United States Patent 9,644,005 (DIDEMNIN BIOSYNTHETIC GENE CLUSTER IN TISTRELLA MOBILIS) - sequence listing, part 2

SEQ ID NO: 62 - DNA, 3919492 bp, Tistrella mobilis (residues 1,959,747-3,919,492 of 3,919,492)
cagcacggtggacccggaaatgccaacctgcgccacgatcacgcaaccgcgaccaaggcggacgttgtgacccagcgtcaccagattgtcgatcatgcaaccatcgccgatgatcgtgtcaggtccggcgccgcgatcgatggtcgaattcgcgccgatctccacgtcgttgccgatcaccacccggccgacctgaggaatacggacatgaccgacggccggatcgctggcaaagccgaaaccatcctggccgatccgcacaccggtatagacatagacccggtcaccgaggatggcgaagccgacataggcgccggcgccgatcacgcaattccgaccgatcaccgtgttccggtcgatgacggcattggcctggataatgctgccgtcgccgattcgggcaccagccatcaccaccgcacccgggccgatctcgacatcgcttcccagttctacgccatcctcaaccaccgcgcgaggatgaactcccgggctggtgggccgtggtggatgaaaccgccgggaaatccgtgcaaaggccatgtaaggtgccggcgacaccagcaggggcagatgggcaggcgcacgctcggcatcggccggcgacaggatgcacagccccgcccgacactcggccagcctgggcagataggaccggttgttcaggaaggtgacgtcggccggaccggcagcatcgatcggggcgacggcgctgagcatgcccgcaggcgccggaccggccagaactgcgttcgccgcctctgccagttcctgcgccgtaaacggcccggcaacatcgaagaaccgtggatcagccatggcttttcccatccctcctgttggagacggcaccgtgacgctcccgccacggtgccgcttccgatcgtctgatcatgtccgcaggtcccgaacggagcccgcagagaccgatcacttcttaggtgcctgggccttgggcagatccagtttcggcacgctcttgttcatgcgctggatgatctcgtcggtcacatccaggccgttgtccaccagaatggtggtctggcgcggcaggaccagggtgtagccccgctcctcggccagattggcaagcacctgcaggaaggcctggtcgatggccatctgcgcacgcgcgctggtctcgtcgaaagaccgacgacgttcggcaaccgccttctgcatctcaccgtatttgcgctcgaactcctcgcggcgcttctggaaggcctcgggagacagcaggctgcgctgcttctggaggtcctcctgctccttgcgcagggcctcctcgtctttggcgatgccgtcgcggaagccggcgcgcaccttgccgagctgctcctgcaggctcttggcggcgctggtctcctccatcaccttctgcacatcgacgacggcaacgctcaacggcttctgctgagcggcggccgggccggcagccacaagagaggcggaggtgagggcgagcccggcggcaagcgcgacaccacgcaggcgctggccgatcttggaagtcatgggttcagaacctcgttccgaagctgaaacggaagacttctgtatcatcgaaatcctccttgagaaccgcctgggcagcgtccaggcggatgggaccgaaaggcgaaatccaggtcaggcccacgccaatcgaggcgcggatcgagttaacatcccggatttcgggaccgctgtcgtcgagttcggtgacactgccgaaatcgctgaacacgcggccacgcacgtcgtagtcatccggcagccccagagggaagccgacttcgaccgtgcccgaatagaggaagttgccgccgagggcatcaccggcctctacgtcgcgcgggccgacaccggcggtcgcgaagccacgcaggctgtccccgccaaggaagaagcgatcattgatcggcacgtcttcacccaggcccacgatatagcctacctgaccactgaccagaccgaccacgtcgtcagtaatcggatagtaccatgcggcatccactcggtgacgcgcgtacttggcatcgccgccaaggccggccagatcctgagtcaagcgcaacagatagccgtcccgtggatcgactttgctgtcccgcttgtcgtaagtgaaggtctggctgacaatcgaactgagacgatcgccctcctgctcccgaatatagcgcgaggcgtcatcgtcgacgtccgttacttcatcattacgcaaggtatatttgagaccatgccgcaggctcggtgtcagccagtaatcagcacgcagtgcaccaccggtcgtcttctgcacataaccggactcgtcttcacggtcgatctcgcggcggaagacgtcgaagccggcggcaacgtcgcgattcagaaaatagggttcagtgaagctgagatcgatcagctgctcatcgcccgaaatcgtgaagcccagccgcagatcctggccccggcccagcaggttgcgttcacggatacccacgtcacccagcggaccggagcccgtcgagtagcccacgccgaacgagatttcaccggtcgacttctcctccacatcgaccttgaccaccgtcttgtcagggtcgctgccgggctctgtggtcacctcgaccttgtcgaaatagtccagattgcggacgcgatcccgcgaggtgcggatgcgctcggcgttgaacggatcaccttccgccacacgaaattcgcggcgaatgacttcgtccagcgtccgggcgttgccgttcacctcgatacgttcgatgaagttccgtggtccttcatcgatattgtaggtgatgttgatgacgtgggtctcacgatccttgctcaccgagggctgaacccgcacgaaggggtagccgcgattggtgacttcagtcgtaagggcctcgacggtgcgatcgaccttcgtcgcgtcgtaccagtcgtcgctttcggtttccaccacatcgctgagcgtggcggtgtcgagccccggcagggtgctctgcacatccaccttgcccagcttgtaacgctcgccctcttccaccacgaaagtgacgtagaactcttcgccctcaggcgccagttccgccacggccgactgcacagagaaatcggcataaccgttcttcagatagaaccggcgcagcagttcgcgatcgtaattcagacggtccgggtcgtaggtgtcattcgaggtgaagaaattataccagcgcgcctcggtggtcaggacgacatcgcgaagcgcactgtcgctgaaccggtcattgccggtgaagctgatcttgcgcacctcggtccgcggaccttcctcgatctcgaagatcaggtcgacacggttctgatcgagctgaatgatcttggggtcaatccgggcggcatagcggccgttgcgccgatagacctcctgcagacgctccacatcctgggcgacccgggtgcgggtgtagaccgtacgcggacgcagcagcacctccttctcgaggtcgctgtcttccaggcgccgattgccctcaaagtcgatccggttgatgaccgggttctcgaccacgtccaccaccagcgtattgccttcgacacgcagggcgacgtcggcaaacagacctgtgccgtagagggtcttgaggctctcgtcaatcagggatggatcggcaggatccccctggcgcaaggacaggtaggaccggatggtctccgcctcgatgcgctgattgccgttcacctggatacggtcgatccggaccgcctgggcggccggtggcgccacgggcgcctgagcatgcgcgattgccgtgctggcgagcatcgtcgccgtcatggtcatggccagccaagaacgcggcacgcggggcctcccacctcaagccagatgtcggccgggcgatcacgcccggccgacctcaaaaattcatgcgacccgccggacctctcccaccgggcccccctctcctgccgcatcacaatgcgtcaggtgaagaggcctgcaagatagtcgacaacccggagcctgacgagatcattccaggtcgctacgatcatcaacgtcaataccaagaccagcccgaagcggaaaccatattcttgcgcccgctggctcagcggacgacctcgcgccgcctcggctgcatagaatgccagatgtccgccatcgagcaaggggaccggcaaaagattgatcaggccgagattgatcgacagcatcgccgtaaaccagatgacggtcgccacactcatgcgcacaacctcaccggacatctgagcaatgccgatcacgcccgccagttcttcggtgcccctcgtcccggcgatcatttccccgacggcgccaaaggtcatggcgacgatcgacaccgtttcgcgcaccgcaccggtgactgcctccaccgggccctgccggacccattctgtgcccgatgccgaaatgccgatccgcggcatctggtgcgtgttgccgaagcggtcatcgaccgacaccatctcaggcgtcagtgacatggaaatgacacggccgtcgcgatcgacttccagcgtcaccggctgaccattgccggcaaccaccgcggtctgcagatcctcgaaccgggtgacggcgcggccgtcgacgccggtgaccctgtcgcccggctccagcccggcagcggccgccggactgtcctcgagaacagtcccgatcaccgccggtgtggtctgctgcccccagatcatgtagagcgcagccagtgccacgatcgcataaatgaagttgaacacggggcccgccgcgacgatggcggcccgcgccttcaccgggcgcccgtggaaggacaccttgccggtcgcaggatcatctgcggcaatgccgcccgcgctggtcgcgtcggcatcgccatacatcttcacataaccgccgagcggcagaagcgaaaccttccagcgggtcccggatttcgccgtccagccgaagatctcggggccgaagccgatcgagaaggtctcgacggtcacaccgcagcgccgcgccacccaatagtggccgaattcgtgcacgaagacgacgattccgagcacgacggcgaagccgatcgggtagctcagcgattggataagctggtccatctgcagcgtcagatcccgcttgaagtgcatcggcgcatccgccggcgcaaaaggtcgtccgaagggtggtcgtggccgttcaacgggcgtccaccagggccacagcccggcgacgggccgctgcgtcgagtgcgatcacctcgtcgatcgacccgggggcccggcgaggctctgcttccagcgtatcggccacgacaccggcaatgtcgaggaagccgatccggcgggcaaggaaggccgccacagccacctcgttcgcggcattcaggattgtggcggcgccgtccccgcatttcaaggcgtcgcgggcgagggccagacaggggaaccgcgtcacatccggcgcttcaaacgacagcgttgcgatcctcgccagatccagcctgtcgctcggcgccggccgccggtcgggccaggccagcgtccaggcgatcggggtgcgcatgtccggcgcgcccagatgagccagcaccgatccatcggcatactggaccaatccatgaatgatcgactgcggatggaccagcacgtcgaggcggtcgagacccaccggaaacagatgatgtgcctcgatcagttccagccccttgttcatcatcgacgcgctgtcgaccgagatcttcgcccccatcgaccagttgggatgggcaaccgcctgctccggcgtcacctggcgcatctgatcgagggtcaagctccggaacgggccacccgaggcggtcagaatgaccttctcgaccacatgcaggcgctcaggttccaggatctgggcgatggcgttgtgctcgctgtcggccggcagcagccgggcgccatgacgttccacttcggccgtgaacagatcgccggcacagacgaggcattccttgttggcgagcgccacgagcgcgccacgacgcacggccgccagcgtcggcgccagaccggccgagcccacgattgccgccatcacccagtccgccgggcgttgtgccgcctcgatcaaggcctctggtccggccgccacgtcgataccgctgccggaaaggcatgccttcagatcggcatagcgtgcaggatcggcggtcaccgccaaccgcgccttcagctgaacggcatcgcgcgccagctgctctacattgccgttggcggtcaacgcctcaaccggatagcgctcgggatcacgggctatcagatcgatggtctggcgaccgacggatccggtggccccgaggatggagatccgtcgcggggctccggacgctgcatatgaggaagaaggctgcgcaggtgactgtaagggttgggtcatagtccctcggcaaacaggccgccggtcaccatcagcatgagtgccagcgccggggcagcgaacaacaggccgtcgagccggtcgagcaggccaccatggcccggcagcagccggccgctgtccttcacgccgaaatggcgcttcacgccgctttcgacaaggtcgccgatctgctcgacgaccgcaagcgccgccccggcagcaccaatggccacgaggtcctggggcaggcgcacaccggcgatgacggcaaccagcacggaaatgacaaacgcggaaaacatgccgccgaacagaccggcccaagtcttgttcgggctgatgcgcggggcgagcctgaacccgccgatggccctgccgaaaacgaacgcgccgatatccgtggcccagaccacgagcatcagccagaaggtccattccagcccgagcggctgcgatctcagccagatcagcgccagaaccggcaggccgacatagaccacacccgccgccagccagcgccgccgcgcaccttcgatcttcaggaaggctgcggcgagcgccgcaaccgcaaccatcagcagggcggcctcgtagcgcccggtcccggcgatccaggcagcgccaccgaggatggcgccgagggccagcccgaccgccatccaggtgatgccggtcagatcgaccagccggcgccactcattcagcagaagcaccgacagaaggccggcaaagagatgaaacacatcgccgcccagatagatcagggccagcaccggcgggccaagcaccaacgtcgtcagcagacgcaattccagcgtccgccgccgctccgcccgggcatctgcggccgcctcctcacctcctgccgagggtcggggtccgctagacggcgccatagcgacgttcgcggcgtttgtattcggcaagcgccgcatcgagcgccgcctcatcaaaatccggccacaatgtcggaacgaagatcatctccgcataggccagctgccagagcagaaaattgctgatcctctgctcgccgctggtccggatgatcagatccgggtccggcaggtcgtgggtctgaagacgggcgccgaaagactcttcgtccagcccgtccagatccacccggcctgcaagagcatcggccgcaagctcccgcgccgccgccaggatctcggcccgcccgccatagctgatcgcgatggtcaggaccattccggtacaatgccgggtccgttccacagaccgatcgagaagatcgcgcatgtccgaagacagtcgcgaacggtcgccaatgaagttgaggcggacattccgatcgatcagcagtttgacttcccggtccagatagaaccgaagcaaccccatgaggtcacgaacctcgtcgagcgggcgcttccagttttcggacgagaaggcgaacagggtgagataaccgatcccgtgctccacggcgcgatcgatcaccttgcggaccgattcggccccgcgatagtgaccgacggtgcgcggcaggccgcgggctttcgcccagcggccattgccgtccatgatgatcgcgacgtggcgcaaggggggatctgagaccagcgccatggggctcggctccatcctgaggggacgcgctccggactcagacctgcatgatctccttttccttcgccgccaccagatcgtcgatctgcttgatgcgttcatccgtcacggtctgaacgcgatcagaagcaccacgcagttcgtcctggctgatctcgctgtctttctcgagcttcttgagcttatcgaggccgtcacggcgaacattgcgaaccgaaatgcgggcctgctcgccgtaacgcgaggccaccttgcccatctcgcggcggcgctcttcggtcagctccggaatcggcacccggatcacggcaccctcaccgatcgggttgagacccaggccgctgtcacgaatcgcccgctcaaccgccttggcaaggctctgatcccagacctggaccgacagcatgcgcggctcgggaacgctgatggtcgcgacctgggagaccgtcatctccgagccataggcgtcgacacgcaccggctcgagcagattggccgaggcgcggccggtacgcagacccgccagctcatgcttcagggcgtcgaccgcgccgtccatgcggcggcggacgtccttgatgatgtcatccttggacacggttcaggcctcgttggtaatgatggtgaaaagtccccgaccgagcatcacctcggcaaagccgccggcatgatgcaggttgaaaaccacgatcgggatgttgttgtcgcgggccagcgtgatggcggaagcgtccatcaccttcaggtcacgcgaaagaacctccagatagccgaggctgtcatagcgttcggcgcgcgggtccttcttggggtcggcagtatagacaccgtcgacctgggttcccttcagcagcgcatcgcaacccatctccacggcacgcagggcagctgcggtgtcggtggtgaagaaggggttaccggtaccggcagcgaagatcaccacccggcccttctccatgtgccgcacggcacggcgccggatatagggctcgcagatgctcgacatcgggatggccgactgcacccgggtcgcaacgccgatccgctccagtgcactctgcatcgccagcgcgttcatcaccgtcgccagcatgcccatgtaatctgccgtcgcccgctccatgccggtcgcggcaccggaaatgccgcggaagatgttgccgccgccgatcaccaggcagacctgcacgcccatggactgcacggaccggatctcgccggcgacgcgctccaccatatcgacgtccagaccgtactggcgattgcccatcaacgcttcgcccgagaccttcagcaggacccggcggaaccgcggggtggagaacgacatggattgtctcctgttcgacgacgctgttcggcccggaagggatgcgaccgggtccggaatggctacgccggcattggccggacggatgcggacacggtgtgacagccgcggcagcgacgccgggcacgggccgtgtaacgtatagccgtgcgcgcgggccaaggcaaccgccgcaaaagggcgtgcggcactgccggcgggaacaaaaaaggggcgccccgttcgaggcgcccctctttcgcatctgcggatcggcagaggatcaggcgcccagcgccttctccacctcggccgcgaagtcttcctgcttcttctcgacgccctcgccgagttcgaagcgggcaaaggccttcagggtcaccggcgcaccgaccgtccccttggcattctccacgaccttgcggatcttggtctcgccgtcgatcacgaagatctgttcaagcaggcagacctgctcgtagtacttgcggatccggccttcgaccatcttctcgatgatgctctcgggcttgccgctctcgcgagcctgctcgatgagcaccgcgcgctcgcggtcgagcgactcggccgacacgtcggcgacgtcgagcgcctcgggacgggccgccgcggcatgcatggcgatctgacggccgagttcggccagcttcgccttgtcaccggtcgactcgagcgcaaccagcacgccgatcttgccaaggccttcggcgacctggttgtgaacataggcggcgatcacgccatcggtgacctcgagcacggccgcacgacgcagggccatgttctcgccgatggtggcgatcagatcggtcagcttcgcctcgacggtgccgccatcgggataggccgccgccttcagcgcctcaatgtcggcgccggcctcgagagtgacgcccgcgaccttggcgacatagtcctggaacttctcgttgcgggccacgaagtcggtctcggagttcacctcgaccaccgcggcgcgcagaccgtcgaccttcacgccgaccaggccctcggaagccacacggctcgccttcttggccgcctgcgacaggcccttggtgcgcagccagtcgatggccgcatccaggtcgccgtcgttctcggtcagcgccttcttgcagtccatcatgcccgcgccggtcttctcgcggagctccttgaccagggcagcagtgatctgagccatgattccacctcgtgtgagttctgttgcgaacgcagtcgcctgacggcgcatcgcgtcacggaaatcctgcgggtccgggttcgcatatcctgcggctaaggggccgcatgcgccctgcccgtcttgagttctgtcgtcgatccggcccggaaacgcgaacggcggcaccccggggcgccgccgcatcgccagccgcccccggggtgagggcggccgttcgtccgtggtccggatacgtcaggcctgggcctcgcccgcagtctcttcggtcgcctcttcctcgacggcttcgtcgtcgagatcgaccgagaccggatcggccagcgcgccgagatcggcgcccgaacggatcatctcctgctggatgccgtcgaggaccgcgcccgagacgagctccagataaagctggatcgccttggtcgagtcgtcattgccggcaaccgggaaggtcacgccgtcggggttcgagttgctatccaggatcgcgatcaccggaatgcccagcttcgccgcctcgcggaccgccagctcttccttgttggtgtcgatcacgaacagcgcgtccggcaggccgcccatgtccttgatgccgcccagcgacgcctcaaggttgtcgcgctgacgggtcagcttcagcagctccttcttggtcaggcccagatcggcctgctgatcgaggagctgctcgatctcacgcagacggcggatcgagttggagatggtctgccagttggtcagcatgccgccgagccaacgacggttgacgtagtactgaccgcaacgcttcgcgccctcggcgaccagctcctgcgcctggcgcttggtgccgacgaacagcacgcggccacggttggcgacgatgtcgcgcaccgcttccatcgcacgatagagctgcggctgggtctcgcgcaggtcgatgatgtggatgccgttgcgggtgccgtagagatacggcgccatgcgcgggttccagcggcgggactgatgcccgaagtgaacgccggcttcgagaagctgacgcatggtgaaggtgggaagcgccatggaaaatcgtccttttccggttcggcctccgcgaggttgagatcggcaccggcatcgtatcctggggctttcccccgggatgcgacggccaccggtaccgacaccggagcgacgccgaccgcccttccccatgttttcaaggggcatgctggcggttggccgcggacctcgcgtgcgtgtgaacgccccgacgaaccctcgtcggaacggccgctctatagcccgggcggcggggtttggcaagggtttagcaggtgatcgccgccgctttccgccgtttttgcgacgcgtcaggcctcgatcgcgtcgatcacccccggcgtgatcttgagcgcggccttgagcgccggcgtgatcgagaccggcttgggcagatccaggcgcacgacctggcgctccccctcgaggtcgatatccagctccagggtaatgcggccgcggccctcgggttcccgttcgatcagccggcggatcagcgccagcgcccgctcctccgccacctgaatggtcagacgggcggaggacgaggctgcgacatcgtcgagcgagcgaacgttctgagccgtcagccggacggtgtcctcacgccattcgccgctcgcctcgatcagcagcggcacaccgggctccagcagatcgcgggcctgggacagggtttccgagaacagggtcacctcgaacaccccggtcggatccgagagctgcgcgaaggcgaaccggctgcccttggccgaccggcgttcctgcttggcgatcagcgtgcccgcgagcttgaggccggctgccccttcccgctccagcttggccgccagatcgccggccctgaccacccccagccggtccatgaccttgtcataggcgtcgagcggatgggccgagagatagaagcccaccgcctccagctcccgcttcagctgctccatcggcatccacgggtcgaccgagggcatgggcggcttgggcacggcctcgccgcccggcccgccgaacaggctgacctggttgctctcccgttcctcctgggcggcctggccgtagcgcagcaccatgtcgatggcgttcatcacctgcgcccgattggcgttcagacgatcgaaagcaccggccttggtcaggctttccatcatgcgcttgttgatgaccttggtgccgagccgggccgagaggtcgaagagatcggcataaggcccgcccttacgacgctcggccacgagttcctccatggcctgcgggccgacctgtttcagggcgcccagcgcatagaggatctcgcccttgggtgcgctcttcgtccggcgcaccgagaacaccgcgtccgactggttcacgtccggcggcaccacgccgattttgagccggttcagctcctggcgaaaaccggccagcttgtcggtgttgtgcatatcgagcgtcatggaggcggccatgaactcgaccggccagttggccttgaggtaggcggtctgataggcgaccagcgcgtaggccgcggcatgcgacttgttgaagccataacctgcaaacttggcgatctggtcaaagatcaggccggcggtctccttgtcgaccccgttggcgacggcacccttggtgaagctctcacgctgggcgtccatctcctccttgatcttcttgcccatcgcccggcgcaacagatcggcctggcccaggctgtagcccgccagcacctgggccgcctgcatcacctgctcctgatagatcatgatcccgtaggtttcctccaggatcggcttgagcatgggatggaggtattcggcctcttccgagccgtgcttgaccgcaatgtagcgcggaatgttatccatggggcccgggcggtagagcgccaccaccgcgatgatgtcttcgaacttatcggggcgcatcttgcgcagcacgtcacgcatgcccgagctttccagctggaacacgccgacgccttcgccgcgggccaacatctcgaagctcttccggtcgtccagcggcacgcggttgatgtcgaaatcgggctcgacctgccggatcagccgctcggcggtggtgatcacggtgagggtcttcagtcccaggaagtcgaacttgatcagcccggtctgctcgacatacttcatcgaaaactgggtgaccggcatgtcggagcgcggatcgcgatagagcggcaccagctcgtcgagcggcctgtcgccgatcaccacgccggccgcatgggtcgaggcgtgtcgataaaggccttcgagcttgagcgcgatgctgatcagccgcgcgacctgttcatcctcgtcccgcgcccgctgcagcgccggttcgccgtcgatcgcctcctgcagggtgaccgggttggccgggttgttcgggaccagcttgcagatcttgtcggtctgaccgaagggcatgcccagcacgcggcccacatcgcgcagcaccgcgcgggcctggagcttaccgaaggtgatgatctgggcgacgcggtcgaagccatagagttcgcggacgtgctggatcacctcgtcgcggcggtcctgacagaagtcgacgtcgaaatccggcatcgacacgcgttccgggttcaggaagcgctcgaacagcaggccaaaccgcaacgggtcgagatcggtgatggtcagcgaccaggccaccaccgagcccgcgccggaaccgcggccgggcccgaccggaatgccgtgagccttcgcccactggatgaactcggccacgatcaggaagtagccgggaaaacccatcttcacgatcacgtcgagttcgtagtccagccgctcccgatagggtatcgcaacggcctcgcgcgccgcctcgtccatggcgggcgtgtaaaccgccgtctcaaggcggcgctccagcccttctttcgaaaggcggcggagttcgtcctcctcccgcgcattcggatcgcgggtggatttgggcaggatcggcttgcggaagggcgccttggccgcgcagcgctgcgcgatcaccagcgtgttgtcgaccgcttcaggcagatccgcgaacagcgcccgcatctcggccgccgatttgaaatagtgatggggcgtcaggcggcggcggttggtatcctcgatatgccgaccttccgcgatgcacagcagcgcatcatgggcctcgtacatcgcctcggtggtaaagaagacgtcattcgtcgccaccagcggcagatcgagatcataggcgatctcgaccagccccggctcgctgtccgcctcggcgtcgggcggcgtctcccccggggcgcaatggcgcatcagctcaatatagaaccggccgggaaagatcgctgccagacgctcggcctgcgcccgcgcctcgtcgtcccgcccctccaggatgcgggcgcccaccgggccattggggccgcccgacagacagatgatgtcggacgaaaactctgccagaacctgttcggaaacctggggagtttcgccggtcggcgtctccatgaacgcccggctgacgatccggccgagattgtcgtagccggccccggtctgggccagcagcaccagcggctcgggttccggccggcggccgaagcggtcctcgccggcagcacgggtcagccggatgatcatgcccaggatcggctggatgccttccttgggcagggtggaggaaatctccatcgcgccgaacagattgccggtgtcggtcaccgccaccgccggcatcttctgcgctttgaccagcttgaccagatccttggtcttcaccgccccctcggacagcgaataggcggtatggacgcgaagatggacgaaatcggcgtgcgacacaggtctgggcgctccatcgctcggggcggggacgatcccggaaatctggaccaaatccccgcccggagcaaccttgggcacacccctcgccgacggtcagttcagtcgggtcgagagatgcgccacgatgccatcggtcgcaggcgtcggccccttgcactgctggcaggtctcgatcagacggtagtcagcgcgatagtcatcgtcggcgaaccagtgggtcagtgcccgcaacgtgcgcgcacggtagtcctcctgctcggcgcccagggtggcgagcggggcgtgatggatgtaggtaccaaacaggtcctcgcacatcccgatataccagcgggtatcgagaatagcacggtgccagtactcatctgcctccacccccggtgcgtgatagctgtcggggtcaaggaacatgagcgcaaggaactgcttgagcttcatctcggcccagcggcacttctcggccgaccagccgaacttcgccgcgcacatgtcgttgacgcgcgagaagtcgtaagcctcgagccggtccagaacggcaatcagccgatcattcaagggatcacgatgcagattcaaaggaagggtcatcggaagtctcctgcgaaaacgtcgcaggcccggccgcggaccttatggccggccgcgcggcagagccatccggaaaggaagaaggcggtgtcggaacgtctcatagaaagcctgcagcgcgatccgagcccgtatgatccgcatctcgctgcagctcaaaaaattctatcctgagttcatattccaggcaataaacctcgcatttgattcagtttgagttcatttggtcagaaaatcgagccgcgcatcggctcggtttggcgtgatcttcacgatctcggctgtgaccacgccctgtgccacgaatggatcagcggtcacccgcctttcgacgtcctcctcggagaggccatggataaacactgtgccgccctgtccggcagcaaggctgccggcgagcagaaaccgcccctcggcgaagccctcatcaagccaggccttgtggccggccaaaaccccggcggcctttccacgatcgatgaacttcagcagcactacgaacatagtcagtcatctccctggattgccgtgcccggtcagtgtgcggacacaccatcggcaaacctatggaagatactgaacaccccgacgaaagaagctttcaggcagacctgccatcgagtacgggggcgagggtccgaagggcgcgcgccagcgcatcggccgcgctgcggatgcgtggcacccgggccatctcgggatgaaccagaagccagagaccgagcgagagccccgtcagaggctccgataccctgaccagccccgggatggctgcgccgataaagcagggcagcactccgaatccgatacccgatcggaccgcctgtgccgcgcccggcagggtattggcgcgaaagcggatccgggattcggggatacgcgccgcgacccagcggccagggccggtgcaggcaagccccgcgtcatagccgatccagggccggtcggcagggttgccgtccatccacttccgtgccagttcggcatcggcgtggaccgccatcgccaccgtgcccacccgccgccccttgagcaccggatccggggcttcggtgacgcgcagtgcgatatcggcggcacgtcctgccagagaaacgacctcgttcgacaccaccagttccacggtgacgtccggcagttcccggcagaggctggccagcacgcccggcagcaggtactcggccacggcatccggagccgtcagccggacgacgccaccaggggcatcatccctgccgcggatgcggctctccagaccctggatatcatcccgcagacggatggccagatcgcgcatctcctccccggccgcggtcagtcgccaacggggcgacgtgcggtcaaacagtcgcacgcccaatccggcttcgatctgccgcaggcgccgggagagggtcggatgactgatcctgagggttaccgccgccgcggtcacggtgccctgctcggcgacgaccagtaccaggcgcagatcatcccaattgaggccagagacttgcgacataatctgaacccgtgcctggagctgccggagagcggtgccgggaccgccctccagctatagcccggcgcagatcagacggcaaacacccccggccggtcctgacgccagggctggagcccttccagatcccgccccagctgcagcaggatgtcctcgcgacccatgccggctgcgagctggatcggcaacggcatgccgtcatgcatacccgcaggaagtgccatcgccggcagcccggtcatgttgaacggcgcggtgaaggggacggtgtcgaacaaccggtcataccagccccgcgcatcgagatcgggatcattctgatcaagatagccaagcggaaccgggatatccttcagaaccggcatcagaatggcatcataagtgccgaagaaggcgccgaaactccgcgacaccgtgttcatgaccataaaggcctgctcgacatccagtgccgtgagcttcgcccctgcctgcgcacaggccatggtcaccgcttcaacggtgtccggcccgggctgcaggttcagcatctcggccataccgtaaacccccgcggcgaggaacgacatccaggcggtaaaattcgcccggtggaaggcggccacatcgtaatccggcgccgcctcttcgacgacatgcccttccgcttccagcagtttcgcagtccggaccagcgccgcatcgatatgaggcgccgctgccggcgaccccggccaccgccgtgccagggcgatgcgcagctttggcgtcggtttgcggatggcctcggcatagggcacggctggcggcgggatatcggtcattgccccgggatcggcccctgcgaccgcatcgagcagggtggcggcgtcgcgcatgcttcgcgtcaccgcaaactcgttggccatgcccagcagcggcagaccgtaatagggcccgaacggtatgcgcccgcgcgagggcttgagacccaccagcccgcaggccgcagccggaatccgaatcgagccgccgccgtcattggcatgggcgagcggcacgacgcccgccgcaaccgcagcagccgagccaccagacgacccgccgggggagcgctccagattccacggattgcgggtcggtccgtagagtatggcctccgtcgtggcgttgaagccgaattcgggcgttgcggtgatccccagcgtgttcaaccccgcccgcctgaaacgggcaaagagttccgaatcgaccggaggcacgaactgcccctggcccagcatccgcgaacccatcatttccggatggccgccgaccgccaggaccagatccttcaccaggaagggcacaccggcaaaaggaccggacgggtcacccgagaccggcgcgtcgaaacggcgaaccaccgcattgatccggccgttcactgcctcgatcgcctgattggcgcattcggtcagctcggcggcgctcacttcgcctgccgcgaccagaccggcaaggccggtcgcatcctcggcaacgtaatccttcagatccatccctcgtctccctgttttgtatggcgggacccgaggattttcggcccatccgtggccggcctccaggatgcagatggatcacatcgacccgagcaccgtcaccagagcggcacgggaattgatccccagcttgtcgtagatccggcgggtctgattgcggatggtgacgggtgacagcccgagttgccgggcaacttccttgtggccctggccgcgggccagcagggcggcaatctcagcctcgcggggggagagccggtccacaggcgccacccggcgcagcaccagccgcaccagtccggcccctgccccatcgacctcggccatcagtccgagtgccggaacctcctgtcgccccgggtgtccgaggatctcgcggagcggtgtcggcagccacggcacggctgcgagacccagccgtgccagatgtcgccagccgaaaatgcacagccccgccggggtgacatgcaggtgcacgctatcggcatcgttcggcgcttctgcacggccacgaaccatgcggtcgagggttgtaaccgcaccgtagaggaaatcctgctcgtcctcatgccaggatctcccgtccccaccaccgcgataacaggcgaggaagagcgaggcgggctgtcccggccggaacgacatcgcacccgccgcggcatcgaggtcgtagcgccccgacatccgtatcagcccgggcgtctgttcgagctgccgcctgcgataggtggcaacccggtcgggcgcacggcggatctggcccagcatcagatcgtcatgacgcatcgcccgccagtcgtcgaagaatggaccggtgatgttgaaggtgcgcgaggccgcgatctccacccgcccgccatcccacgcggaaaagccgtaccaggcggaatcgaaacccagcacgcccgccagccgtccgatcgccagatcgagcgcatccgccggcgaggcttcagcgaggaagccgtcgacgtcttcgagccaagccgagaagctgcggatgcccatggtcatgggggaagcgtccccttgaagcgagacgacatgcagaccgtccgccgatgttgacacggcccgaggcatccggcaacgacgccatcccactgccccacaacggaaagccggcagcccccgaggggactgccggcttttcgcaaaggcatacccgatgcacggggccgcagatcccggaaggatcgcagccccggcgcggatcagcgcttcgagaactggaagctgcggcgggccttggccttaccgtacttcttacgctcgacgacgcggctgtcgcgggtcaggaagccttccttcttcagcggcttgcgcagggtcggctcgtagagggtgagcgccttgctgatgccgtgacgcacggcacccgcctgacccgacaggccgccgccgaccacggtcgcaacgatgtcgaaattgtcgacgacattggccacggtgaagggctgacggatgaccatcatcagaaccggacgcttgaaataggcgtcggcgtcctggccgttgacggtaatcttgcccgaacccggcttcacccagacgcgagcgatcgcgttcttgcgcttgccggtggcgtaggagcggccctgcgcatcgcggaccggctcggggagctgctcgtctgcgatcagaccggcggcctgggccatgtccttcagcgcgccgaggccctgggcctgaacgttggtttcggtcatagctcgattaccccacgttcttgcggttcagggcggcgacgtccagcggctccggggtctgggccgcatgcggatgctcggggccggcatagacgtgcagcttgcgcatcacatcgcggccgagggggccacgggggaccatgcggcgcacggcggcctcgatcacgcgctcagggtagcggccgtcgaggatcttgtccgcggtccgctccttgatgccgcccggatggccggtgtgccagtagtaggtcttctggacgcgcttgcggccggtgagcaccaccttttcggcattgacgatcacgatgtgatcgccgcaatccatatggggggtgaacatcggcttgtgcttgccgcgcagacggttggcaacaagggcggcaagacggccgagcacgagcccgtcagcgtcgatcaccgtccacttgtgctcaaggtctgccagcttggcggtataggtcttcatgagccttggcaccgagatgggttcttgaaactggaggcggagtatgccacggaacccgcggccgtcaatggcgaagaagcgccttatatcaatagcttataaaatcggtatcataataccacaaacgctgagccaggagaaccggggcttcccggccgtttgttgtacgccagaaggtccggcagggcttggacggtcgcgccggccggcgttatgatgcgcacgaaagcatacagcatcccccgaaagcgcgcgcagcatgacgcccgcgaatacagattgagtaagggagggacaccgcgccatgactgatcagtcgccgacgaggaccgccgaggctgcccctatccggcttgaggtggaggccgatggcgtcgccgtgctcactctcacccgttccgctcagcgcaatgcactctcgctcggcatgatgaccgcgatcgaagccgcgctggaacagatcgccgccgatgccgccgcccgggtggtggtgctgcgcgcggaaggcccggccttctgcgccggccacgatctgaaagaaatgcgggcgtcaccggatcgcgcctcatacgaagcgctcttcgcccagtgcagccggatgatgacccggatcgtgcgcctgcccaagccggtgatcgccgaagtctcgggcatcgccacggcggcaggctgccagctggtggcgagctgcgacctggcggttgccgccaccaccgcccgcttcgcgacccccggggtcaatctcggcctgttttgctcgacgccgatggtggcgctctcacgcgcggtcggccgcaagcacgcgatggagatgctgctgctgggccagatggccgatgccgagacggcgtaccgcttcggcctggtcaaccgcgtggtcgcccccgaagagctgtcggacaccgtgatgggcatggcgcggatcatcgcgtccaagtcgccgctgacgcttaagatcggcaaggaggccttctacgcgcaggtcgagatgccgctcgacgacgcctatgcctatgcctcccgggtgatgaccgaaaacatgatggcccgcgatgccgaagagggcatcgacgccttcatcaacaagcgccagcccgtctggcaggggtgctgatccgatgaccgggacccgtgcggtcgtccatgaccgctatccggatgcctatatccgcgacatcctgcgcaacacccgcgtcatcgccatggtcggcgccagcccgaactggaaccggccaagctatttcgccatgaagtatctgcaggaaaagggctatcgggtgatcccggtcaaccccgtcgccgccggccagaccattctgggtgaacccgtctacgcgacgctggacgagctgccggtggtccccgatatggtggacatcttccgcaattccgaagccgcagggccgatcaccgacgatgccatccgcatgggcgcgaagacggtgtggatgcagctgggcgtgcgcaacgacgcggcagccgcccgcgccgaagcggccgggctgaacgtggtgatgaaccgctgcccgaagatcgaatacggccgcttgtccggagagctgggctggagcggcgtgaacaccggcgtgatcagcgccaagcgcatggggccgccccgatgaccgatcagacgacgaagccggatgccgccagcggcgccggcggcttcggcttttcaaccctcgccgtccatgccggcaaccggccggagccccataccggcgcgcgggtgacgccgatctatcagacctcgtccttcgtgttcgacagcgtcgaccacgccgcgtctttgttcaacctgcagaccttcggcaacatttattcgcgcctgggcaatcccagcgtttcggcgctggaggaacgggtggcggcactcgaaggcggccgcggcgccaccgcctgcgccagcggccatgccgcacagttcctggcactggccagcctgatggaggcaggcgacgatctggtcgcctcgcgcttcctctatggcggctcgtacacgcagttcagccagagcttcaagcgcttcggctggggttgcagcttcgtcgacgcccgcgaccccgacgaagtcgccagggcgatcgggccgcgcaccaaggcagtgttcgtcgaaagccagtccaacccttcgggcgtgctcaccgacatcgccgccctcgccgatgtcgcccatgcccacggcctgccgctgatcgtcgacaacaccattcccagcccctatctctgccggcccttcgatctgggcgccgatctcgtcacccattcgctgaccaagtttctgggcggccacggcaattcgctgggcggggcgatcgtggaaagcggccgtttcggctggaaggcgtccggcaagttcccgtcgctgtccgagcccaatcccggctatcacggcctgcggtttgaagagaccttcggcgactttgcctttaccgtccatgcccatgccgtggcgctgcgggatttcggcccgacgctctcgcccttcaacgccttcatgatcatgaccggaatcgagaccctgccgctgcgcatggaccgccatgtcgcgaatgccaagacggtcgcggcgtggctggaagcccatcccaaggtcgcctgggtctcgtatgccggtctgccatccagcccgcaatacgatctggggtgccggcagatgccccgcggcgtcgccccggtcttcaccttcggtctgaagggcggctatgaagccggtatccggctggtggaaagcgtggaactgttcagccatctcgccaatgtcggcgacacccggtccctgatcctgcacccggcctcgaccacccatcgccagctgtcacccgaagaccggacgaagagcggcgccggtgacgatgtcatccggatttcgatcggcatcgagacggtcgacgacctgatcgcagatctcgaccaggctttcgcgcagatctgaccacacaagtcccccgacccgaggcttccattccgttcatggctccgtcgcatttccccggggcaggtcctgccctgcccgcccttgcatccgtcgaccggctgatctttctgcgccatggccgcacggccttcaatgccgagggccgcgtcgccggccagagcgacatcccgctcgacgaaaccggccgcgcggaggcctgggcggccatcgaaccggtccgcgccctcggccccgatgccatcgccgcaagcccgatgcagcgggcacggagcaccgcggcgatcatcgccgaagggttgggcatgaccgatgtggtgcagctggtcccgggcctgcgcgaacggaactggggcatgtatgaaggtgcgccactcggcgaccggcccccctacgaagaaacgccgcccgggggcgaaccctgggcagcgttcctggatagaacggcgcatgcccttgcaggggcattacgcatgatgggcagcccgcgccgcccgctgatcgtcgctcactcgggcacgtcgctcgccctctcgaagctgctcggcgcaccgatgccggtcgagaaggcgcagaacgccgtgccgctggtgttccagcgcgcccgcgacgggtcgtggcgctgctggatcccggggagctgacggcgcgggtgcgcagcagccgtcaggcggcaaccgcctgcggcaccagacgggcgatctcggcctcggccgccgcgatcgccttggcgcgtgcctcggggcccatgccgatgccctcggcacgaacgatctcgacatcggtgatgccgatgaagctgaagaccgccttcagccagctctcctgatgctcgaaggctgccatcgccgggttcgaggaatagacgccgccacggctcgacaccacgatcaccttgcgaccaccggccaagccttcggcaccattcgggccgtatcggaaggtgcggccggcgcgggccagacgatcgatccaggccttgagctggctcggcaccgagaaattgtacatcggcgcgccgaccaccacgacgtccgccgacaggaactcgtcgagcaccgcctcggccagcgccagctcatcctgctggaccggcgtcagatcctcggtcttgccggcacggaccaccggcatgcgctccgccgacagatgcggcagctcgtgggccgccagatcgcgggtcacgacttcgaggcccggcatggcctcggcgatggccgtggtgatggtctcgaccagctggcggctgaccgacgcgccttccgtggcgctggactggatctggagcagcttcatggagcatatccctgagtgatagttgagatggtagaaaaccttctccctatacctgccgacggaacgggcctgacaccagatggcaaattctggataatacgttccattggtggaacgccagggcgaggtggccgatgcaggacctgaacgatctgatgatctttgcccgcatcgtcgagcatggcggtgtcgccgccgccgcccgcgctttgagcctgcccaaatccacggtcagccgacggctggccgcactcgaagaccgtctcggcgtgcggctgatccagcgcaatacccgcgcctggacggtgaccgaggtcggccgtgcctatcaccgccattgccaggccgtgatcgccgccgcagaggccgcacaggaggtgatcgatcacagccgggcagagccgcgcggcctgatccggatgagctgccccctgccgctgctgttcacggcgatcgcgcccatcctctcccgcttcatggccgattatcctgaagtccgggtggaggtagaggcgacccagcggcgggtggatgtgatcgaggaaggcttcgatctggcgctgagggtccggcctctgccgcttgaggacaccgatctggtggtgcggatcctgggacagagcgcgagcgtggtcgtggcgtcaccgcagctgctgcatggccgcccgcccgtcacgcggcctgaagagatcgcgacactgccgaccatcgcccagacccttccggggacgcgcagccatgcgggcaatgacaccaacccgccccatcattgggtgcttaccgggccgggcggcgagatcgtgcgggtggcccatcatccgcggctcgccgtcgatgatctgcccaccctgcatcacatggccctggccggcatcggcgcaacgatcctgccggattatctggtagccccgcatctggaggccggacggctggttgccctgttgcccgactggcacccgccatcgggcgcagtgcatgccgccttcccatcccgccgcggtctggttccggccgtgcgccgcctgatcgaccggctggcggacgagttcgatggcgaggccggctattcacgaggagaccgcagatgtccgtagcccgccgcttcatcaagcaggaactgccgctccatctggtgcggcgccatctggagccgggtccggtggtcctgttgacctccgcccaaggcaccagccgcaatgtgatgacactgggttggcagacggtgatggagttctcgccatcgctggtcggctgcatgatttcggccggcaatcacagcttcgagctgatccggcagagcggcagctgcgtgatcaacgtcccgccggccaacctgatcgatacagtggtcggtatcggcaacaccagcggcgcggatatcgacaaattcgagacctacagtctgacgacggagccaggcgtcaaggtgccggccccgtccatcgccgagtgcttcgcaagcttcgaatgccggctctcggacgaccgactggtggagagccacaacttcttcgtcttcgagatcgttcatgccacggtcgcccgtctggcccgcatgccgcggaccctgcactataccggtgacggtgtcttcatgatctcaggacggcggatcgacaagtcggccctcttcaaccctcatatgctctgaacaccccctgaaccaagcggagatctcacgccgcggcaagatgtgcctgtatgaaggctccaaaggccttgaccgccatggatggttgctcgccggcatagacgactgcgattccgattccgggcagagccggcatcagatcgtccagggtgaaaaggtcctgcggcacggccgagccggtaatcacgctgatcgcctgtccggaacgcgccacagcaagcaggccggccaggctgttgctggcaaaggaaatccggtagggccggccggccttatccatcgcattgcaggcagcgcggtgatcgagcgtgtcgggtgccgacaatgcaagcggaacgatcttctgccccatgacctcgggttgagggctgttcgccacccaaacgaaagattccggccggatgatcgacccgccgcttgcgtcatcaggcagggagatcaccgccaactctatctgccggcgatgcagcatggggcgtaactccaccgtcggcgcgcagaccacttcgatttccaccgacggatgtcgcgcattgaaccccctcagaatttcgggaaagaaggctgtcagataatcctccggacagccgaatcggaccaagccctgcaagccactccccgacagatccgagatggcctcgtcatgcacaccaagtatgcggtcggcatagaccagcagacgctctcccgtcgtcgtcaggcgcataccgttgccggtgcgatgcaggatcggctggccgataacggcttccagccgctgcatctgcatgctcaacgctgattgggtacggccgacctgaagtgcggccgtgctgatggatccgctccgcgaaacggccacgaagctgcgcagcagctggatgtcgagagacagcatgatatcaattttcctgatttttgattttcatactatgaatttgaatgaaatcaaagccctgactaccctctcttcagccacggcatacgtgggtagatccaagggagaatatctatgtccgtcgggacacatgtgtcggccaaccacgatccgtctttctgggcagccgtagacagccacgtcctgcgctatggcggcagtttcgagcatgcaatcatcgaacgtgcaaagggcagctacgtctatgatgccgatggcaagccgatcctggacttcacctccgggcagatgagtgcgcttctggggcattctcacccgcgtattgtggagaccgtgcgtcgtcagatcggtgagctggatcatctcttcagcggcatgctatcccggccggtggtcgaactcgctcgtcgcctgggatccctcgctcctggccttgaaaaagtcatgctgctttcgaccggagccgagtcgaacgaggcagccattcgcctcgcaaaactggtgacgggacgacacgaggtcgtcgccttctccaaaagctggcatggcatgaccggcgctgcggtctccgccacatacagcaccaatcggcacggctacggccccgcaaccgtcggctccttcgccatcccggcccccaatccctacagaccacgcttcttcctgccggatggaagcctggactggcaaaccgaactcgatgacgcctttaccctggtcgacgcccagtcatcgggaagcctcgcagccttcattgccgaaccgattctctccgccggcggcatcattgatctgccggaaggttatctggctgccctgcagcggaagtgccgtgaacgcggaatgctgctgatcctggatgaagcccagaccgggatcggacgaaccggtaccatgttcgccttccagcgcgacggtgtgacaccggacatcctcaccctgtccaagacactgggtgctgggctgccgctcgccgcgatgatcaccagcgccgaacttgaggcaaaggcacatgaccggggcttcgtcttctacaccacgcacgtctccgatccgctgcccgccgcagtgggactgagtgtcctcgacgtggtggaggaagatgggctggtggatcgggcgcgcatcgcgggcgcaaagctcaaacagggtctgctggcactgcagcagcgtttcgactgcatcggggacgtacgcggccgcgggatgatggtcgggctggagatcgtcaccgaccggcaaagcaagacgcctgatcatgccatcagtacgctgattgccgaagcggcagcagcacgtggcctcagtatgaacatcgtgaagctgcccgccatgggcgccgtgttccgcatcgccccacctctgacgatatccgacgcagagattgaggaggggctcagcatcatcgcctcgtcgatcgaggccgcgaccggctgacatccaacaaacccgcagatcatacggagatcgtccgccatgcagacccgaaccggcctggtcgacatcgaccacattatgtgcggcgtctcggatatcaatgcgactgtggcagatctgagccggctgggtttcagcttcacaccggaaagcaccatcggcggcatgtccaatcgcctcgtccagatgaaaccgatccggccggccggtgcagcgaatttcttcgaactgatgaccgtcaacgaccatttgcgcgtaccgccgctgatgcgggacattctgtcgggccctgacgggctgaagatgatcgtgcacctttccgatgacatagaacaggctgcggcaacctttgccaaagccggaagcccgatcggcgacagttggacggtcgggcgtgactgggtccgggaggatggcgaacgggagcatgtgcgcttcaccgtcctgattcccgcacgcggtcatctgccgttcttcatgaatgcctatcgccccgactccatcgcgcaatatagccaggcccgataccagactcatgaaaatggcgcacgccatatccgtcgcgtctatgccacctgtccggcagccaagctgccggaggtcgtggcgcagcacgaaaaactctacggctgtcaggcctcgacacttggcgacgacgcattcgcaatccggccgggagacgtcgacctggtactgatgagcgaggacggcttcgcttcccgcttcggccttgcaggacacatgcagctcggattgccacgcctcgccggcctgacgatcgaggtctcggatccggacgcccttgccgctttgctggcccggaacggtatcccggccaccgcctgcgaacatgccctggtcgtgggaccggagcatgctgcgggcatggtgatcgaattcatctgatgacgacgtcggcttggaagggccggcacacggaagaggaagatcctcatggacatcgctccctggctcgatcaggcccgcgccttgcagaccgagaccttcgtcttcgactacgccccttgtggggagccgatcataatgaccccgcgccaccgggcacagatgatggccggcctggagcataaacttccgatcggccgcatccttgcaaccatgacccgcgaccggctggacgagatcgccacctccacggaactgcgcgcccgcatccgggcctgctgggatcagagcggtgtcgatgcagttcagctcacgctgggaggccgggcactggctccgcagctctgggacgcatgcatcgaggatgttggccattggctgcaccgggcacgcgccggcggcgacatggccgtctgtacctcggcggacgacctcgtccaggcccgggcagccgggcggatcggtctggtttttggcctgcaggattccggtgtcatcggcaccgatctcgaccgcctcgacctgctctatcgcatgggactgcgtgtcgcgcagctcacctacaatacccgcaacgcgatcggcgacggctgtgaggagcgtgcacctgcgggattgagccggttcggcctcgtcgcggtacaccgaatgaacgcactgggcatagtggtcgacgtatcgcattgcgggcctgccacgaccatggatgccatttccatgtcccgggctccggtcgccgtgacccatgcctgctgccataccgttgccgcccaccctcgggccaaaaccgatgatgtcctgcgggcgctacgtgacaccggaggcttcttcggtatcgtgacggttcccaaattcctcagtcctgaaggtcaggccgatctcggtgtcatgctccgccacatagaccacgccgtgagcatccttggtaccgacaaggtcggcatcgcgaccgactggggtggctggacacccgatctgccccccgaactgatcgatgccgcaacggaaaacttccgcaggctgggtttcaaggcggatacctcgccacaattcggtgtcggcctccccgagttcacggcctgggagcagtggccgcatctgaccgccagcctgctcgccgccggctatcctgctgacgatgtccgccagatgatcggtgggaactggctggcattcacccgacgggtcgaagctgcctccaggattgcctgaacaggcccctgaccgcccccgcatgcaccaaaataagaacaaataacaaacacaaagggaacataaagatgagggtgacgatctttgccgcagtttgtaccgccctggcacttatgggacagtccgtcgtcgcgaaaacgctgacttatggctcaggagttcccgaacgcgctgcagccaaccgtctcggtgtccttccgatgctcgatcggctgacacaggtgagcgacggtgagattcgcttcacgcccatactgggggggcaactggtctcaatcccggggggactccccgccatccgcgaccatgtggtcgatgcaggtttctttctcacgcaattccatccggccgatatgcctgccgcatcattcatggcggagctgaccgggcttggcacatcgcccctggcgacgatcggcgccctgaacgagatcttcttcacgcgttgccccgcctgcatggctgacatggccagacagaatgtggtgccaatgatgatccagtcagccacgccgctggttctgcagtgcacgggtcaggtatcggatgctccggatctggctggcctgagagtggcagtgatcgggcagccagaaatgcgctggattgaggcgctgggcgcgataccggtacgatcgtcggtctctgatatcctgagtgcccttcaactggggcaggcagattgtggattgctccctctgtcctggatccggagctatgggttgcaggatacgatccgcagcgtgatcgaccggccgcaggggatcattaccggcgcagttccattggcgatcaacgccgatacctggtcaacacttccccaaacgacccggcaaaaaatgatcgccgccatgccaggcatcatccacgactatgtgacgtctgcctatgtcgggcccgatgatgcggtccgcggcgaaatggcagagcggctgcacgtctccgatggcggccccaccctggccgcggcctgggcatcttttcagaaggcggagccgactgccctgatcgaggccgcgcgcgctcatggactcgagaatccggaaggtttcgtcgccatggccgtagagaccttccggatatggcatgaagatctcctgccgcgtttcaccgatgatccggacacgttcaccgcactgctgaaggctcgtgtctacgacgctgtccacccctgagggagaacgctcatgcagcgctcgttgcccgatcgcgcctgccgcatcggagaactcgcggcggccaccgtcatcggcctcatgaccctgcatatcgggctcgacgtggctgctctcgccctgtcgggcactccattgcggggaaccgctgaaatcgtctcggaactctacatgccctttgtcgtcttcggggggctcgccgcggttcagtacgccggagacgagatacgggtcgacatcatcgacggaattctgtcgcagcccctccgccgcggtctcgaaaaactgactcagctgatcgtcgcactggcagcaggcgcattggcctggcagaccagccttcaggcgctggatgccctgaagcagggggagcatctggtcatcggcaccatgcgcatcatcacctggcccggcaaggcagcgattccggcagcttttgccatgcttgccctggcatcgatcgacaggatgcggcgatcatgaccccgattgatatcagcgtattggtcctggcaggtgcggtactgctgatcttgctgcgtcttcccgtcgcaatcgccctgggtctctcggcattcgccggggccgtcgccctcctgcctctgcccgctgcggtcagcatcatgacccgcaccccccatgaattcgccgccagctgggaatactcggccgtccccctcttcctcgccatgggggctctgatcgtccggaccggtttgtcggattcgctttttattctggccagccgcgccttcgcccgcattcctggtggcctcgcgattgctaccaatttcgcaggcgccgccttcggtgccgcctcagggtcgagtctcgccacaaccatcgccctcgggcgactggcaacgccaaggatgctgcgtgccggctacgatccggggctcgccacagccgtcacggcctgctccggcaccatggccgctctgattcccccgtcaataccactgatcgtctacggaatcctggccgagcaatcggtggtcaggctgttcttcgccggcatcctgcccggcctgctcacagccctcggttacggggtgatgatctggatccgctccgtcagacatcccgaactcgccccgccaccagcccgggacacggatgaggacctcccgatctcatggtcgatcctggccctgccgatgattgccatactggtgctgggaggcatctatggcggctggttctctcccggtcaggccggggcggtcggcaccctggcagtgatcgcgctctcagcccttcagccgggcgtgacatggccgcgtcttcgcgaggcattcgccgatactgcccggcagaccgcgtcaattctttttgtcgccgccggcgccatgatgctgaccagaacgatggctctgaccggtctgccggccgcattggcatctttcgtagcagatgcgggtctttcaccggccctgctgctggcagccctgtcgcttctctttctgctgctcggcatgatccttgatccgttcgggatcatgatgctcgccgtcgccgtcctgctgccgaccctggagcaggccggcttcaatctgatctggatgggaatcgtaatcgtgaagtacattgaaatcggcgtcatcacgccaccggtcggcatgaacgtttttgccgcaaaatcgatcgccccaccttccatcagtctgacggtgatcttccgcggggtatcctggttcctggtggtcgagatggtgatccttgtaatcctgcttacgtctccggaactggtgctctggctgcccgatctcatgaccagtcgctaggcgggcatcaaagcaccagacgcagccggagtggatggtctgccggatagcgggtctcaattaaggccatgagtgcgcggctgaagccggcagcctcgtccttgaggtcgcgatagagcggcactgccctcgcttcggcgggcggtacatcgagtgccatgcggtttgccggatcatcgagtgcagccaggaaccggtcgtaatggctgagcgccggcgccagtgccgccgggccgcagacatcgagcatacggtcgatcggcgggcggcccagaaggcccccgagcaggcggcgcttctcctccacggcgagccccgccgtttcggccgcagccaccacgcccgagacgtagagcagcttgcgtgagaagaccagcttcacattgcgcaggccccagcccttggcctcggccccccgggtcttcatctcgaagtcgacgcagatgctgcggtaatagcggatcacgtcgttgagcaggaaggtcgccggatcgtcgcgaccatgatgatcctgcacataggtggcgatcagcccgtcgagggtccggcggaagacggcctcgccggcaagtgcccgcccctccagcagcatcagcaggcggcgggtggtgatctggttgacatccgcaacgccaccaatggtgttgatcagatcatcggtggactgggcactctcgaaggcgccgccatccgctggctggcggatacccgccgccttcgccgccccgtgaacccgccgggccagcacccgggccctggcctccgtggcccgccccggctcgtaaagcacatagctgtccagatccgcctgcggaccggcctcgccgcggccataggatccgcagaccaccaccgacaggccgggttcaatcacacccgcaggctcagcgccccggaagaggtcgtcatcgtccagcacaggcaccatcggcagggcatcggaaagccgtccgagttgcgcctccgtacgtcggcgcaactgcaccagatgcggggcgtcggcctcgagggccgtgaagcccgcgccgacgggggcatgatcagcggtcatgccgccacgccgaacaggtcgggctggcgcccgcctgccccctcggccgcgatggccgccagcgcggacaggccgtaaagcggccgcttgcggcgggtcttcacctcgcggtagcgccgggcataggcttcgggagagtccagcaccacgtcgggctcgatggtgaagcggcgctcccgccccatgaccatctcgacaggcaccgccgcctcgacggctgcccgcttgcggccggcagcggcagcacgggccgccctgaaatcggcatggatatggcccaccaggatggcgatcagcgcctgaagatcacgcacgcgaccgagcagggcgcgctcggtcaggaagaaatcctcggcccgataccggtcgatcgtctgatcgacatgacgctgcaccagcgcatcggccgagcggcagacgtcaccataaatgaaactgtcgtagatccgctccttcagccgccagaaaccatccaggcggcgcaccccggcgcggtcgacccgggccagcgccagaaccgaaatcagcgggtgggcatcgaccggcgcccggtggagataggtgttcgcacggcagatgccgtcgatcgtatcgatgttgatcgggccggagaacagatgcgcatgcgggcggttcgaccggcgggcaatcagtgccaccacctcgtcggggtcgacgccatgccggtcgagcgctgcgcgaacatcgcgaccgatcggcacctcgccccggatcaccgccgcagtcgctgcatgatgatcgataccgaaccgatcggcgaagaccggctccagcgtatgcgacagcggcccgtgacccacgtcgtggagcagggcggcggcaatcagcagatcgcggtcacgcggctgaacgcccgccagccgacagtagctgacggccagcagcgccacgcccagcgaatgatgatagcggttatgccggacgaaagacggcttgccgttcgggtggaacagccggtcgatgacccccaggaacgagatgtcgcgcagccgctgaaatccggggctggcgatcagctcgcgatgcagggcttgcggaaaagcctgggcgatggccccgtcgtccagacggaaacggaaacgtggcgcctcgggaaacagatcgcccgccgccctcgcctcttcaggccacgacaccggtgcccagtcggccagatcctcgaaagcttcggccatggcgggcgcatggggcggctccgccgtctcgactccgaagtcccagatggtgatctgccgtccggtcataccttctccgctcgcatgccgcgccactggtcggaaagccccacgcagccgggcacctgatctagcacccgcagcgccagcgggtccagtgccctgcatcggacctcccggtcagccaccgcattcctgctcaactatggcattcctgcgcgatccaggccaggaaaccggcagatccaccctcgatcggccaggcagatatgcccggcaggtcatagctgtgcagggcgatcacccgcgctgtcagaagctcgaggcgatcggcggtcgtcttggcgatcagcaccacttcctcgcccgtctccaccttgtcttcccagcgatagatcgccgtcatgccgccgatcagattgcagcaggcggccaggcgttcctcgacaagcgtgcggccgatcatcagcgcttcgtcgcggctgccgcaggtgacataggccaccatggcgcgcgcgaccataccagccgcttcgacaaggcaccgctcggcggcgtcgagcggtgccacgccgtcgaccgccagggcaagtgccgacaaggcatgtgcaacgtctttacccccggccggctcgccggcctgtgcgctttccaaaagccgctccagctgtcgtgcagcttcaccgaccttcggaaaaccgaagctgcctgcggcgccggcaagggaatgcgccgccctctccgcatcgtcgagccccgcagcctcatgctgatcgcgccaggcggcaatgccttcgcggatgcgggcgatccgtgccggcatgccctggcggaactcttccgtcagcgtggcgatgatgtcggtagcactgccggccctgccaccatcgggcccatcggtttcgggactgtcagtcacgaccagcttctccgctcgggggggtgcttttcagagagtcccttatcggacgggtcaccggattgcagggctcgatatatcgcctgcagttcggcagacagcgtcaacggatcaaatggcttggcaatgacggccgccgctgccaccccatccaccccgtccagatcggtgcgggtgcgggccgtcagaaatactgccggcaccaaagctcctcccggcaacaaccggagccgcctcagggtttccggcccatctatccccggcatcatgacatccagaagcaccagatcgtgccgcgcggcatcaaaggcctcaagggccgcatgcccgtcggcacaaaccgtcacctcgatccgcccgacggcagacagcgccagacgaacaagttcgcgcaggtcgggctcatcttcaacgagcaacacgtgccgaagctcacccatccccatctccaccgtttcgggcgattgtcgcccggtcgcccgcattggaagacagatcccgagaaccggagacataccccgtcggtccttcctgagggcacggcaggtatctcaacctgtccagcgatgcccaccaggtgggcaacctgatctggacagtgccaggtcgggcttcaaacccgcgcacgcagctttgcatggtacaaaaatgagaacggccgcgccatccgtcggatggtgcggccgtgaaagctgcagacttcgctgctggtacggcatccggggatgatgccgtgaagagaagaattggtcggagcgagaggattcgaacctccgacccctagtcccccagactagtgcgctaaccaggctgcgccacgctccgaccgttcttcatggggtcgcgatgccgtttccgccatcctcccccttgcgaagtgcgcggactatagccaaccggatcggcccgcgcaacccttctgaagcaggatttgtatccgggctggtcagccctgcccctgctgtctcaccttctccacctcctcggtggaaatctcctcggttccagcggtttcggcccgttcttcacctgcggcctcaacctcgtccgtcgcatccccatctgccgccggcagatcggcaccggtttcgccgtcggcaagctcgacgacgaagacgtcctgggcgaagctctcgtcgggtgtcaactccccaccgccggcggtggcgtccacgcctgcgtcttcatcggtcccgtcgaggattgcccgcgcctgcttcaacaggtcgaacgcctcacacaagaccagacgacgccgttcatcggcggcaagaagatccctgacacggctttccgcgcgttccgccgctgcgacagcctcggccgtcatcgaagtggtggcgatctcttcagccggttcgtcttcatcgaagccgtcgctgtcggtctcgtcatcctcgacgacggcatcatcggcatcctgatcttcatcgaagatctcgtcttcgctctgacgcgccaacgcctcgagcagatcaggatcctgcgccgccgcgccggccgcaccggcttccactcgttcggcgacggccttggcgccgccttcgcggagcagcttctgcacacccttgatggtgtagccttctgcatagagcagatcgcggatccggcgaagcaggaccacgtcgtcggggcggtagtaccggcgcccgcccgcccgcttcaacggcttcacctgcgggaatttgccttcccagaaacggaggacgtgggcggggacgtcgatgtcttccgccacctcgctgatggtgcggtacgcgccaggcgccttgccgccgccgcgccgccggtcgccatcatgggcggtggtgtcggtcatctcgtcaacgcctccatctcaccggccgcatcgcccttgctcaggcttcggcctcgtcatcctctgtctcgaggtccagatccgcgatatccgccaggctcttgccgatccggtccttgagcacgttcgaggcacggaacaccagcaccttccgcggaaggatcgggacctcctcgccggtcttcggattgcggcccacgcgctcgcccttctggcgcactgcaaaagtgccgaaagacgagatcttgacggtgtcgccttcgaccaggctgtcggagacgacggacagcaccgcctccaccagctgggccgattcatgccgcgacagaccgacttcctgatagaccgcctcggccagatccgcgcgagtgacggtgcgtgccatagtcttgtcctcaaatacttgcgcgcgcagcttcaccctgtttatgcgccatggcagacaagaatgtcaaacgccatgcgcttcaaggctttgcgacacgcagttgcgtcgtttcggaaaaagcgtgaaaggctcaccaccgacggtaaggccgggggcgtcaccagcggatcagcgccgaaccccaggccaggccgccaccgatggcttcgacgagcaccacctgccccggctggatgcggccgtcggccacggcctcgctcagcgccagcgggatggaggcggcagaggtgttgccgtggcggtccaccgtcatgaccaccttctccatcggcaggcccatcttgcgggccgtaccggtgatgatccgggcgttcgcctgatggggcaccagccagtcgatcgcatccgccgtcatgccgttggcctccagcgcctcgttgacactgtcggccagtttgacgacggcgtggcggaagacttccttgccctccatccgcagatgaccggcactctgcgtcgacgacacgccgccgtcgacatagagcgcgtcgtgatgccggccgtcggagaagagatgcgtggatagcacgccgcggtcgtcgctcgtgccctcgccttccgcggccctgagcaccactgcacctgcaccgtcaccgaacagcacgcaggtcccgcggtcgttccagtccaggatgcgcgagaaggtctcggcaccgatcaccagcgcggtgcgaaactggccggccttcaggaaattgtcggcggtcgacagcgcgaagatgaaccccgcgcagacggcctggacatcgaaggcggcgccacgggttatgccgagcccggcctggatcttggtcgcggtcgccgggaaggtctcgtcgggcgtcgaggtcgcgaccacgatcaggtcgacctcgtcggcgccgatgccggcattggcgagtgctgcgcgcgccgcatgcaggcccagggtcgaggtcagctcctcgggcgccgcgatacgacgctcgcggatgcccgtccgctcctggatccattcgtcggaggtgtcgaccattttcgacagatcgtcgttggtcaacacccgggcgggcaggtagccgccgacgccgagcacgcgcgcgcgcaataccgtcatgccgttgccgccttctgctggtcggacgtcccgtcgatccggtccgccgcgatccgtttgaactcgccgatgatgcgttcgttgaagccgtgcgccaccaggtcgtaggcaacgccgatggcattggcaaaaccaagggcatcggtaccgccatggctcttgacggcaatgccgccgagcccaaggaacatggcaccgttgtggtgacgcggatccgtctgcttctggatcgccttcaggctcgaccgcgcaaagagatacccgatccgggccagcagcgagcggccgaacgcagaacggagatagtggctgtagagcttcgccgtgccctcggccgtcttcagcgcgatgttgccggtaaatccgtcggtgacgacgacgtcgaccgtgcccttggcgatatcgtcaccttccacgaagccatggaagcggatgctctcggcggctttcagcctcgccgccgcttcccgcaccgtttcgagccccttgacctcttcctcgccaacattcagcaggccgaccgagggggtctgataaccgagcacgatgcgtgcgaacagttcccccatcacggcgaactggatgaggttccggacgtcgcattcggtattggcgcccagatcgagcacaacactctcaccgcgcagcgtcggcatggttgccgcgatcgccgggcgatcgatgcccggcagcatgccgagcatcatccgcgccatcgccatcagcgcgccggtattcccggccgagacggcggcactggcacggttctcccgcaccgcccgaagggccaggcccatgctcgacttgcgcccctgcctgagcgcgaccgaggggcgcatggtgcccggaaccacttcgtcggtgtgcaggaagtcggtcgcggcgagcagctttttgcgccgcttcatcagcgtgcgcagccgcggctcgtcgccgaccatcaggaaccggaggcccggatgtcgcttgagtgcgatggcagcgcccttgaccaccatcttgggagcctgatcgccgcccatcgcatcgagtgcgatggtaacttcaccggacaaggccacctcacctccgcgcccttcgtcgggccaggccggcccgacgtcttcctccgatcacctggagccggcaggccggatcaaccggccgccgcctcggtcgcgacgtcacggccgtcatagaagccgcacgagccgcagacatgatgcgagagcttcagctcaccgcagttcgggcactcctgcgcgttggtcgcggtcagggcgtggtgggcacgacgcatgtcgcgccgcgacttggagacctttttcttggggacggccatagtcttcgcctttcgggatggtaacggtcacgagccgaatagcgcgcttagttagcgaaaaaccggctcgatggcaaggcttctcccggatctcgtatccggtgtcatgccggtcaggatgcgtcacccccttcgggcgtgtccgtatccatgcgctgcttcagggccgcaagcttcgcgaagggatgttcgcggccctttccctcaggggcgctgccacccctgagcgtgaagacttcacgctcgaccggttcccccggggcctcagggctccggggatagggatcgatcgcgagagaaaagtactcggtcgcaagttcgccggcatcaaccctgccgtcgaccagctgctccggcggttcctggtcgtcttccggctcggccgcatcaagggctgccagccgccggccgtattccggctcggcaagtgcatccacctcgacggtttcggagaccgaagcctcgaaccttagattggtcacgacacaggtctgaatcaacctgcccgagagctcgaacaccagatgagcaccgccccgaacgcgcgtcacggtaacctcggcctccagtgacaggatctgatcctgccccagacgccgggcaagcgccgcacactcggccggcgtggccgtgtacgagaaggtgcgcggctcccccggctcgatcgcctcgatctcgatgacgcgcgagaattcgggggtctgagcgctggtggtatcggtgccggtcatgggcgtcggtcgtccttggaacgcgaaatgccgggcccagccgggcccgtggcggcgcaccctactccatcagcccgggtttcgccagccccggcaatgtgttgggtcatgtgcagggatcaatccccaccggcgtcggacgcatcctcgcactctgccgacggcaccggcagtgcggcataggcggcccggccgtccagaaggtctgccgccggctgcccatccagcgcgcggatgctggcgagcacataggatgcaagtgccccaagcacgacgcctgagggtcgtacggccccctcgccctccacaccgaacacgttgcgggcgatggcgtcgccaagctctgcaccgccatcggctgccgacgcctcaatggccgcatcatagcttttgacccggccatagaaggcctcgcccatgcgtttgacatgcttaccgacactcagatcgccgacgcccatctcccgcagcgagcggtccatgtcggcaaacatgcggtcgaacagcgcctgtccggtccgacgtcctgcctccccctcgcgcttcaggcggtgcagaatcatgaagacgtggagcaccaacatgtcgaagcggccgtccaccgtgtccggtacgccgaagtcacgataaaaggtcaccgaccgcgcctgggcgaccgccgtatcatagagcgcttcggcggcggcacggggccccgtgcgaccgaacagcctgtcgagaaacatcgggcatggacctcctctttcgaccatctgcaagccggttgtaccagaacggccgccggtccgattgacaccccgcatcgcggaatgcaatcttgggccgcccgccagcagacgggccgtcgcatccccgccgttctgggctttccgaagcactgctctctttgacgcccgctcgccggcgtcgttccgtgcagatgccggttcgtgcaagtggttatggaggcgacgccccacagcgtcaacggtgacatcgccaagatgatccggtcagcgccccggcgccgccccattttcccgtccgtcacccgcaccacgccgatggtcgcggtggttcttgccggcctcgccctcggcgcctgccagccggtgatccgcacccacggcttcatgccgtcgaaggacgagatcgcccagctgcagcccggcgtccagacgcgcgaggatgtccgcgccatcctgggcgccccggccacgacgggcaccttcgaaaccgacacctggtattatatccagcgacggaccagtacgatcgccttctattcggccgatgtcacggagcaggatgtccttggcctgcgctttggtgcagatggccggctcgccgacgtgcttcgcttcggcctggatgatgcccgccaggtcagctatgtcgaccgggtcacgccgacttcgggcaatgagctgaccgtgctggagcagttcgtcggcaatatcggccggttcaattcggacccctcggccaccaacccgggcaacccgtcgggcatgggccgaccgcgctgacggccggcatgccatactgcagacgatgaaagaaggggtcgatcggtcgaccccttcttcatgtccggccggcctttccggcaagccgtcaattgatcttctgtgccgcgacgtcgctggtccgctggatcaggacatctgccacgacctcgcgtccgaaccagtcattggccgcatcggtaaggccgaccttgatctcgtcgagtgtcggctcacgccccaggcggtcggcggtggtcgagacatgctgggcagcgccggtcagcaccggacgcaggcgctcaatgccgttcgatacctcctcgtcatccgctccggggacgagttcgagcaccagatccagcatgagataacgataaaccacaccgtgtcggatcatgggcacccccacaccggtcatccccacgaactccggcgcaggcacggcggcgggggcgcgcaaatggtgcccgaagacgccgaaagggtcatcccggtagatcagccatccgccaccgcccgcaaccacgagcagcacggaaacgatgaagatcagcaggactctcattctggcggaccgtcaggatggggcgcgagggcgccgggcttccggtcagccacgacctcccggctctgagaagtgcagcacttcgtaggtattcacgcaatcggattgcgcgcccaccgccgcatcccgcgaggcagcctcgttacaccacaggctgtagcggaccagctcccaccggtcggcgtcgagcgcgatggaatgagcatacaggccgggcttggtcagcatctgcgcctgcagcgccgcctcgcgctcacgcaccgcctcgagcgacgtctcgggtgcgatcacatcgacctcacgcacggcgaagcgcggctgatcggtacatgcgccatggccgaagccgagcacgaaccaggttcgcacgcgcggccgtccgaaagctgcagccagattggcgaacagatccccgaagacgaactgcttccagtcctcttccgagcgccagatgtagaacggtgcatagacctgatcctcctcgttcaggaggaaggacttcatcaccagtcccgggtgattgtcgtagagcgatccgcgttcggccacgcgccggcggatcatatccgcgtccacgtcggccttcagacggactgtgtattgcagcgccagcatcgtctgcgttcgtccccccgcgatcgatgggcccccaccgtggcgcagatgcacgcagctggcgggtcggatatccccggcggcacgcggccctgcgtggcccgagggtgtatccgcggacgttacgccatcgttgccgtcgcgagaacggtcattcacgcatgacgcccatgcaagctgcgtcagaaatgcacatgtccggccctgtcggccgcaatgatacgcccgtctgcgttgatcagcacggtccggcctctgtctcctgccctgggaacgatgcgcccgatgcggctgacatgaatgccttcgcgtgcggacagcgccgtgatggcgtgggcggcggcaggtggcgcggtgaagacgagttcataatcgtcaccccccgtccagacgatcgacccgagatccggacgggcagccaccacacggccagctgcggccgaccgggggacgagatcgatgtgcaactcggcatcgacccccgaggtctcggcaatatgccccagatccgccggcaggccgtccgagacatccgcgcaggccgtggccagccccaccagcatccgccccagcgccagtcgcggctccggcagctgccgccgcgcctccagccccgcgatttcctcggcagagaggccgagggcggcggggtcgaagcggccataccccgcttcgaccgacagcgctgcatcgccgatcgtgcccgagacccagacgtcgtcgcccggccgggccccgccgcgggtgagcagggccgatggcgccggggcatggccaagcagcgtaagactggccatggccgggccgtcggtccccaccgtgtcaccgcccagtaccgccacaccatagcggccctgatcggcaccgagcccctctgtgaagcgccggatccagtctccggcatgggggcccggaaccgccaaggccagcagataggcgacgggcgttgcccccatcgccgccagatccgacaggttcacccgaagcagcttgcgcgccaccagttccggcggctcccccggaaaccagtgccgcccctcgaccatcgcatccttggcggcgaccaggatccgcccgggtggcagggcgagccagccggcatcatcggtcaggtcgagtgcgcccggcaaagaccgggcaagcggccgcagccagcgttcaatggcgccgaactcgccgagcggcgcctccggggcggtctcgtccggcgccttgcctgtcacttgcggggggccccgccggcaggcttgccaccgcggtggtcggcacgcagatgccccgccagccggtccagaatcccgttcacgaagcccggttccgagcccgagaaaaaggcatgggccacattgacgtattcgttgatgatcacggccgtcggcacatcggtgcgcgccgtcagctcgtaggcgccggcacgcaggatcgcgcgcagcgtctgctcaacccgctccagccgccagccctcggccagcgaggattcgagcatcgggtcgatctcggcctgggccgcagcgacgccggtcacgatatcgcggaaatggtcgcgatcggcatccagctccagcccgtcgtcgatcaccttcccgatacgatggttcaggaattcggcgatgaccgcctcggcccgggccgcgttgaaatcgatctgatagagcgcctgaacggcggccaggcgcgccgccgtccggcgggccatgccggcctcgcggccggggcgcggggcgccgctgcgcttgcccgcccgtgcagcgggtttcgcatccgtcttggctcccggtttcgccggggcggcgtcacgcggcttgtcggtcatggcaattcctggtccttcagccctgctggaactggcgcttgatttcgatcatgcgcaggcaggcattggccacgtcggcgcccttgttggcccggtcggcgcgtgcgcgggcccaggcctgctcgcggttctcgacggtcaggatgccatagccgatgcaggccttgcgatcgatcgcaagctggttgagcccgcgggcgctttcgccgcagacgtaatcataatgggtggtgtcgccgcggatgacgcagcccagcgcgacgaagccgtcatagcgtccgctgtcgagcgcgaaacggatcgccgccgggatctcgaaggcgcccggcacggccagacgctcgacctgggccccggcggcttcaagcacgcccatcgcgccgtcgaccagcgcatcggcgatgtcttcgtagaagcgcgcctcgacgatcaggatgcgcagatcggaggtggtaacggtggccatgggtgtctcagaccttctcgatgatcagcggggcatgcccggtgatgtggaggccgtagccgtccagccccaccaccgtctgccgcgaattgctcagcaggatcatgttgcgcacccccaggtccagcaggatctgggcgccggtgccatagtcgcgcagcgtcgatgccgcctgcgggctttccagccgggcgcgcgccagatccgacaggcccgtcggccgcggctcgcgcagcaggaccagcacgccacggccggcacgatcgatctgctccatggcagcacgcaccgcaccggcacggccgctgctgcgatcgcccagaagatcgtcgaaggcgttcacgacatgcatacgcaccagcaccgactgatcgcccgcagccgccagatcgcccttcaccagcgccatgtgttccgagccgtcgatcttgctggcatagacgatcattcgccactcgccaccgaaatggctgcggaacaggccatcggtcaggcgctcgaccagcttctcggtgcggcggcgataggcgatcagatcggcgatcgtgccgatcttgagcccgtgcaactgggcgaagggcaccaggtccggcatccgcgccatggtgccgtcgtcgttcatgatctcgcagatcacgccggaggggttcatgccggccagccgcgcgatatcgaccgcggcttcggtatgcccggcccggacaagcacgccgccatcgcgggcgcggagggggaagatgtggccgggggtgacgacgtcgcgggcgcccttggccggatcgatcgcaacctgcacggtatgggcgcggtcggcggccgagataccggtggtgacgccgtcgcgcgcctcgatcgacagggtgaaattggtgtggtgccgggaggcgttgcgctgggtcatcagtggcaggttcagttcctcgacccgctcaccggtcagggtcaggcagatcagcccgcggccgtatttggccatgaagttgatcacctcgggcgtcaccatctcggccgggatgaccagatcgccctcattctcgcgatcctcgtcatcgaccagcaccaccatgcggccgttgcgggcgtcctcgatcacctcttcgatgctcgagatatagccgcggacatcgtcggcgccgccctcgtccttgatcaccgtcatggtcttcctctcctctgggccgccttcggaccgggcggcctcccgctgatcagccgcggatgcccgcctgccactcgttcaaccgcgccacatagcgcgcaagcacgtcgatctcaaggttaatcgcatcgccgggcttgcggtcgcacagtgtggtgtgggtccaggtgtggggaatgatgttcacaccgaagcgggtgccgtcgacttcgttcaccgtcagcgaaatgccgtcgatggtcaccgaacccttgggcgcgatgaagccggcaagctccgtcggtgcctcgaacaccagtcgatgagaaccgccttcgggcgcaatcgagaccagacggcccagcccgtcgacatggcccagcacgacatggccgcccaactcatcgccgaccttcgccgcccgctccagattgatccgccggccggcaccccagccgccgagcgtggtcttggacagcgtctcacccgacgcctcgaccaggaaccagccctgccctgctccgtcgcggccacgctcgatcaccgtcaggcagcaaccggagcaggcgatggaggcaccgatatcgatgccgtcggggtcataggacgtccggatcgtcagccggcggtcttccgccgccccggcttcgggcgcctggacggagacgatctcgccgatgtcggtgatgatgccggtgaacatggaacacgaccttctgccgggggagcgcggccggaacacgcgcgggatgtcgaaagataacgtcgaaagaggcagggctcagccgccgggcgtgaccacggcggtgcccgcataaacctcgtaaaggtcggggccgagctgccggatatcgagccggacgaaggccgccatgtccaccagctcctgcacaccataagaccgcgcagcaggcacaccgtcgccccccatcacggcgggcgcccggaaccagtggatgcgatcgaccagccggtcgcgcagcagagaagcggccagctctccgccgccctcgaccagcacccgggtgatgccccgatcgcccagcgcctcggtcatccgcaacggatcggggcggccgtcggccccgtggggcacctcgatcacggtgatgccagcggcggccagcgcatcatgacggctacggtcgcagtcggtccgcgtgatgatccatacgggcgggcggccgccttcgcaggcctcgcgtaccagcgtgtgcgtcaacggcaggcgcaggcggctgtcgatcaccaccctcaccggcgaacgttcctcaagccccgacacacgcacattcagacgcggattatcggcaagagcagtgccgacaccgaccatgatcgcatcatggctcgcgcgcagcatatgacccatggtacgggcctcgggtccggtgatccactggctctcaccggctgcggtcgcgatccggccatcaagcgtggtcgcaactttccaggcgaccagcggccgacctttcagaatgcgagaaaagaaaccggcattgagcgcccccgcttcggcggccatcaggcccagatcgaccgtcatacccgcggccgtcatccgatcgagcccacggccactgacccgggggtcggggtcgcctgtggccaccaccgcccgggtcacaccggccgccaccagcgcatcggcgcagggcggtgtcttgccccaatgggcgcagggttcaaggctgacataggccgtggcgccgcgcgccgcctcgcccgcctcggccagggccatggcctcgccatgggggcggccgccgggctgggtccagccacgaccgacaatccgaccatccgccgacaccagaacacagccgacggccgggttaggccacacccgtcccaggccgcgttgcgcaagggtcagggcgtgggccatatggcgacggtcggcctcgctccagattatcggttcagccatcgttgccctgcccctgatcgccgccgccaaggctgccgatcagtgcctggaagtcgtcgacctcgcggaaatccttgtagaccgaggcgaagcggacataggcgatcttgtcgacgcccatcagcgcctccatcaccgcttcgccgatccggccggtctcgatctcggtctcacccagcccttccagcctgcggtggatggcgctcactatccgctccacctgctcggcctcaaccgggcgcttgcggacggcgatgcggatcgaccgggccaacttctcccggtcgaagggctcgcgggtaccatcctttttcaccaccaccagttcgcggagctgaacgcgctcgaaggtggtgaagcgggcgccacaggcggcacaatgccgacgccgccggatggcgaaaccttcctccgccggccgactgtccttcacctgggtctcttcgttgccgcagaacgggcagcgcatctcacctccgcaaaccgggcgtcatgaaccgggagagccgcgtgcccgcctcccctcgttgcgggaggcgggcacgtcgatcacagggccgggtagatcgggaagcggtcgcagagcgccttgacctcggcccgcaccgccgcctccaccccggcatccccctcgggcgtcgccgccagcgcgtcgagcacgcggacgatcatctcgcccacctggcggaattcggcctcgccgaagccgcgggtggtcgccgcaggggtaccgaggcggatgcccgaggtcaccatcggcttctcgggatcgaaggggatggcgttcttgttgcaagtcatgcccgtgcgctcaagcgcatgctcggtggcattgcccttaaggcccttcggacgaagatcgaccagcatcaggtgattgtcggtgccgccggtgacgatgtcgagaccgccggcaaccagcgtctcggccagcacctgggcattcgccacgacctggcgggcataggccttgaattccggacgcagcgcctcgccgaaggcaaccgccttaccggcgatgacatgcatcagcggaccgccctgcagaccggggaagacggccgagttgatcttcttggcaagcgcctcgtcattggtcagcaccatgccgccgcgcggaccacgcagggtcttgtgggtggtggtggtgacgacatgggcatgcggcagcggcgacggatgggcaccggcggccaccagacccgcgaaatgggccatatcgaccatcagataggcaccgacctcgtctgcaatcgcacggaaacgcgcgaaatcgaagacgcggctataggccgacccgccggcgatgatcagcttcggcttgctttccttcgccagccgctcgacctcgtccatgtcgatgcggccgtcctcgggacggacaccatactgaaccgcatggaaccatttgcccgactggttcggcgccgcaccatgggtcagatggccgccggccgccagcgacaggcccagaatggtatcgcccggctgcagcagagcctggaacaccgcctggttggcctgggcaccggaatggggctggacattggcgaagccacagccgaacagggcacaggcccgttcgatcgccagcttctcggcaacgtcgacatattcgcagccgccgtaatagcgcttgcccggatagccttcggcatatttgttggtcagcaccgtgccctgggctgcgatcaccgccgggcttgcaatgttctcggaagcgatcagctcgatctgatcacgctgccgggcaagttcgtcgttgatcgagcgcatcagctcggcatcgtcggcgagagcggcacggaagaaggccgcggcactgtagctgggggtctgatcggtcatcggtcggcactttctgacggggtcgcgctcgtgcgggacaagacgcagagaccgggacggtcgaaacgacctcatgcggtcggatactggaacggcggcggcggcactccgcacacaccggagcaccgccgacgtcacgaacggatctgtgcggtcagccgagcttgtcgacccgccgctgatggcgaccgccttcgaagggcgtgtccaggaagacccggagcgcgtcccgcgcggtctcgacaccggtcacgcgggccccgaaggccacgacattggcatcgttgtgctcgcggcagagccgggcggtgagcgcgtcgtggaccagagcagcccggatatgggggtgacggttggcggcgatcgagataccgatgccggatccgcagatcagcacgccacgcgccgcccgcccctcagccagggcggccgccagcgcattggcgaaatcgggatagtccaccgaagcggagccatcggtcccgaggtccaggacctccagacctcgcgcagcgaggtcttccttcaggaccgttttgaggtcgacgccgccgtgatcacaggcgatcgccacgatacgggtgctgtcctcggacattccggccccttccatcgcatcgagacccaggcgaccggcccgatggccggggttccggtgccggatatccggcgtcggagcccggttgcggaagcccggtcgcggcgcccctctcccttaacacaacccgtgtgccacgccaactgcggtacacacatggcccttcgccagcgcatgcatgatggcgaccgcaatcgcccgccatggcggcacgcatccccattctccaaatccaccggcgtcgattgtggcccaatactgataaagtcaccacctcacgccatatttctgttgtgatatctgtggacgcaagtcatcatgcggcgagtgatatttgcaggatgcctgtgccctccgaccgggccaagttccggaggtggttctaaccggagcaatgacggttcgatataatctggaaggcatgcggactgtcctgcagcaacacatcgtgcggcgactacaacggctgccagccatcggaaagcgagtgttccatgtcggatagttccgaaaaccccatcatcgcccatgacaagctgctgagcatggccgcgcagatcgtcgcggcctatgtcagccacaacagcctgccggcccagcaactgcccgagatcatccagacggtctacagtgcgctgaacgatcagcagagcggcacggccgccgcacaggaagtcgtgcgcgaggaagcgcagaagcctgcggttccggttcggaagtcgatcacgccggactacatcgtctgcctggaagacggcaagaagctcaagatgctgaagcggcatctgcgtgccaactatggcatgacccccgaggaataccgcgccaaatggggtctggcgcctgattatccgatggttgcgcccaattatgcacgtcaacgctcggacttcgccaagaagatcggtctgggtcgtgcgacgaatgcgccgcgggcgcgtggcggccggcgggctgcgcaggcctgaaaaccggcgtcgcgttcacgcaggaccgcgttgaacggccatcagacggtttacacgaacggggcgccgcaagatctgcggcgccccgttcgtgttcaggcgcaatatgttccgagataaatttccataaatttaaataaaatacattgttttggattatcactcctgagcaccatgccagagccgggcccccagatagatcttggccgccgagccacccgcagctggcagcagcttggcatggctgatcccgaccaggatcgccgcggcgggaatacgggcgaagagacggtggcgcccgacggcccgcaggacgctctcggccagccgtggatgggccgcccccgcctcgcccatcagttcaaagaattgcggccaggctccggggcgccccatatagaagcgggcatcatcgttgatctcgataccgacccgtggggagatccccgccggcgtgaggtcgatggagagcgccagtgctccccccgcccgcctgcaggcgaccggaaagcggcagaatggcgcccagcacgtgatcccgcacctccggagccatttctccggccagcagcgacggaatggcgtcgggccgcaggcgacggatcaccacccgcagggtctccgccccttcggcccgaccgatcattcggcccgcctggaagacttcggcccagggcggcaaccggccgagcagacgtctgaaggtcgcgtggatcccgggcccgatctcgcccgacaggctgcaaagcggggcaaagccgacagccgggtccgcatggaaccggttggtcgggctcatctcaggggtctcgtccgcaagatcggccggcgcagtgaacacccctgcatcacgagccccgggtgtgccggtgtcgaattccagaagcagatcccgcaattggggaaacatgcctccccgccatgcctcaatcgtctgaaccacccgcccccaggcttcatccgaccagagccgccgccaggggccatcggccgccgcacaggcggggtccgccacctcctggcgggtcatggcaacacagagatcgacggctccgccatccggcgcatcggcacgcagttcgacaccgaacgaattgcgcgccagggcagccggtatcgccgcagcaacatccatgatccgccggcggtcttccgggggaaccagatcgcgccccatgaccccgagcagcgcctgaatggccggccccatcccctgaccatgatgaagacgaccgtcatccgaaccgaagaccgtcatatgccgtcccctcgcctccgcgcgcgtgccaacgcccccaacgtcaatgccgttgccaatgcgtccgagcgatagtggcagccgggcggtgcaggtggggtgacaccgagatagatcgcgtccgagcgacagtatccatgcgtgaagacctcgcggaccagcagggcaactgggcggtccctgacaggcagcggcagcatgtccagggcgtcggcaacatccagggcctgcgccagacgaaagggcgaggctccatcatcctccagcacccgggccgccgtcctggagacgtccggcagtgctggccgcaagctacctgtgccccgacgaacggcacgggcgacggcctgggccagatcgatgggatggtcgtaaaagatcagcgcctcccgcgcagatcccgaacaggctgcgatcacgaaatcggccgccgcgcggcattccacggcatcgcccaaccagccgatcatgttggcattcaccacggcatcgatgtccagatcggctctcggccctgccatccaggttctgaagcggccatccggtacccgtgctgcacgccccagagtgcgattgcggccggatgcgatccagggatgggcgccggagagcgccatggaggcacaggcggtgtcgtcgcaatcgggcacgaagccctcaagataggcccagatcccgggtgcgcgcatagtgcgcacaagaaacccgcgcgagcggtcgatcagcgcggcaatctctgtctggtccggatctgcaagccccccaagcgccagaagccccaccgccgccacgaagggcgtgcgctcgtcgatcccgggaccgacgggattatcgggcgggcccggcacacgctgcgagggccagcagccgtcggcagcaaccgtccggttcaaccagtcccgggccacaccgaaggcgtgatcgatctccaccatccgtcaccgcatgttgccgaccagcggagactgcggggcgttcagccacggcgtcaggtcgacattgccgcgagacgccagaaactgtgccagggcctgctgaatctcggcatcggtaaagccgccggtcccacctgcgacgcgatccagcgcgtcgtcgtccaacgctccgtcctctatggcgggcgccgcccggaagatctgtgtgaccgccgatttcgggtcgctctccagaagggccgccagctccggcttctcccggaccgccgctgcaatccgggccagaatctcgtccatgctcatcagaattccctctcccccggcgccaccaccggtggattggcctcacatcggaaagttgaggttattccagtcgacagtgccgccggacaccgcttccagggatgcgtcgtccagtgcatcgccggcgggcggcagcacgatgtgcaggcgcgagggggtttcttcatgcaccacgacctccagcgccgtcggcagttcgatcccgagcagtgtggagatcgcagccttcggatcgcgaagcattgtctcgcgaaatcccggatcggcagttgcgcggtcgagaatgcggttcagagcgtcatcgcgggacagcatgcgatctcacctttcagggatgatgcacggcagcggcggccccgaagggcgatcctgctggccgggtgatcatcccctgcggcaggcgctcgggcaatccgcacctgcagacatgtcaaccggcattgaaccatgtcctgtccccgatcctgaaatgacgaagccggccgcgcccgtctgatatggggcagggccggcctcgtacaggcacggtgatggcagttttggtcaggcctcggcagccggcgcggcatctccggcaggcttttcggccttcaccaccttgggcggcaggaccacgcgcaggtgcagttccttcaactgctcaggcgtcgcctcgtgcggcgcgttcatcatcgggtcctgggcctgctggttcatcgggaaggccacgacctcgcggatgttcggctgatcggccagcagcatgacgatgcggtcgacacccggcgcgataccgccatgcggcggggcgccgaagcggaaggcgttcagcatcccgccgaacttgtcctcgaccacctcgggaccgtagccggcgatctcgaaggcccggtacatgatctcgggcttgtggttacgaatcgcgcccgaagagagttccacgccgttgcagacgatgtcgtactgataggcgttgatctccagcggatccttggtgttcagcgcctcgagcccgccctgcggcatcgagaacgggttgtggctgaacacgatctggtcgagcttctcgtcgaactcgtacatcgggaagtcgacgatccagcagagccggaagacgtcgggctcgatcaggtcgagctcggcgccaagcttgaggcgggcggcgcccgccagcttcgcggccttgtctgccacgtcggtggcgaagaacacgccgtcgccatcccccaggcccagctgtgccttcatctccgccagacgctcatcgcccagattcttggcgatcgggcccttgccgccgccattctcgaaggcgatccagcccatgcccggggcaccctgctcgcgcgcccaatcgttcatcttgtcgaagaagctgcgcggccggtcggcgacgttcttgaccggcaccgcacgcaccaccttgccggcctcgaccgccttagcgaacacaccgaagccggacccgcggaagatctccgacacatcggcgatctcgatcggaatgcgcagatcaggcttgtcggagccatatttcagcatggcttcggcgaagggaatgcgcgggaacggcccggcgggcacatggcgggtgccgccgaattcctcgaacacaccccgcaacaccggctcgatcgcctggaagacgtcttcctgggtcacgaaggacatttcgatatcgagctgatagaactcgcccgggctgcgatccgcgcgggcgtcctcgtcgcggaaacagggggcgatctggaagtagcgatcgaagcccgccaccatcagcagctgcttgaactgctgcggcgcctgcggcagggcgtagaacttgcccggatggatacggctcggcaccaggaagtcgcgggccccttcagggctcgacgccgtcaggatcggggtctggaactccatgaagccctgatcggtcatccgccggcgcagcgacgaaatcacctgcgagcgcagcacgatgttcttgtgaacatgctcgcgacgcagatccagatagcgatagcgcagccgggtgtcttccggatagtcgcggtcgctgttgacctgcagcggcagcgggtccgcagccgactgcagcgacagctcctcgacccggacctcgatctcaccggtggccatgccggcgttcaccgtttcggggctgcgggcgacgacccggccggtcgcggtgatcacgctctcgttcttcagctcttccgccagcttgaaggcggcgctgtcgacgtcgaccacgatctgggtcaggccgtaatggtcgcgcaggtcgatgaacagcagattgccgtgatcgcgcttgcgatgcacccagcccgaaagccggacggtctggccctcatgggcgagcgtcagttcattgcaggtatgcgagcgataggcatgcatcggttcgggcctgttcgtcagcgggcgggtcgagactgtgggtgcggcgaccgggtgcggcagcgcacgcgaaggccccgcgacgaaaggctttccgcgcgggaccggttcggaacaacgcacggatgccgccggattgtcaagccatgccgccttgcatccctcgcgcgggcgccatgaagcccccggaaggtgacgtgacgtgtgtcgcccgtggcggcggggcgggcaatcatgctatagacggatcatgacagagatgatcaccgatacccagtcgctgcggcagttggtcgacgagttgaaggcggagcccttcgtgaccgtcgataccgaattcatgcgcgagaagacctactggcccaagctgtgcctggtacagctggccggcgcgcagcgggcggccgcggtcgatccgctggccgacggtatcgatctcgcgcccttgggggagctgctcgccgatccgtcggtcctgaaggtgttccacgccgcccgacaggacgtcgagatcttcctgctgttgttcggcaacgtgccgcggccgatgttcgacacccaggtcgccgccatggtctgcggcttcggtgaaagcgtcggctatgaaacgctggtcaacaagctggcgaaggcgtcgatcgacaagtcgtcgcgcttcaccgactggtcgcgccggccgctgacgcccaagcagatcgcctatgcgctggccgacgtcacccatctgcgcaccgtctatctgaagctcgcgaagctgctggaagacagcggccgcgaggagtggctggacgaggagatggcgacgctcaacgcgcccgagacctatgaaagccgacccgaggcggcgtgggagcggatccgcacccgcagcctggatcgtcgcttcctggggctggtgcgcgagttggccgcctggcgggaacgtcaggcccagtcgcgcaatgtgccgcggaccttcatctcgaaagacgagaccctgctggagatggcgtccagccagccccgcagcgccgaggatctgaaacgggtgcgcggcctgcccaaatgggcgaccgagggtgccggtggcgacgaggtgctgacggcgatcgagcgggcgctggccgagaaccgcaacgccctgcccgatcgcgagccgccgcgcgaactgccgcgcggccttgggccgctcatcgaactgctcaaggtcctgctcaagatgaagagcgaggagcacggcgtggcgcgcacgctcatcgcctcgcaggaggatctggagaccctggcgctcgatggctcagctgcgcagatcgccgccctgaagggctggcggcacgaggtcttcggcgaggacgccctgcgtcttctggcaggtgaggtcgccctcggcgcccgcggccggtcgattgccgtgctgtcgctgtcgggtgacgaagccgttctgcaggccacccgccgcaagcggcgcaagcgcaagtcccgcaaggatggcgagccggctggagccgatgatgcggccacggcatcggacgccgtcgcagcagactgatcgacctcggtcgatcggcgttgatcgatcagcgatcggcctgaagcatcagagtcgggaccgcagccggcggctcggacagggtgaagaccctggtccccggccgccgaccggtccggatccctgtcacggcgatgcccgccgcggccagacgccgatgcgtggcctcgatatcggccacccgccagcacagcccccacaaccggtccgacacaggcggatgtggtgcggcggcggcggtttcgtggatgacctcgaccaccgcatcgccgcagcggaagaacagcatccgcgccccccaggcggggttggcacgatccagcctgagatccagacccagccgaccgccgagcatcgccagagaccgttccggatcatcactggccacgaccagatgatcgagccctataacgctgcccgccgctgccggacgcgccgcatcctgctcgaccagaagccagagcgccggatcggtgccgctgcgcagcaccgcgaccgggcggccatccacggcatcggtgccatgatcgacggcaagcccgcgccgcgacatcaggcgcgcggtccggtccaggtccgacaccgccagggcggcatgagccaggccttccgccaccgccccctgccccacgccggtttcagcgcggaccagccgcacctccagaccgccgatccggaaccggacgaggtggtcatcggcagcgaccggcgccagatccaggatatgcgcataaagccgggccgcagcatcggttgccggcacgcggatcatgagatggtcgagccccaggatcatccgtcgcctgccgtccggccccgaccgcggacccgcggcgccgggataccgagaacaccacgtgccagcgccaccgtgatcccgcgacgctccgccagcgccgcagcatcgagctgatcgaccaaccggcgggccgcatcgaaagaccgctccatgtgcagcgtcagccagtgcaccacctcgccgctgaccctgagctggcgatcggtgaacagcttgaccagcacggcgctcagcagcgcgtcatccggcggccctaccctgaccgcaggggccgcccgcagcctggatgcgagatccggcagcgccagcgcccagcgggccggcggctcggccccggtcagcagcagggtgcctccggcggcggccaggtgattgtagagatggaacagcgccgtctcgtccgctcctgaggcaatcgcctcgcccacatcttcgaccagcaccgcacgggcaccgccggacaggtcgaccggtgcggcatctgcagtcagtcggtcagccgccacctctacggcgccgctcatcgcctgccacacccgggccagatgggtcttgccgcagccggccggcccgtggatggccagtgccggccccggccagtcgggccaccggtccagccacgccaccgcctcggcattggacggcgccacgaggaaatcctcccgcccgagtgccgggcgaagcgcaaggtccaacggcagttgagcggggcgtcgtgtcaaccaccggcctccggggcagctgtggagcaggcatccggcgagccggtggcatcgatgaccgttgcatcgaccgccggccgcggatcatagagcgcactggcaagataccgctccagcgcatagcgcaccacaaccgcgacacagacggcggccggcagggccaccagtacgcccaccagcccgaacagagcgccgccgaccatcagggcgaagatgatccagaccgggtgcagcccgacacgattgccgaccagcggcggctgaagcagggtctcgatcccctgcccggccagaaagatcgcgcccgccgcgatcacatgccagtcggtaccgaactgaagcagcgagaagccgaccgacagcgcaaagccgctgatgaagccgacgaagggcacgaaggacagaatacccgccgccatgccgaccgggaccgccagatcaagcccgatggtcaccagcccaagcgagtaccaggttcccaggatcaggcagagcagcgtctgaccgcggaccagaccggcaatgccacgatccatgtcgcgggccagccggcgaacaacgtcgcggccggtgaccggtacccagccgtcgatgcgcgccatcatcgcgtcccagtcgcgcagcagatagaagctgaccacaggggtgatcaggatcagcgagaccaggttggcgatcgacatcaccgagttcatcacgcccttgagcacatcggcgatcatacccgccgcgcgcgagccctccccctcggccgaggtgaacatcgcctggatgcgatccgccacttcaggcggcagccggcgccagagcagatccagctgcggcaggacctcctcgcggaccgccttgacgtaatccggcagcttgtcgatgaaggcgctgatccgggtctggatataaggcgcgagcacggcgatgccgatcacgatcacgccgaagaacatgatcgtcaccagccaggtagatgccatgcggcccagaccggcgcgttcgaagcggtcgaccacggggtcgaggaaataggcgaccagaagcccggctacgaagggcagcagcacgccgcccagcagccaaaggctgccgatcagcaccacgatgaaggcggcccagaacagggtgcgtgcactgcggctcatccggtctcccttcggatcgtcaggacggcggccggccgtcggcgtcgtcgcgaggctcgtgatcatgcgtgcgggcatgggacagccagcgccccagatagcccgccccggatgtcagggtggtggctgccaccaccagcatcagcaattccgtcaccgtccgccagtgacgttcgtcggtcgggccgtgaccgggcagcatcgccgccgccatggccatcaccatcagcgccagcccgatctgggcggcagtattgatcttgctggcccgcgaaggggcgatggcgaagggctggcccatggtctggcccagcatcaccgcccccatgatcagcacatcgcgcgaggcgaccagcatcaccagccagaccggcaccagattctgccagccgagcgcgatgaacgtgccggcgatcagcagtttgtcggcgatcgggtccagccaggcgcccagttctgtccgggcgtcgaagcgcttggcgatccagccgtccagcccgtcggagaagcccgcgaacaggaagacccagaaggcctcggccaccatgcccttcaggatcagccagatcaccaccggcaccatcaggatccgggcggtggtgatcagattgggcagctggcgcaggccggcggccatggctcagccgccggttcccaccgtgcgcggcggcacgctgccgccctgcccggacgtcccggccgccggcgtgccggtattggcggcgggcgccgccgccggcgaggtggaggtggtggtcggcgccaccccaccatagggggcgaggccggagttctgcggcggcacgggctgtacggccgcatcggggttgcggatgcgatcgatcagctcccagtcgacccccagcggcaccagcgccagattctgccgggtcaaggccgcctgaagcccctcgcgatcgccgtaataccggatggtgatctcggcgccgacattggagagcagcgtctcctcgaccttctcgatcatggcgagcgccgtcaaccgccggcggatctcggcccagaccgacagattggcgaagcgcaccaccgcgtccaggcgctcacgccggctgtagtcgacgatgttggtcgcgcgccagccgctgcgcgcctgatccagcagctgggccaccaccgcctcggcggccgttgcgacaccgttgtcgccggcaatctggccgttggcggtgtagacggtcccgtcggcggcggtcatccgcccctgaagctggctgccggtcacctgcgcctcggccacccagacaccctcggcatcgtagcgcttcgccagctcgcccttggccacgtcgtcggcgagcgacgcgccgtcggccggcagggcctgacgatcggcaaagtcgccgagcggcaccagcatcgggatcagcccgccgcggccgacagcctgttcccacgccgcccgccaccagccgtcatcccagtagatgccgtcatcggtgcggatgaccggcaccaccagcgacagcccctgatcggcggccgcgaaggcgatgccggcattgcgcagcaggccgcgtaccccctcggcatcgaaacgcacggtcagggtggcgcgatagcgctgcggcgccaccgcctcgttcgccacgtcgatcgaacgcaccagccgaagcagctgatcgtccgacggctgcggcaggcggccatggtcacgcggatcggtcatgccgctgagcagcatgtccagcgccttgcgctgacccacggcaagcgccttttcgcgcgccgcattggcattgccggaggtctcgtcgaccgcgacaccatcctgggtatagacctgggcgcggctctgcgccagggcggcacccgacgcagccaggcacagcaccgccaccacaagggcggcgaatgccggcataaggcgccggagcacgggtcggacgccattgaaggcggaaaggccgggtacagcgtggcctggctgcattgctagcattgcaaacgccgatcgttgcagtatgttcaccgcgccggaccgcccgccgggccgcccgccgttgttgttcgacggcaactctagtcgagagccggcgcgctgaaaaccatctcgcccggaaatcagcttcacgacacgggattgccgcagcacgcggcaccggccgcgtgaccgctgccccggaccacgacactcagaggcgatgccttcgatgagcgacgaccgcaccgcacagacccccgccgcccccgccggggcacgtgaccgctatcgcgatgcgggcgtcgacatcgacgccggcaatgcgctggtcgaccggatcaagcctgccgccgcccgcacgaagcggtcgggcgttgccggcggcatcggcggcttcggcgcgctgttcgacctgaaggcggcgggtttcaaggatccgatcctggtctcgtccaccgatggcgtcggcaccaagctcaagatcgccgaggcggtcggccgtcacgacaccatcggcatcgatctggtcgccatgtgcgtgaacgacctggtggtccagggcgccgagccgctgttcttcctggactatttcgccaccggcaagctgtcggtgccgcttgcggccgacgtgatcgagggcatcgccgaaggctgtgatcaggcgggctgcgcactggtcggcggcgagaccgccgagatgcccggcctctattccggatcggattacgatctcgccggcttctcggtcggcgccgccgagcgcggcacgctgctgccgcgcgacgacgtcggtgccggcgacgttgtgatcgggcttgcgtcctcgggcgtgcattcgaacggctattcactggtccgcaagctggtcgccgatggcggcttcgactatgccgcgccggccccgttcgagaccgcagccgccagcctgggcgaggccctgctcacccccacccggatctatgtgaaggcgctgatgccggaaatccgggccggccgggtgaaggcgctggcccatatcaccggcggcggcctgctggagaacatcccgcgggtgctacccgagggcgtcggcgccgatctggatgccgcccgctgggccctgccgccggtgttccgctggatggcggaaacgggtgggctgtcggggcatgaactggcccggaccttcaattgcggcatcggcatggtggtcgtggtggctgcagccgaggccgaagccgtggtcgcggccctgggtgctgccggtgaggacgcagccgtgatcggccgtctggtgccacgtgcggcgggcgaggccctggttgcgatcgagaacatggaggccgcatggccaagcgtgacgtcgccgtcctgatctccggatcgggcagcaaccttcaggcattgatcgatgcggttgccgccgatccggaccacccggcccggatccggctggtgatctccaacaagcccggcgtctacgggctggagcgcgccgccgcggctggcatcgaagcggtcgtcatcgatcacaaggccttccccgaccgggcggccttcgatgccgcactccaggccgagcttgaggcgcgcgggatcgatctggtctgcctcgccggcttcatgcgcatcctgaccgcccccttcgtcgaggcctggaccgggcggatgctgaacatccacccctcgatcctgccggccttcaagggggcacgcgcgatcgacgatgccctggcggccggcgtgcgcatcaccggcgtctcggtgcattacgtggtgcccgaaatggatgccggcccgatcgtggtacaggcggcggtgccggtactgcccggcgacgatcatgatgcgctggcgaagcgcatccatgccgccgagcaccggatctatccggccgccctgcgctgggttgccgccggcgacgtgcggttggcagagtcgggtcgggtcgaacacctgaccgatccggtggcgatcaactcggtgctgatctcgccacccgccctcggctgacgccgggctgtccttgataggacgtcatggatatgaaaagggccgcgcggcttgtgccacgcggcccttttcttcgtcccgaaggcgtcggatcagccgacgatctcggtctgggcgaagaagtaggcgatctcgatcgccgcattctcggccgaatccgaaccatgcaccgaattcgcctcgatcgactcggcgaagtccttgcggatggtgccctcggcggcattggccgggttggtggcgcccatgatctcgcggttggcggcaaccgcattctcgccctcgagcacctggaccaccaccgggcccgagatcatgaaagcgacgagatcgttgaagaaggggcgctcgctgtgcacggcatagaagccctcggcctgggccttggtcagctgcaggcgcttctgggcaacgatgcgcagacccttcgcctcgaaacgggcattgatctggccggtcaggttgcggcgggtggcgtcgggcttgatgatcgacagggtgcgctcggtggccatgtctcgaactcgtctctcggaagcggaaggaagcggtgccgcagggacatcccccgggcgccgacgggtctccgcggccaccccgaccggcccgttaccgggcgcgcatcgacatgccgcgatcgagccggcttataacggtttcccggggccggggcaaccgccgctccgtgacgacacgacgccgacacaacaccgatccccccgcctccggcagcggatgacagccctcgcggctcatgctatgtgatcgcccatgctgcacatcaacgatctcgtctatcgcatcgagggtcggccgctgttcgacggcgcgaccatcgccatttccgagggccagaaggtcggcctcgtcggcccgaacggtgccggcaagtcgacgctgctgcgcctgatccgtggcgagatctcccccgatgcgggatcggtggagctgcgccccggtgcgcgcatggcctccgtcgcccaggaagcaccgggcggcccggacagtgcggtggagcatgtgctgggcgccgatgtcgaacgggcacgcctgctcacgcgtctggccgaggcggaagcaacccatgacggcatggcccaggcggaaatccatgcccggctggccgaaatcggtgcccatgccgccccggcgcgcgcggcgcgcatcctctcgggcctcggcttcgacgaggcgatgcagactgcggcctgttcaagcttttccggcggctggcgcatgcgcattgcgctcgcccgcacgctgttcgccaatgccgacattctgctgctcgacgagccgaccaaccacctcgaccttgaagcgacgatctggcttgaaagccatcttgccgcatggccgggcacgctggtggtggtcagccacgaccgcgacctgctgaacgccgtcaccgaccgcatcgcccatgtcgagggcgggcggctggtgtcctatcgcggcaatttcgaccagttcctgcgccagcgcgcagaacggcgcgagcacgcggcaaaatctgcccagcgcgtggaagccgagcggaaaaaactgcaggccttcatcgaccgcttccgcgccaaggcgaccaaggccgcccaggcgcagagccgggtgaaggcgctggagcggctgggctcggccgacgcgccgccgcctgcctatgaagttgccttctccttcccctcgcccgagaccctggcaccgccgctgatcgccatcgacgacgtgacgctgggctatggtgatgcgccgccggtgctcaaaggcatcaatctgcgcatcgaccaggacgaccgcatcgccctgctgggcgccaacggcaacggcaaatcgacgctgatgaagctccttgccggccggctggaaccgcgtgcaggccgcatggtgcggccgtcaaagctcagaatcggctatttcgcccagcatcaggccgacgagctgatcccgggcgaaaccgccttccagcatatgcgccgggtgatggccgaccagcatgagagcaaagtgcgggcgcatctgggccggttcggcctgacccaggcgcggggcgatacgccggtggaacagctgtcgggcggagaaaaggcccggctgctctttgccctggtcactcgcgatgcgccgcacctgctgctgctggatgagccgaccaaccacctcgacatcgaggcacgcgatgcgctgatcgaggccgtgaacgactattccggcgccgtcgtcttcatcgcccatgaccggcgcatggtcgaacttgccgccgaacgtctctggctggtcgccgacggccgctgccgcccctatgaaggcgatctcgacgactaccggcgcctgctgctggaaactgcccgggccacccctgaccggggcggagttgccagtgacgccgacgccagggcgacacgtcgcgaccagcgccgcgccgccgctgaacggcgggaaaagctgaagccgctcaaggatgtggtccggaaagctgaagcagaggtcgagaagctgacccgcgaacgcgaccgtcttgccgccattctggccgacccgaagctctatgacgggccacaggctaaggtggctgaggcgactcgggccaagggcaaggtcgacgccgacctcgaagctgccgaagagcgctggcttgccgctgcagaagcctatgaggcggcggaggccgaggcactggccgacgcctgagaatgccgatgccgcgctgacggcgtccgctcctccgcaatccgatcgccatcacgatgcgcaggccggccagcgccgcctgccgcctctgctttttttgcgcccgaaacgcgtctacgacgcgacgggcgaattttgcgttgcagactgcgactgagacgcaaccctatgcgctgcagaatgcatcgcgttttgcatcaagacatcataaccattcccggcggtcgttattcacgcctggcgtatcagcagcagccgacgtcgagtgccaataatcaaaggatctcatcttcaaattttgcttcgcatttttcatcttgaacacatcgtcgagacgatcctaaataatccatatgatccctgctcaattcacatgcttccatccgtaaggagtgcggccatgaaagaaattgaggctatcctgcgcgacaatcgcatcaccactgcggagattctctatcatatgccggatcatccaacagtccttcagagttttgtctggcaattcctcgacatcgctccccggtttccgaagttacgctcgttcctggatttctgggcccgcgagattgatggccgaattcactcggtaacggttgccaactcaacactggcagcacctgcacgctggcggcacctggacggggtgtggcgcctgcaataggcatgggcccgcgctgtgactgccacagcccgaacgatcatggcgcgggacttgcttacctcttcggtcatcaccaccgccccccaccacggcacatgccggcaggcgcctgcatgtggtcgcggacggaaagctgtcatgaccgaagaccggccgggcgccgcagcgcgccctgcacctgatcatcgaagcgccgggagacgatcgacgatcgccgccgacgccttgatcgtctggctgaagccagtggcggtcgggctgatgctcgcggccctgctgttgtttgccgtggggttggtgcgcagcaacgagatggtccgcggcgtcataacggccgcatcgggcgatcttccgcgtgccgcgatcgccctccgcgatcttgagcgcacgattctggccgtggtggcggggctcccgtcgacggaccggacaatccctgacgagcccgatatcacgcgcaacaggctcgatcatatccgagagctgacgatcgcgatcgacagcaccggcatgggcgcaatcgtccgcgccttgccggatggcggaccggtcctggatacactgcgcgccacactccgccgggcaggcagcacggcagatcccggcgaggtggtccgggagctgggcccgatcgccgcccggctcgcagggctgctgccgaggatcgaagaaaaaacggccgaagcccggatggccgcccgcgctgagcttcagacgttgcagacgatgagcatgctgtcggcaacgggggtcgtggtctcggtcacgggtctcaccctgttgtcggtgatcatgcagctcaggctccgcgcaagccgcgggcgactgcgcgacgccatcgaagccatgtccgacggctttctgcacatcgaccgcaatggccgcgtgaccgttgccaatgaacggctgcgcagccatctgcctcgcaccatggcgtccgtccaccgcggccagccctcggggctgctgatcgccgccctggccgccagtgcggccgacccggaaaccgcacatcgacgcctgcttcatgtattggacagcatgccggagcccggacgcgcgctgcttccggccctggatgtcaagctggccgacgagcactggctgcggctcagggttcgtatcggcagcgatggcggccgtgccgtgaccgtggcagacgtcaccgatctcatagctgcggaacacgcacggcatcgtcaggctctggtgttcaaacacctgacggatggcgtagtgctggccgatgccgacggaaaaatcatggatgtcagcccggcggccgaacagctttacagcgtatcggcggcagccatagaggggcagcccatcggcctgctgctccgtccatccgatgcggagcagatgacccgggccctgctcgacgaactgtccggctgcgaaatggcagaacgcgccttcccgatcgcccgtcccggccctgatgggaacttcagccccaccggccgcgatggcgaggcaaccttcgtcgcgctccgggaggcctctgccggcttcagcggcgtcatcgccctgatccgggatgtcagtgaagtccatcgcgtccacaagctgaaggcggccttcatcgcggccgcggcccatgagctgcggacgccgacgacggcactgcttggcgccttgcgtctcgcaaacagcggtgtcgggggcaatgtgcccccgcaactgaacgcgctgctcgacatggcctcgcgcaatgccgatcgcctctcatccgtcatcgacgggctggtggatgtcgagcgcctcgaaagcggaagcttcactctggcacgtcagccggtgaggttggtagatctgctggcaaccatcgccgcccgcgcaagcgatctgccgcatgtcggactgacggtgagcggtcccgcggatcagatgggctgtgcagaggccaccacggtgatgatggatccggaacgtctcgcccaggctctgctgggcgtcgtcgatcaggtcgcagggccaccatcgcggatcgggagccgtaccgcggtcaggctggcctggggcctgaacgatcaccgggtccggatgtcggtggaacagcccgatccggccaacctgccggccgagacaatgccgcgcacaaagggaaaccgctcgagcccgccacgccgcccaggcgatatcggtttcggtctggcggtcacccgggcggtggtggagcgtcatggcgggctgatctggtgggaaaccaccgacgccggcagccgcttcagaatcgatctgccgctccaccggaccggctgacggccatgcaatcaggcggcccgttcccagcggccatccggccgctggcgccaataggtcagcgcgaacccccgggccttccgcgcccgccagcggtcgcgtgccgccgcaaccgccaggtcatcccgcccgtcgaagagatcgagcacccggacaaaacccgacggatccggatgatccatgccatcgaccaggacgaggacctgggggtcgttgggcagatcatcccccgccgtcagccagacgggctgacgttccggcaggggatcgccctggctgccatgcggcaggaaactgtccggatcataggtccagagcagactgtccagcgccttcacccgctccgccgagcccgcccgcagcgccgcccgccagtcgcgggcgagcacccgctcgagcagcgcgggaagcgcctgctcgagcggggtcgcggtcagatgataaaaggcgatctccaccccggcgggcgttgcctcggcgtcggcggacatcgcctctccgccgccgctcacgcgccggcttcgaagcggtcggcgaccaggcggtcgagcaggcgcacgccgtaacccgtggcccccttgggccccagatcggtgtcacccttgccccagaccacgccggccacgtcgagatgcgcccagggcgtgtcgcccacgaaccgcttcaggaactgcgccgcggtgatgctgccgccatcccgtcccttgccgacattcttcatgtcggcaatgtcggaattgatgtccttgtcataggcatccgacagcggcaggcgccacagcccctcgccggtcgcggccgaggcggagagcagggcattcgccagaccgtcgtcattggcgaacagcccggcattataggtgcccagcgccacgatgatcgccccggtgagggtcgccagatcgacgatggcagacggcttgaagcggtcgcgcgtataggcaagcgcatcggccagcaccagccggccctcagcatcggtgttgatgacctcgatggtctggccggagagcgaggtgaccacgtcgccgggccgctgtgcagttccggacggcatgttctcgaccaggccgaccacgcccaccacattcacccgcgccttgcgctgggcaagcgtgcgaagcagcccggcgacgatgccggcgccgcccatatcccacttcatctcttccatgccacccgcgggcttgatcgagatgccgccactgtcgaaacacacgcccttgccgacgaaggccaccggatcgccgtcgtcctcacggccggtccagcgcatgatcaccagatagggctcgttggcgctcccctgcgcgacgcccagcagggcgttcatacccaacgccgccatgcggtcgcggtccagcacctcgacatcgatgccgagccgcgccagatccttcagccgctccatgaaattacggggcgtgagaacgttggcgggttccgagatcagctcgcgggtgaaatcgacaccgtcgccggcggcattgcgggcctcgaacgccccggcagcctcggcaccggcgccgctcatcaccgtcaccgccggatcgacgggggcgtcgtcaccctccttcttgctgcgatagcggtcgaaccgccaggcgcgcaaccgggcgcccagcgcgacctcggcggcaagcgccgcctgatctccgtcgagcccggaaatatcgatggcgatcgccgcagcaccggcggccgagcgcaccgccctgcccccgagcttcagcgccttcagcgcatcgaactctccggtcttgccgatgccgagcagaacgacccgatcgagccccacgccatgtggcgccagcacgacggcctgctgctcgggcttgccttcgaaacgggccgccgccatggcccggcccagcgcgccgccggtcgcctcgtcgaccgcctgcccggcaggcgtcagtgcccgaccttcggagacgggaagaacgagtgtgccgtcggctggaatcgacgacgtcgcgaagctgatggtcatgcctgcctctccgggttcctgtgcatggctcggacacgcctgaaggtgatcctgatgcggactgctctccggcgggtgtctccgggcaatataggcggtgtgtccctccggcagaagaccggtgacgcatatcggacacgcccatccccgaaggcgggcactggaccctgggcgtcggccaatataagttgcgcccggcgggcggtgtccccgcatcctgtcgcaggacacgtcacaacccgcccgttccgcatctctcgccgcccccggtctccgctcggggatggacagtgaagccgcttcccagcccaggggttccatgccgggttccatgccgcttgccacccgctatctgttcagacagctgctgctgccggcgctcgccatcacagcaggccttgccgcagtggtctggctgacgcagtccgtgcgcttcctggatctgatcgtcaaccgcggtctttcggcactggtcttcgttcagctcaccatcctgcttctgcccactttcctgaccatcatcatgccgatcgccctgttctgcgcggtggtcacggtctattcccggctgatctcggaccgggagctggtggtgctgcgcgccgccggcctgggcccatgggcgctgatccggccggcgatgatgctggccggcgtcttcatgctgatcggctatctgctctcgctctacatcgtcccgaccttcacccgggatttccgcgaactccagatctcgatccgcagcgatgtggccgccgtgctgctccaggaagggcggttcaattcgccggtgccggggctgacggtcttcgtccgcgaacgcctgccctcaggcgaactcgcgggcattctggtgcaggacgagcgcaacaaggcggcgccggtcacgatgatggcggcgaagggcggcctggtcgccaccgacaccggccagcggatcgtcctggtcgagggcaacaggcaggaacgcagccccgacgggcgggtcagcttcctctatttcgaccgctataccgtcgatctggcactggttgcaggcgatgcggcgcccagtgcaccggaccggcgcgagcgttatctgtcgcagcttctgaaccctgaggccggcatttcggagaagttccgcggcgagttgcgcagcgagttgcatcagcgccttgcctggccgctctacaatctcgccttcaccctgattgccctcggccccctgctcgccggcgaattctcccggcgcagccgttggacgagggtcgcattggccgcgacggcaatgatcgccgtacagctcgccggcatcatgctgacctcggcactcgtcacgtcgccgctcgccgcaatcccgctttatctctcgattttcggcgctgcagccatcgccctctggctcatgctggggcgccatccccggcggattccaccccaggcgcccgacgcggcggcggaggaggcccgggcatgacgcagccatcatccagtgccggtcacgtgcgggcgggtcgggcaccatcgaccccgcgccggcatgtatcgaccacgctcagcctctatcttgcccgccatatgttgaattcggtcgggctggtgctggccgtagtgatggggctggtgctggtggtcgacctcatcgaactgctgcgccgcgcggccggggacgacgtgccggtagcgacgctgatcgggatggcgatcctcaagaatccgtttcagttgcagaagatcgctcctttcgcggtgctgatcgggggcatgatcaccttctcacgcctcacccgcacgaatgagctggtggtggcgcgagcggccggcgtgtccgtctggcagttcatggcgccgcccgtcggggtggccctgctgctgggggcgtttctggtcgccgtcttcaaccctctcgccgccatgatggcctccagatacgaatcgctcgacgcccgatatatcggcggtcgcagcagtcttctgtcggtcggccccggcgggttgtggctgcgcgagcggctggacggcgcaccagtggtcatccacgccacgcgtatggctgcggcgggcaccgatctcggcaatgtcacgatcttccgctacgggccggatgaaaccttccgcgaccggatcgacgcggcccgtgccactctgggcaatcaggtctggcatatcgagaacgccgtaatctcggcaccagaccggatgtcagaacgcgcagagaccatggaacaggcgactcagatgacgcgcgagcagattctggacagcttcgccaatcccgaaaccatgtccttctgggcgcttcccggattcatcgcgcagctcagggatgcgggcttcagcgcgctacagcatcggctctactggcactcggttctggccctgccattgctgatgacggccatggtcatcatctccgctactttcggtctgcgtttcacccgcaggggcggtgccggcatcaccattgccggcggtgtcttcaccggcttcctgctgtatttcctcacgggcgtggtctatgctctcggccaatccggaggcctgccggtggtgctggctgcctggactccggccggcgttgcggcgctgttcggcatagcgaccctgttgcatctggaggacggctagccttggtcgccggacctgcttccacccgccgccgctccacgctcgatcgcctgcgcgccgatcttctggccgcagccgccgtcgtcgtgttgagcgccctgcctgatccggcccgcgcccaggccctgccctctcttgcctccgacgagccgatcctgcttcaggcggatgaggtggagtatgcgcgcgagctggagcttgtggtcgcgcgcggtaatgtcgaggtcgcccagggcgaccggatcgtcagggccgacagcctgacctacaaccggcgcgacggtatcgtcacggcgcagggcaatgtggcgatggtcgagcccgacggctcggtcatgttcgcaagctatgcccagctggatgaaggcttcgccaagggcatcgcccgcgatctcaaggcccgactcgccgaccagacgcttctggttgccgccggcagcacccgggaaggccgcttcacgcagatggacaaggcggcctataccgcctgcgaactttgcgaagacaagcccgaccggccggctctctggcagatcaaggccgacaaagtcacccatgacgagcagacccgcgacatcgtttatcgcgacgcgacgctggaactgctgggggtgccgatcgcctacacgccctatttcagccatccggacccgacggtcgatcgccgcagcggcgtgctggcgccgacctatcgctcgaacagcacgctcggcagccggatcgacatcccctactacatcgtgatcgatcccgcgaccgatgccacggtcacgccgatgtggaccaccgaccagggtgcaggcctcagtgccgaataccggcgggccctggataacggggcctatgcgctggaaggcatgatcgccgaggcaacggacgatgtcgcgcgcgacaatgtccgcggctacatcgccggccgcgggcgtttcgacctgaccgatacgtggcgctggggttttgacggcatatgggccggcgacgacacggtgctgcgcgtctacgacattaccaaccgtgagaccctgacctctaccctttacgccgaagagctgaacggccgggactatgctcagattgccggctactggttccagggcctccgcagcacgcagcggcaatcggagctgccgacagccctgccgatggcgcaatggagccgcctcggcgcgcccggcatggccccgctgggtggtcagtggcggatggaatcgagctttgccggcctgtcgcgtcaggacgggaccgacagctaccgcgccacggtgggcggcgggtggaaccgcagctatatcggcagcgaaggcggggtgtacacgctgaccgccaatctgcggggtgacggctatgtggtcgatgacctgaccgatgacggccgcagcttcaatggcaccgccggccgtatcctgcccgagattgcgctggactggcgcctgccgatggttcgctccgacggcgagacccggcagatgatcgaaccgatcgtgatgggggtgatcagcccctatggcggcaattcgtggaagatccccaacgaagacagccgcgatttcgagttcgacgagaccaacctgttctcgacccagcgcttctcaggctatgaccgcgtcgaaggcgggccgcgggtcagctacggcctgcgggtcggccattataccggcgatggcggacagatcaccggtctggtgggtcagtcgctcagggccagggccgacgacaccttcgcgcccggcagcgggcttgaggacaaggtttccgattatgtgggccgggtggtagtcacgccgaacccgaacctcgatctctattaccggttccgcttcgacaaggacaccttcgaacctcgccgcaccgacctgggcgcggcctggatcgtcgatcgggcgagttttgatctgtcctatacgctccttagggccgatgagcgcgaagtcacagaggattacaccgaccgcgaagaggtgtatttcagcgccggctacgatattacggacgacttcaagatcttcggcagcctgcgccgcgatctggagaatgaccgctcgatcaatcatggggcgggcttcgccgtcgatctcgacaactgcctctacatcgtctccgaagtccggcgcagcttctcgcgcgaccgcgacatccagccgtcgaccgatgtgctggtccgtgtggtgctgcgcaccctgggcggaacctactgacatgcacacgaacgagcacagaggacgttcgatgaagcccttgcgcattctgctcctggccgccttcgccggtaccaccgcattgggcggagtggtggcgactgggcccggcacggcgctcgcgcagacggcgggccgggtcgcggccgtcgtcaatgacgatatcgtctcggtgttcgatctgactgcccggatggacatggtcatcaagacctctcagttgccggatgatcagcagacccgtcagcgcctggcaccgcagattctccgccagctgatcgacgaacgtctgcagctgcaggcggctcgccggctgggcctgaacgtcaccgccgatgaactgtcgcgcgccgaggcgcagatcgagacccgcaacaacttcgcgcccggcaccctggaacaggggctgcgggctcagggtatcgtgcccgccacagtgatcgaccgtctgcgctcggaaatcgcgtgggaaaaggtagtggcccgcgaggtgcggccgcggatcgtggttggtgaagatgaaatcaatgcggtgctggatcgcatccgcgccaatgccggccagaccgaataccgcgtgctcgaaatcgtgctgagcgtgcccgacccgcaacgcgaggccgaggtgcgccagaatgccgagcggctgcttgaacagctgaaggcaggtgcgcccttcacggcgctggcccgcgagttttccgacggcgtcaccgcccagcagtcgggcgatgtcggctgggttctgcccggtcagctgtcgccggagatcgacgccttccttgccaatgcccaggccggcagcgtatcgacgcccatccgtacgcccgagggctatcacatcgtggcggtcgccgacacccgcaaggtgacgggcggcgacgcctcacagatcgagatcgcgctgaaacagattgcgcttgaaaccggtgacgatccggcagcccagcgggccgccaccgagcggctgcaatcggccacggccgatctcgcctcctgcgaggccgtggacggcatcgccaaggagctgggcgccgatccgaccaccgatctcggccggctgaaggtcggcgatctggctccggcgctgcgtcaggcggtgatcaatctgggccccggcgaggtttccgggccgattaccggtggtggcatggtgcgggtgttcgtggtctgcgaccgcagtggcgacatcgccgggcttccggaccgcgataccattcgcgaggcgctgatccgccagcggctcgacacgatggcccagcgccatctgcacgatcttcgccgccaggcgttcatcgatgtccgcgtctgacgatgcagcacggcggccgctggccgtcaccatgggagagccggccggcatcggcggcgagctgaccctcgccgcctggatgcgccgggcggatctcgccctgcccgccttcctggccatcgacgatcccgaccggctggccgggattgcacgcaagcttggatggacggtgccgatccgcgagattgcgtcggccggcgacgcgctgacggctttcgacgacgccctgccggttctgcccgtccggctgccctcgcctgccaccccggggcgcccggatcccgcccatgccggggcagtggtcgaggcactcgaccgtgcggtcgaccttgccatggcgggcgcgatcgatggcgtggtgaccaatccgatccagaagaagaccctctacgacgcgggctttccttatcccggccataccgaatacctcgccgcccgctgtggtggcggcatgcggccggtcatgatgatcgcaagcccggccatccgggtcgtgcctgtgaccattcacgaggccctgatccgggcagtggccctgctgacgcccgacctgattgtcgagaccgccaccatcaccgccgaggcgctgcgccgggatttcggcatcgctcggcctcggctcgcccttgccggcgtcaacccgcatgcaggcgaagacggcacgcttggccgggaggatatcgagatcgtcgccccggcaatcgaacggctgaaggcagccggcatcgatgccagggggccgctgccggccgataccctctttcacgaagaggcccgggcgggctatgacacggttctgggcatgtatcacgatcaggtgctgatcccggccaagaccctggacttccatggcggtgtcaacgtgacgctgggcctgccgattgtgcggacctcgcccgatcacggcacggcgctcgatctggcgggccgcggcacggcccgtgtcgacagcctgatcgccgccatccgcctcgccggcaccatggctgccgcccggcgccgtgtctccccttctgcctgaattacagagccctcatgacctccacgcctccggctgacaccgctgcgatgcgcgatccgacatcggcgctcgacgccctgcccccgctccgggacgtgatcgcggccgcgggcctcgatgcacggaaatcgctcggccagcacttcctcctcgacctcaacctgacccgccggatcgcgaagcttgcagaggggcgggacggggttgccggtcgtacggtcatcgaggtcggcccggggccgggtggcctgacccgcggtctgctcgccggccctgccgcccgcgtgatcgcgatcgagcgcgacagccgggccgttcaggcgttgcagccgctgatcgaggtctgtcccggccgcttctcgatcatcgaagccgacgccttgacgatagaccccggcaagctgctcgacgaggttggtgacgacggtcggtgctggatcgcctccaacctgccctacaacatctccacgcagttgaccgtgcagtgggccgagcgtccggaacgcatcgccggcatggtgctgatgtaccagaaggaggtcgccgaccggctgaccgcccgtccgggcagcaaggattacggccggctgtcggtgttggcccaatggcgcttcagcatccacaagggcttcgatatcggcccgcgtgccttcacgcccccgcccaaggtgacctcgaccgtgctggtcttcgagacccgtcccgaaccgctggcgcctgcagatctgaaagcgttgtcgacggtcaccgctgctgctttcggccagcggaggaagatgctgcgacagagcctgaaagcacttggcgaggcagaagggctccttgctgccgctgatatcgatccgacccgccgggcagagacggtgccggtagaaggcttctgcgccctggcacgggcccttacagcgcgcaacacgccttgaggacatgatcgatttacaccgtcgacgatcttgaacggctcgcgacggcgcccgacattggcatcggccacgtccggcctccctctcgaccggagaccgcatgacctatcttctgctcgctgccggccttggacttttgttcctgggtggcgaactgctggtgcgcggagccgtcggtaccgctacacgtctcggcgtctctcccatggtgatcggcctgacgctggtcggcttcggcacctcgacccccgaactggtggccagtcttcaggccgcccttgccggggctccgggtatcgcaatcggcaatgtggtcggcagcaatcttgccaacatcctgctcatcctcggtgtctcggggctgatcctgccggtggtcgtgaacccgtccgcctttcgccgcgacggtaccgcgctcgccctcgccaccatcgccttcatcgtcgcctgccttggcggcgagcttggccggattgccggcgtgctttttctcgttggcctcgtcggctacacgctgttcagctacatctccgaccggcggagcaacgacgctgcagcccgcatgcatgcagccgaggcggatttcgtctcggaagagccgcaggtgaaagccatgagcctgcccaagggcctgctgatcaccgcgatcggcatcgcgggcgtcatgctcggggccaattttctggtcggctcggcggtggagatcgcccgcgaatacggcatgtcggaagccgtcatcggcctcaccctggtcgccgtcggtacgtcgctgcccgagctggtcacctcggtgatggccgcgatccgccgccatggcgacgtcgccttcggcaacgtcatcggcagcaatattttcaacatcctgggcatcgccggcgtgacggccctggtcaagccgatcgcgattccggccgaggtgctggcactggatctctgggcgatggccggggctacggccctgctgctgttcttcgcctggacaggttggcgcatcggacgccgggaatccggcatcttccttgcagcctacctggtctatctggcggcccagctctcacccggcatccgcggggcgctggggctcgcctgacatgcgtcgggttgccggaccgcctctcctcagcggccggcaccttcgcgcatcgcgttcacgaaaccgctgaggccgagccgccgccggcgccgcaggcgctcagccctgaggatcgcttccagatccgccagggtacggtcgacatcctcgttgaccagcacatagtcgtattcggcgtagtggctcatctcatccgccgccttggccatgcgcttggccaccacctcggcgctgtcctgagcccgggtggtcaggcggcgctccagttcggcgatcgagggcggcaggatgaagacggtcacaagatcgtcgcgcgcccggtcggccagctgctgggtgccctgccagtcgatgtcgaacagaacgtcgcggccgtcggccagggtcgcctccaccgcggcccggggtgtgccatagctgttttcgaatacggtcgcatgctcaagaagcgcctcttcggccaccatgcgatcgaaactcgggcgatcgatgaagtgatagtcgacgccgtccacctcgcccgggcgcatcggccgggtggtcaccgagaccgacagcgtgatgtcgtcatcctgcgagagcaggcggcgcgacaacgtggtcttgccggcccccgaaggcgaggagagcaccagcatcagaccacgccggcgatcatgaggggcgcggcgtgcagcggtggcgtcggtcatcggcagcatggtccctgagaggcggtgatgtcgaagctcattcgacgttctggatctgctcgcggagctgatcgatccgggtcttgagggcaaggccgatccgggtcagcgccgtgtcggaagatttcgagcacagcgtattggcctcgcgattgaattcctgcgccaggaagtcgagctggcgcccgaccggttcgtctgcggccatcagctcccgcgcctgggcgacatgggcgaccagacggtccagctcttcgcggatatcggccttggcggccagcattgcggcttcctggacgatccggtcttcggcagcacccgcgcggtcctgcagcaggctgcggagctgttcttccagccgggcacggatggtcgcaggctgggtggcggccaggccggcagcctcggtcaccagcccctcgatcgcatcgacatgttcggtcagcaaccgggtcagagccgccccttcctgggcgcgggcaatgaccaggcgatcgaaggcggcgatcaggctctcggtcatcgcatgctcgcgcgccgcccgaacggcctcgctctcctcctgctccaccatctgcagcaggccgggcacccgcagcagaccgtcgagccgcggcaccttcgccttgggaaagcgccgctgaagctcggtcagaacctcgcccagcccatcggcgacctctggatcgatgcgaagacgcgcgccccgggcatgggtcaccaggcccagctgcacgctgacatgaccacggcggatacggtcctgggcgaccttgcgcacgaccggttccagctggtcgaaaccgggcgccagccggatccgcaggtccagcccgcggccgttgacgctcttgacttcccagttccagccatagcgggcatcgcctgcatcggcgcgggcgaatcctgtcatgctggcaagcgccatggccaatctcccgaggatgagcgatgatcaggggcgggtcggacgggcggactatacgaacccgccccgcccccgccaagcctcggatcaccatccgggtctgatcacgtcacagtctccgacgctgcccgtcggatgtccaccaggaccacccgcgtcccatgaccgcatcccccacgccccgccatatcgcgatcactggcgcgtccagcggcctgggcgccgccctggccctggaatatgccgggccgggcatccggctttccctgcacgggcgcgacatggaccgcacggaagccgtggcggcggccgcccgcagccgaggtgccgaggtggatgtggcgcggttcgacgtcaccgatgccgatgccgtcgcagcctgggtgaccgcgatcggcgcacgcgcccccctcgacctgatgatcgccaatgccggcatctcaggcaatgaaaccggcagcggcggcgccgtttcggcagaggtcacaagggcgatcttcgcggtcaatgtcgacggcgtggtcaacaccgtactgcccgcagccgaactgatgctgggtcgcgggcggggagcgatcgccatcgtcgccagtctcgccggctatcgcggtcagccgggggccccggcctatgccgcctccaaggcggcggtgaaggcctggggcgaggggctgcgtccgcgccttgcccatggcgggctgcgggtctctgtcgtctgcccgggattcgtgcgcacgcccatgactgcccgcaaccgctttccgatgcccttcctgatggatgccgaccgggcagcgcggatcatccgccgcgggctcgatcgcaaccgggcgcgcatcgcctttccctggcagcttgccgccctctgctggctgctcgccgccctgccggccgcctgggcggaccggctgctcggcagcctgcccggaaagtgatggccgccacgtcgggcccgtgaaaacacgcgaatgtcacatcgcacttgccagaagggcgatctccgcgccaggatgtcgccactgacggtgtcctgcggtcgttccgcgggatgaaaagggaatgcggtgcgccggtggaatagtccggcaattccgcggctgcccccgcaactgtaagcggagagtgccccgtctcgaaaccactggccccgacgggggccgggaaggtgacggtggtgcgacgacccgcgagccaggagacctgccgtcattcgcggtcacgggcgagcacgtcgggcggggtgtaccgatgggttctgcaagcggtggcggcgcggcatgaagatcccataggcccccaaggcttccctcttcccgccccgaccagccaccctgccggcctcgttcgcagtgaccgcatgatgcagtcgaacgaggtcgagtatcccgtgtccacgaatcgcccgcccgcttttgcccggtcgcgccgtctgctccgcaccggtctgaccctgccgctggtcgccctctctccgtttgcggtcgccaccgtcgccacagccgaagatgccggcactgacgaggcgacccgcctcggaccgctttccgtctcggccgcccgcagccccgtgccggtcgaaaccgtcggcagcgccgtcaccgtcatcaccgccgaacagatcgaggctctgcagatccgtcaggtcgacgatgtgttgcgcctggttcccggcgtcgcagtcagccgcaccggatcggtcggcggcatgtcgcaaatccgtatccggggctcggaaggcaatcagacgctggtgcgcatcgacggcatcgaagtctccgacccttcgggcggttcggaattcgatttcggccatctgctcgcctacgagatcgagcggatcgaagtgctgcgcgggccgcagagcgcgctctatggctcagacgccgtgggtggcgtgatcgacatcacgacgaagcgtggctccggcccgctctcgggcagtgtgcggaccgaggccggcagtttcgacacccgcgaagcggtcggcacggtctcctatggcgaccagatcttcgacgcgctggtctcggcccaaagcttccgcaccgacggcatctcgtccgcagacgaacgcgccggcaatccggagaaggacggctaccgcaaccgttcggcctttgccaaattcggcctgcggccgtccgaagacctggagttcgccctggtcggcaggaccgtgcgctatcgggccgaaggcgatggctattccaccctcccttacgacgccgatgaggaaacccgcggtacgcagaccttcctgcgcggcgaagcgcgctacgccatggcggacggccgctggcatcataaggtcggccttgccaacaccgaacatgatcgcgactaccgatcagatggcagcatcaccagcacctatctgggccgccggctgaaggcagactatcagaccgactacgggttcgagaccggcgccgtcagtcacgatctttcgctgggaaccgagtatgaacgcgaaaccgtacgaaccagcagtgcctggtcaacggtcgaccgtgcctttgattccacaggttttgcgggggaataccgcctcgggctctacgaccagctctttctctctgcggccggacgctacgacaagaatgaaatcttcgacgatcagaagacctggcgcttcaccgcagcctggctgatcccgggcacggataccaaactgcgggcttcttatggaactggcatcaagaacccgaccttgtttgagttgttcggctacaccaatacctatcaaggaaatcccgatctgaagcctgaagaggcaaccggctgggatgccggtatcgagcacagcttcttcgatggccgattcgtgatcgatttcggctggttccgtcaggacatcgaaaacctgatccaaggcagcggcagcacgtcgatcaacctgcccggcgcatcacgggtcaatgggatagaaacctcggtcaccattcggccggtttcgtgggccgatctgcggctggcctatacgtatacagacggagaagactccaacgggcaggagttggtgcgtcgtgcgccgcacatcgccagtgccgatctcgcgacccgctttctcgacaaccgtggccgggccggcctctctgtcgtctacaacggcgaacagaaagactgggcctacgatgccttctacaaccgaagcgtcgtcaccctcgacgattacaccctcgtcaacctcaccgccgcctatgatctcaccgacacggtcgaaatttttggccggatcgataatctctttgacgaggagtatcaggaggttctgggttacggctcacgcggtcgcgcaggctatgccggcctgcggatgcggttctgatccatgcggaggtggcgcctcacgctccgcccgaccggccttctgctgaccggcctgttgctcgcgatcctgcccccggctttcgccggggacgggccgcgccggatcgtgtcgatgaacctgtgtgccgatgaattgctgctgcgcctggcgccgcccggccggctggtatcggtcacctggctggccgcggggccggcggcgatcgatcctgcagcagcgcaagggctggtgttcaatcacggccgggcggaggagattgcccggctcgccccggatctggtggtcgccggccgctacaccacgctgacgaccacgcagatgctgcgcagggccggcatcccggtgctgctgctcgacgaggcgaccagcctcgccggcatccggtcccaggtcaccagccttgcggcggccgtgggcaaccccgctgccggccggcagatgctcgacgccatggaccggatgcttggcgaggcgaccctggatgcgaaagatacaccgcaaccgggtgtcgtggttctgcgccccggcggcggtgtcgccggagcgggaaccctgcaggacgagatcctggccgcggccggtctccgcaatctggcccccgatgcgccggtcgatggcgatggccggatcggcctcgaacggctgttgcgcctgaaacccgatctgctcgtgctcgattccgacggggatgcgccaccggcccttgcgcgcgaggtgctcgaccatccggccttccgggcacgggcggcgggtataaccgtcaccagcctgccggccgctctctgggtctgccccggcccgtgggtcgcagaggcggtcggtcgcttgtcggccgcgcgacggtcgctcgccgcacgcccgcgaggatcgcggccatgacgctgaccacggggcggatatcggcggcgctcctcctcctcaccacccttctgtcggtggcctccatcgctgccgggccggacggtctggatcttccgcgcgccatggccgacgtcgcccatggccgcgacacgctggatgcgctgatcctggtccagctgcgcctcccccgcgcgatcctcgcgattgtgctgggcgccgggctcgccatgtccggcgcagctttgcaggggctgttgcgcaacccgctcgccgatccgggcatggtcggtgtctccgcctcggctggtctgggtgccgttgccgccttctacagcggtgcggcagccgcctggtcgctggccctgccgctcggtggcatcgcaggcgccctcgccgccacgctggtcctggccgtgatcgcggcacgtggggccggcaccacagcgcttatcctcaccggcgtcgccgtcggcagcttcgccgcagccctcaccgccctcgccctcaatctcgcaccgtcaccttatgcggcgctcgaaatcgtcttctggttgatgggatcgctcagcgaccgcagtatggatcatgtctggctggcggtgccgccggtgatgatcggtctggtgatgctcgcccggctgggacgggcactcgaagcgctgacccttggcgaggacacggccgcaagtctcggcttcgatgtcacccgcacccggcttacggcgattctgggcacggcccttgccgtcgggcccggtgtcgcggtcgcgggcgcggtcggcttcgtcggcctcatcgttccgcatctgctgcggccgctggtcagccatcgccccggcgccctgttgctggtcgcagcgccggctggcgccgctttcaccctctcggccgatatcgccgttcgcctgctgccgacccgtcccgaactgaagctgggggtgatgatggccctgatcggtgcacccttcctcgcctccctgatcctgaagaccgcgcgaaaggacggctgacccatggacgcaatgaccctcgaggcgcgacacctcaccctttcagggccggaccgcgcccggctcgaggatctgtccctgtcgttcggcccggggcaactggtggggatgatcggccccaatggcgccggcaagaccacgctgctgcgcctgctcgccggtcttctgaccccgcagcatgggagcgtgctgctcggcgggcagccgctgcaccaattgtcggccgccgcccgggcgcgtcggatctcgtatctggcccagggtgccgatgtgcattggccgctgccggccgaggcggtggtggcactcggccgcctgcctcatggtgacggccggacgcccgcggaccgccgcgcgatcgcccgggccatggcggcgaccgggacggagggctttgccggacgcagggtcgacaggctttcaggcggtgaacggctcaaggttctgctggcccgggcactggccgtggaagcaccgatcctgcttgcagacgagccggtcgcagccctcgacccggcacaccagctcgatgtcatggacttgctcaaagcccttgcaggcgatggccggttggtggtggccgtgctgcatgatctggggcttgccgcccggttctgcggccggctggtgttgctggccgagggtcgcctgattgccgacggaccacctgaagccgtgctcacccccgacaggctggcacgggcctatggcatccgcgccctgcacggccaggccgacggccatctgctggtcgtgccctgggcccgcacccggatgtcggaacagtcaagggagacaacgacatgccccacgcatccatctccgggtatgaggatgcaggcccgctgatcggccagcttctggccgatccggcccaggcctggagcacaggcagcttcggcgccatcgccgagttcatgcgcgatgccgacgagccgctgtcggtcgatgccgcagaggaccccgagcgccgccggctggccaccgcccgtggtgccatcgccatcacgccgcggagcgatgtccggcctctggcctacgagaccccgtcctccgacggcgtcggctggtcgtcggccatcgccttctgcctgcccgaagccgccgccgccgggccggcccgaacggtggtcaccgaactcggccccgatgcggatgccgtacggccggaagaccggagcggcatcctgttcgatctgggcctcggcattcctcataccgaggcctgcctgcgcgcctcgacgcccgaggcgctctcggttctccgcaggctggccggccggccgctgctgggagaggatccgggcccgcgccgggccgccgcagccaccggggcccatcgggtcttcatgacccggctggcaaggatcgaggtatttcaggccgttccgaagacgggtgaaacctctcccgaaggaccccacacccatcttctgccgaagctgctggccgccggtcgcgccgcctccgccaatacgccgatccccgacgggttggtcgccggtctgacgctgcatgcgtgcaatccgctgcgcgacgctctcggtcggccgcgtgccttcgacccgatcgcccatcagacctttcaggaattgatgacgacgcatggcgatccgcgggtgctggccctgcgtcagcggttcctggccgcactgcaggacgggatggctccggacgccctggtcgatgacgatgatcaggatgcccggcatctgcgggcgacgcttcgtgtggctctgcgtcaggcccgccagacgcaggcggccagaacggctgttatcgatgcctggggcgatgcaatcgatcctgccactcgtgggcgggctccggacgccgtctgcggctgaggcgtcagtcgccggccgccgccttcgcggcccggcgacgctcgcgctcgatccggcgccatttggcgacattggcattatgctcggcgagcgtgcgcgcaaagacatggccgcccgtcccgtcggccacgaaatacagcgcatcggtctccgccggctgggccacggccatcagcgctgcccggccgggcaaggcgatcggcgtcttcggcagaccgtcgatctcgtaggtgttccagtcgtgggcattgcccagatcggaccgggtgataccgcggtcgatccggccgctgccctcgctcaggccatagatgacggtcggatccgactgcagccgcatgccgcgcttcagccggttcacgaacaccccggccacaagcggccgctcgtccggaatgccggtctcccgctcgacgatcgaggccaggatcagcatctcttcgggcgtcgacagcggcagatccggccgccttgcggcccaggcatcgtccagtgccttgtccatcgccgccttcatccggcggatcagggcgccgcgatcatcgccacgggtataggtgtaggtctcgggcagcagcgcaccttcggcgaacccctccatcggcggcatgtcgccgctgagcaggtcgtcgccggccaccgcctcccaggcggcgcgaagcgtgatgccttcgggcagggtcaggcggtgcagcacgaccctgccttcgaccagcatgtcgatgatgtcggacgggctctgccccggctcgacccggtattcgccggccttcagccgggtctgcacatccagcagcaccaccgccgcccgaaagaccgccggttggtcgatcgccccggcatcggccagttcacgggtgatgccggcgacgcccgtaccccgcggcaacagcacggtccgggcctcggtcagcggcccgggcgtttccagccagacggagccccaccacaacaacgcccccgcccccgcgacgaccagggtcgtcagggagacgagggcgatgatgagatgcttcaggaagcgcacggcagagcccgcagatcccggatcatagtgtcggcatcactcgggacggctcattcgggccggccgaagatcaccgaggcgttggtgccgccgaagccgaaggagttggagagggcgtaacgcacctcacgttccttgggctgatggggcaccagatcgatgtcgcagccctcgtccggattgtccagattgagggtcggcggcacgacaccgtcgcggatcgagaggatcgagaagatggcctcgacagcgccggcagcgcccaacagatggccgatcgacgacttggtcgacgacatcgacagcttgtaagccgcctcgccgaacaggcgcttcaccgccgccagttcgatcacgtcaccgcggggcgtggaggtgccgtgggcgttgacatagtcgatctggtcggggttgagccccgcccgcttcatcgccgcctgcatggcgcggaagccgccattgccgtcttctgacggcgcggtgatgtgataggcatcgcccgacatgccgtagccgacgacttcggcatagatcttcgcgccacgcgccttggcatgctcaagctcttcgagcacgaccacgccggcaccctcgcccatcacgaagccgtcacgacccttgtcccagggccgcgacgcccgttcgggggtgtcgttatagccggaggacagagccttggccgccgcgaagccggcaatgcccatgcggcagacggcggcttcggagccacctgccaccatcacgtcggcatcgccccacatgatcagccgggcggcatcgccgatggcatgcgcacctgtggagcaggcggtgaccacggcgtgattcggcccgcggaaaccgtatttgatcgagacctggcccgaggccagattgatcagcgctgccgggatgaagaacggagacacgcggcgcggaccgcgctgttccatggtgaccgcgccctcggcgatggtcggcagaccgccgataccagagccgatcatgacaccggtgcgatcgagttcttcctcggcctccggagcccatccggcgtcgcggatcgcctcgtcggcggcccccagcgcgtagtggatgaactcgtccatcttcttcacgtccttcgcgggaacatagtcctcgggacggaaggcatcttcaccggcgcccttgggcaccatggcggcgatgcggacggaaaggtcggacacatcgaagctgtcgatgtgacggattccggacttgctggcgagcagacgctcccagctcgtcttcaccccgaccgcgagcggagtgacaagacccagcccggtgacgacgacacgtctcatctcggtcagcgcgtcctttctgcctgaaatcggtcgcgtgccggcggcgcgacgcctgccggaacgccagaagcgggcgttgcagccgatcccgttccggaccggccgacgacgcccgtttcatagcggatctccgcggcccgtcagggttgcgcggcagagccggctgcggagatgcctgatcggcatcgcagcaccggctccggaggatcagctcacccgcatggaagcgggcgcggccgtaccgacctggtggccggcacgtcgcccggagacctgtccgatcaggactggttctcctggatgaacttgatggcgtcctgaacggtcaggatcttctccgcggcgtcgtcggggatctcgatcccgaactcttcctcgaaggccatcacgagttcgacggtatcgaggctgtcggcaccgaggtcgtcgatgaagctggccgtctcggtgaccttctcttcgtcgacaccgagatgttcgaccacgatcttcttcacgcgctcagcaatgtcgctcatcagtcgtcgtccctcaagctcactggcaagtggcgttcgttcgggcgtagcgccgtactgccgtttgtctcgtgcctggcagccccgccgaaatcgaacagggctgtagcacactttccgcaccttggccagccgcggcggacatgtcgcggcaatgaaggtcacggggctggtccggtttgcgtccccggcccggcggtcagatcatgaccatgccgccgttgacgtggagcgtctgaccggtcacgtaagccgcctcggcgctcgccagatagacgatggccgcggcgacgtcttccggtgaaccgagacggcccaccggcaccttctcgagcagaccggtcttctgctcgtcagtcagcacgtcggtcatcggcgtcgcgatataaccgggtgcaacacaattggcggtgatcccgcgcgaagcgacttcgtgcgcgatcgccttgatcatggcggtcagcccgcctttcgaagcagcgtagttcgcctgccccggattgcccatatggccaacgaccgaggtgacggcgacgatgcggccgtagcggcgcttcatcatgcccttcatcgcggcccgggccagacggaagccggccttcaggttgacgtcgatcacctgatcgaaatcggcgtccttcatccgcatcaacagcgtatcgcgggtcagccccgcattgctgaccagaatgtcgagcccgcccatggcggcttcggcatccttcaccagctgctcggccgcgccgtccgccgccaggtcggcgggcagaacatgaacacgcgagccaagctcggcggcaagaccttccagcgcgtccgcgcggcggccgtgcagcgcgaccacggcgccctgggcatggagagcgcgggcgatggcggcaccgatgccgccggtggccccggtcacgagcgcggtgcgctgcgtcagatcgaacatggatgatccatcactgtggtggacgggaaagatcgcgggacggttgaggggccgtcctcaaagagacttcaggaacgcttcgatctcggccggcgttcccaccgactgggccgaaagcgctcggtcgatgcgcttggtgagaccggagaggaccttgcccgcccccagctccacggtttcctcgacgccggcctccttcatcgccagcacgctttcgcgccagcgaaccatgccggtcacctggtcgaccagcagaccgcggatgcggtccggatcggaaaccggagcggcgagcacattggcgatcagcggcaggcgcggcgcgtcgatctccacctgcgccagggcatcggccatccgctcggcggccggctgcatcagcgggcagtggaaaggcgcgctgacctccagcgggatcgcccgcttgccacgggccttggcgacctcgaccgcgcggtcgatcgcggtcttgtggcccgacaggaccacctggcccggggcgttgtcgttggccgcaacgcagacctcgccggaccccgcggcctcgtcggcgatggcccgcgcctcgtcgggatccacgcccatcagcgccagcatggcgccctgcccgaccggcaccgccatctgcatggcctggccgcggatcttgagcagacgtgccgtatcgccgatgtccagcgccccggccgcgcagagcgccgaatactcgcccagcgaatgcccggccacgaaggcggccttctgagccagatcgacgccgccttcccgctcgaggacgcgaaccacggccatcgagcaggccatgatcgccggctgggcattctcggtcaggatcagctgctcggccgggccttcaaacatcaggcgggtcagcggctgcttcagcgcctcgtccacctcctcgaagacctcacgggccgcggcgaaggccgctgcaagatcctgtcccatgcccaccttctgcgagccctgtccgggaaagacgaacgcacgtgccatggagcctcgcttcagtcttggctgtcgacccgatcgccggaccgaagcccgcaggcccggccggtcgtcgccaagtcatgaccgcgaccgcgaccgattgtcaagaaccgcatcgtcccagcgcaccggatatggtcgccatgactggcacgaccagcagtttccagggctttgcgatgcggaacatccaacgccggatcggtctcagtttagccgacgccgcggaagatgcgagaggcgaaatcaacctttaatacgtatttttcgggacttttgtgatcacagggcgagtttcagtgcccaccgggggccgccttgtgcccggccatccgccgggcgggccgccggcggcgatttgccttgcgcgccgaagggcatgacgtatagtgcgcgcctccgcaccgggtctctcgatccggtggtggggatgtcgtgcgtctacgccattatgacatggccagatgcacaacaccgctccttgccggcatcgcgtgatgtcggctgagcccgtcccgcccgggcggtccgacacgccggaaggcgatcgtcggagaccggggcgtcgggcaggaaaaagccgtaaggagtccattatatgcccttctacgagacgacgatcatcgtccgtcaggacgcctcgacccagcaggtcgagaagctgggcgaggatatcaagaccatcctcgagaacgcccagggccgcgtgatcaagcaggagaactggggtcttcgccagctcgcctaccgggtcaagaagtaccgcaaggcccattatctgcacctgaacatcgaggcctcggccgaggcactggttcagatcgagtacatgctccgctaccaggaagatgtgctccgctatctgaccgtgcgcgtcgacgaagtctccgaggagccctcggtgatgatgcagagccgtggccgcggtgagcgtggcgaacgcggtgagcgtggcgagcgccgtggcggcgaccgcttcgagcgtggtgatcgcggcgatcgtggtgatcgcggcgaccgcttcgagcgtcgtgagcgcgccgaccgctgatcctgtatcagaaatcgcgaggatagatcgtcatggcttccaacaagtcgcagagcgccgtcacgattccggcggctcagggccagcgtcgcccgttcttccgccggaagaagacctgcccgttctccggtgcgaatgcgccggtgatcgactacaaggacgtgaagctgctcagccgctacatctcggagcggggcaagatcgtgccgagccggatcacggccgtgtccgcgaagaagcagcgtgagctcgcccgcgccatcaagcgcgcgcgcattctcgccctcctgcccttcgtggtgcagtaacccatcagcccttccgacgccgtccgctcaagacggtgatcgacgggatccgatggaccgaccgactgatcaggtccggatggtcccggaaacacgaccttcgacccggtaccggtaacggtgccccggcttcggaggcggatagcggaacaggacgcccatgcggttgtcgcgcgacatctccatcaccctggcggcgggtgccctttcgggcgtcggcagcctgctggtcgtgacgggggtgctgggcgtgatcgcagcctatctggcgcccgcaccgctcttcgccgccgcgttccgctatgggctgcccggcggggtgatttcggccgtggccggcaccatcgcaggcgccgccaccgcagcggcgctggccgggcccgaacaggttctctacggcctgggctttgcggtggtcaccgcgctgcccgtgcttgtcatcgcccgtttcgccctgctttcccgccccgatggtgcggggggaaccgaatggtacccggcaggacggctgatgacggtggccatcgcgctcgccggcgcgctggttgccgggggatggctgttcgcagccggtgccgagggtggcctgcgcggcgaggtcgcgcggacgctggaaccgctgatcgagctgatggcggcagatgccgccacggcgaatgccgcggttctggccgaaagtctggcggggcgtttcgtcgccttcgccgcgtgtttctgggtggtgcagatggtcctttccggcatgctcggccgcttcgccgcggaccggctgctcgggggatcgatgcggcccgtgccgccgcttgcctccttcgatccgcccgaggcggttcgctgggtgctggtcgccggcgtcgcactgaccatcgccaccggcggcgacggtgatttcggcctctttgccggagttgccgcggtgctggccgcgatgccctatctggtcctcggtctgggtgtggcacacgggcttgcccgcggtgtccgcggcggcgggtttatcctcgctgcggtctatctgctggcactgatgctgtactggccgatcctgctgatccttgtcttgggcttcgtcgaacgttgggccgggctgcgccgtcgctccggtgccgcctgacacagccttaggagtacatccgatggaagtgatcctgcttgagcgcattcagaacctgggccagatcggcgaccgcgtgaaggtccgcccgggttatgcgcgcaacttcctcctgccgcagcgcaaggccatgcgcgcgaccaaggagaacctcagctatttcgagacccagcggaaggccctggtggcgctgaacgatcagcgtcgcggcgaggccgaggtgctggccgagaagctgaccggccaggttctgccggtcgtccgtcaggcggccgacaacggccagctttacggttcggtcaccgcccgcgacgtcgcgattgcgatggagcagttcgggttcgaaatcaacggccgccaggttcagctgcgcgagccgatcaagaccctgggcactcagaccgtctccatctcgctgcaccccgacgttgtggtcgacgtgaccatcatcgtcgtccgcagcatggacgacttcctgaaccagcagcgccgtgcggccgaggccgacgagcagctcgacgacgcctatgagctcgccgaggaaagcgctgcctatcaggccgacgaggttgaggaggaggaagaggtctgatcctcttccgcccggacagcccgtcgggaccccttggggccgacacatgcggccgcgttccggtacatccgggacgcggccgtatcgttttgacagaccggctttctggaaccgcaacaggacctgcggattttacgaccgatctgccccatccggatgctgtggcaaaaattcaacagtgcagcacatcaagtccgtagacatttgacgggcgcttttgaaggggcataagattggaacgtgtctaaaatacgccggcccggaccggcgagcgacgtcggaccatcccccgcgcgtcggctgacccacaatacccggcccgtgctcctcccgcacggtttccggcatccgcacgcgtggagttgcccccgcacagacccggcgtctttcgccacggcccggtcacggctcctgacggaggcgattgaccgtgatatccggtttgaccttcctcggcggactgatccgcacggggacgctggttgtgaatgacgagaacggacgcagtcaccgcttcggcgacggcaccgccccgcatgtccgcatccagatccacgaccctgccatgctccggcgcatggcggtcaacccgtcgatggccctcggcgaagggtatatgaacggccagttcgacatcatcgacggggatgtgcgcaccctgctcgatctgggcgtgaagaattatgcccgccagtcggcccatgcccatcactggccggtctgggcaacgaggctgatcaacttcttctatcagcacaatccgcgaaaccgggcgcgacgcaacgtcgcccatcactacgacctgtccgaagagctgtaccggctgtttctggatgccgaccgtcaatattcctgcgcctattttcagacgccggatgacgatctggagacggcgcaacggcagaagaagcggcacctggcggcaaagctgctgctgcaaccgggtcagaaggtgctcgacatcggctgcggctggggcggtctcgggctctatctgtcgggtcatgccgatgtcgaggtggtcggcgtgacgctgtcggaagagcagcacaaggtggcccgcgcccgcgcagaagcatcaggcctcgcccagcgcgccgatttccggctcaccgattatcgcgacctctccgagcgtttcgacagaatcgtgtcagtcggcatgtttgagcatgtcggcctgaagcactatgacgagtatttccgcaaggtctacgacctgctgaccgatgacggcgtggccgtggttcacacgatcggccgaaccgacgggcccggcgtcaccaattcctggatccgcaaatacatcttccccggcggctatgtcccggcactttcggagatgatgccggcgatcgagcgcgccggactggtcgtcaccgatgtcgaaatcctgcgtctgcattatgccgaaacgctgaagcactggtatgagcgtttcatggagcaccgcaaagaggtcctggcgctgtatgacgagcggttctgccggatgtgggaattctatctggcaggctgcgaggcctcgttccgtcactggggtcaggtggtgttccaggttcagctggcccgccgccaggatgccgtgccgctgacccgcgactacatcaccgacaccgaacgcgaatgggccgcgcgggagcgtcggcacgagttgcatgtggcctgctgacgcgacgccctggcccgccaggggtccctgccctcagaagcctttcatcccgacgcccgccggtgcatgatcgcgaccgtgggcgaccggtggccgggccaacccgtcccggccaccggtcgcccacgacctgatctgtttctgcaccgatcccgaggccgatgaccgacaccgatttcgacgcagccggcctgcccgccgtcaccgccggcgcctccacggcgcttacggcagggtccgatgcggccggcagcgggctcgcggtccgcagccgccccaacaatgccgaagtcgaacaggcgctgctgggcgccctgctcatcaacaatgaagccacccatcgggtcagcagcttcctgcgccccgaacacttccacgagccggttcaccagcggatctacggccagatcctgcgcttcatggagcgcggtcagatcgccaatcccgcaacgcttaaaccgctgttcgacgccgatcccgccctgtccggtgtcggcggggccgcctacctggcgcgcctggtcggctctgcgatctcgatcatcaatgtcgaagactatgcgcggatcatccacgacttcgcgctccgccgggcgctgatcgacatcggcgaagaggtggtgaacgaagcctatgacggccgcgccgagcgtccggccatcgagcagatcgagcatgcagagcaccgcctctacaccctggccgaacagggagagatcgagggcggcttcgtctcttttgaccgggcactcagcacggcactcgaccagatcgaagcggcctataagcgcgacggcaacctggtcggtgtcgccaccgaactgatcgatctcgacaatctgatgggcgggttgcagccctcggacctgctgatcctggcgggccgtccgtcgatgggcaagacggcgcttgcgacgaccattgcgttcaacgccgcgcgcgcctaccggacggaacccgaagaggccggcggtaagcccaaacacgtcgacggcgccgtggtcggcttcttctcgctcgaaatgtcggccgaacagctggccgcccgccttctggcgggtgccgccggcgtgccttccgaccggctgcgccgcggcaccatgtcgcccgaggatttcgagaaggtggtgatggcggcgcgagagctgtcgcgcatcccgctgttcatcgacgacacgccggcgatcaccgtcccggccatgcgcgcccgcgcccgccggctcaagcggcagcacggtctgtcgatgatcgtggtcgactacctgcagctgatgcgggcggtgcgcgccaccgacaaccgcgtgcaggaagtgtcggagatcactcagggactgaaagccgtcgccaaggaactgaacgtgccggtgatcgcgctgtcccagctctcgcgtgccgtggagcagcgcgaggacaagcggccgcagctctcggacctgcgcgaaagcggatcgatcgagcaggacgccgacgtggtgatgttcgtgttccgtgaagagtactatctggcccgcgccgagcccaaacagcgcccggacgagaagcccgacaagttcgccgagcgctattcccactggcaaagccggttcgagatgtcgcgcagcgtcgcggaggtgatcgtggccaagcagcgccacggcccgatcggcaccgtgcggctgcatttcgacctgaacaccacgcgcttcggcaatctggatcgcgaccacgcagccctgctggccgccaacgccccgtcgagcgaatgagcacgccgctcactgccctgcccgcggcacccgccgccccgccgccggcctggatcgagatcgatctcgacgcgctggcagagaaccacgcccgcctcaccgggctgatgcgcgcgcacaacccggctgccgaggtcacgggcgtaatcaaggccgatggctacgggctgggggcggatatcgtcggccccgcccttgcgcgggccggcgcgcctgcgcttttcgtcgcacatctgtcggaaggtgcagcgctccgccgggcgctccgggcggatcccgaccccgcccgccatgccctgccggtctacatcctgaacggcatggccgagggagaacgtgcggattttctggccttcgacctccgccctgtgctgaacggccccgacgacctcgaccgctggacccgcgccggccaggcccaaggcgggccgctgcccgccgccctgcatatcgacacggggatgagcaggctcggtttcgacgaggcaggcttcaaggccctcgcagccgacccggcacgcctcggcggcgtcgatatccggatcaccatgagccatctcgcctgtgccgatgatcccgcccatccgctgaaccggcgccagctcgaccgtttccgggccgtgacggccgtagtcgggcgtggccggctcagccttgcgaattcaagcgggctgttcctcggccccgacttccatttcgatctcggtcgcccgggtgtggcgctctatggtgtcaatccggtgcccgggcacccgaacccgatggtcccggtcgtgcgtctgaaggcccgggtgctgcaggtgcgaaccatcgacagcttcgagagcgtcggctatggtgcggcagcccgcgcgcggccgggcatgcgggtggcgacgctggcgatcggttatgccgatggctggccctggtcggccgcaggcaagggcgaggtggtgattgccggccatcgggccccgatcctcggccgcgtgtcgatggatctggtgacggtggatgtcagcaccctgccggaaccgctgatccatggcggcgccgtggcggagctgatcggcgatcatcgcgacatcgatgcgctggcaaaagacgccggtaccatcggttatgagatcctgacccgcctgggccgccgctatgcccggcagccgatgacgtcgggccagacgcaggtttatccgattggcgtgcccacgccgcagacggaggtcgaccccgccccatgaacccgcttgccgccatcggccgggccctgctctccctgttcgagaccgtgggccgcgttacgctcttcgtcctggtcgtgctgcgccatctggtcaccccgcccttctatttccgcgccatgggccggcaggtgatggagatcggctattacagcctgccggtggtgggcatgactgcgctgttcagcggcatggtgctggccctgcaaagctataccggcttcgcccgcttttcggctgaaagtgccgtcgcaggcgtggtggtgctgtcgatcacccgcgaactcggccccgttctcgccgggctgatggtcgccggtcgggtgggggccgcgatcgccgccgaaatcggcaccatgcgggtgacggaacaggtggacgcgctgaccacgctgcgcaccaacccctacaaatacctgatcgtgccgcgggttctggctgcgaccctgatgctgccggtactggtgctgatcgccgacatcatcggcgtgatgggcggctggctggtcggcgtttacaagctgggcttcatctccaccacctatctggtcaacaccttcaatttcgtcgagccgctggacgtgatctcagggctcgtgaaagcggcggtgttcggcttcctgatcgcaaccatgggctgctatcacggcttcaacagccgcggcggcgcccagggtgtcggcagtgccacgaccaatgcggtggtgtcgagttcgatcctgctgctgatcttcaactatgtcatcaccgagctgttcttcgcgcgctgaaccacagccccgtccccgaggagccccaggcgacatgaccaccgccaccccgaagatcgcgctcgccgacgtgcacaaatcgttcggccgcaagcaggtgctgcgcggcgtagatctttcgatcgatgccggatcgtcgctggtggtgatcggcggctcgggcaccggcaagtcggtgctgatcaagtcgatcctgggcatcatccatcccgacaagggctcgatccgcatcgacggccgcgagaccatggggctcggcgcccgcgaccgcgaagaggtcatggccggcatgggcatgctgtttcagggcggtgcgctgttcgacagcctgccggtctggcagaacgtcgccttcggcctgatccagggcaagggggtggcccggcgcaaggcgcgggagatcgcgatcgagaagctgtccctggtggggctcggcgccgatgttgcagaactggccccggcggaactgtcgggtggcatgcagaagcgcgtcggcctggcccgggcgatcgccaccgaccccgacatcctgttcttcgacgaaccgaccaccgggctcgacccgatcatggccgacgtcatcaacgatctgatccgcaatcaggtgaagcgcctgggtgctaccgccatcaccatcacccacgacatggcgagcgcccgcaagatcgccgaccatgtggcgatgatctatcagggccggatcatctggcacggcccggtggaagagatcgaccacagcggcaacccctatgtcgaccagttcatccatggtcgtgccgacgggccgatccagatggaactgcgccggccctgacgcgtttcggcgcgacggattccgggaaaccagtcgatggccaaagccaccacacatttcgtctgccagtcctgcggtgccactgcggcgaaatgggccgggcgctgcgaagcctgcggcgaatggaacaccatggtcgaagaggtcctgccccagccggtggcgggtgggcgcggttcggccgtggcctccgcgcggcgcgggttgtccttcgtcaccctggacgggccggtcgaggtcgtgccccggcggcgctgcggcatcggtgaactggatcgggtgctgggcggcggcctggtcccgggggcggcgatcctgatcagcggcgaccccggcatcggcaaatccacactgctgatccaggccctggcggcactggccggcaatggggtcgatgcctattacgtctcgggcgaagaatcggtcgatcaggtccggctgcgcgcccatcggctgggtcttgatggttcgtcggtcaggctcgccgccgaaaccaatatccgcgacatcgtctcgacgctggagaagaccccggcggacagacccgcggtagcggtgatcgacagtatccagaccatgcgccatgacggtctggaaggcgcaccgggaacggtgtcgcaggtgcgcgcctgcggtcaggagctgatccagctggccaagcggcgcggcattgcggtcatcatcgtcggtcacgtcaccaaggagggccagatcgccggtccccgcctgctggagcacatggtcgataccgtgctccacttcgagggcgagcgcggccatgcctaccgcatcctgcgcgccgtcaagaaccggttcggcgccaccgacgagatcggcgtgttctcgatgaccgatctcggcctgatggaggtggagaacccctcggccatcttcctgggtgatcgcgatgagaaggtctcgggcagcgccgtcttcgcggggctggaaggcacccgcccggtgctggtcgagatccaggctctggtggccgcctcggcgctcggcacgccgcgccgtaccgtggtcggctgggatggcggacgtctggccatgatcctcgccgtgctcgatgcgcggtgcggcctttcgctcgggtcgaacgacgtctacttgaacgttgcaggcgggttgcgcatccttgaaccggcagccgatctcgcagttgcagcagcgctgctttcgtcgctcaccgaccgggccctgcccaaggaaacggtggtgctgggcgaagtggggctgtcgggcgaggtgcgtgcggtttcgcagatggaggcgcggctcaaggaagccgccaagctgggctttacccgcgccttcgttcccaaggccggcgccggccggcagatgccggtcgagatccggccgctgaagcgcctggccgaactggtggaactcttcgtggggccgaatggcgaatacgcccccaaacctgccggcgatcaggccggcgaccgggacggcgctgcccggcccggccggcgcggccagccgcgcggaacgatcgactgacggaagcgggcctccctgccctccccgccgtccgcccctgttgaaggaagacccggatgtccctgacgctcgccgacgtggttgtgctcgccatcgtcgcactttcgaccctggtggcattgatccgcggcttcgtacgcgaggtgctgtcgatcgtcgcctgggtcggcgccgcgctgatcacggcctatctcttcgatccgctgcgcccgcttgccgatgacttcatcgccagcgagaccgccggcgacatcgccaccatcgcggtcatctttctggtctcgctgctgatcctgtcggtgatcacccgtgccatcggcgacgtggtctcgggcagccccttcaccttcctcgaccgcctgctcggcgccggtttcggtgtcgcccgcggcctggcggtgatggcagccatctatctgggcctgctctgggtctggggcccgaatggcgagcccgaatgggttcggaaatcggaaacccgtcccgcggtggtcgaagcggcgcggatcattcaggaactggtgcccgagcgcatgcgcagccagttcctggagcgcgcagaccaggcggcgggcgctgcggccggcgccgcaggcgatgcggtgcgcggcacgctgggcggtgcgatgcccggcatgccgcgcgacactgcgcctggaacggctcctgcgcagaacaacccctcgggcaatgtgacaggtgcaaccccctccggcggtgaaatcggttacggcgaagggcagagacatgatatgaaccgcctgctcgatgcgatcgagcccgcacctgcgggcggccagggtacgcaaggccagggcaactgaccgcatccggctgacggagcgaccgcaagtcccaagacggtcgtcgaaatcggtgcgaggcgatgatcatcacccatcccttccgatccgggcccgacggccgggacctggtccatgcagatgaggatcatctgcgagaggaatgcggaatcttcggcattcacggccatcaggaggctgcccgtcacgtggccctcggcctgcatgccctgcagcaccgcggccaggaggcctgcggcatcgtcagttacgacggcgaccagttccacccccaccgtgcggtcggccttgtcggcgacgctttcgccgatgaacggctgatggcgcagatggccggcactatgggcatcggccatgtccgctacgccacgaccggcggtgcgggcctgcgcaacatccagccgctctatgccgatttcgccttcggcggccttgcgattgcccataacggcaacctgaccaatgcgctgaccctgcgtagccagctggtccagcgcgggtgcattttccagtccacctcggacagcgaggtgatcgtgcatctgatcgcgatcagcctctataccgatgtggtggacaagctgatcgacgcgttgcgccaggttcacggcgcctattcgatcgtggccctgacccgcgacaagctgatcggcgtgcgcgacccctggggggtgcgcccgctggtcatcggcaagctcgacggcgccatgatgctggcctccgagacctgcgcactcgacatcatcggtgccgaattcgtccgcgacgttgagccgggtgagatcgtggtcatcgagcagagcggcctgcgctcgatcaagccgttcccgaagaccgccagccggttctgcatcttcgagcacatctattttgcccgccccgacagcgtgctggaaaatgtcagtgtctacgaggcgcgcaagcgcatcggtcgtgagctggccctggaaagcatcgtcgaggccgacgtggtcgtgccggtgccggacagcggcgtgccggcggcgctgggcttctcggagcagagcggcattcccttcgattacggcatcatccgcaaccactatgtcggccggaccttcatcgagccgaccgatcagatccggcatctgggcgtgaagctgaaacacaacgccaatgtgccgatgatcaagggcaagcgggtcgtgctggtcgacgacagcatcgtgcgcggcaccacatcgaccaagatcgtgaacatggtgcgcgaggccggtgcggccgaggttcatatgcggatcgcctcgccgcccaccacccatccatgcttctatggcgtcgacacgccgagccgcgaaaagctgctggcggcgcgcatggacatcgaagaaatggcccggttcatcaatgccgacagcctggccttcatctcgatggacgggctgtaccgtgccatgggtgaagagggccgcaatccggttcagccgcagtattgcgatgcctgcttcaccggcgactatgccctgccgctgaccgacggccaggtggacggcagcgacgccaagttccgcctgcgcagcgacttcgcctgagccgacaccgcagctgccgccccccagagcttccggagcgcgaccgatgaccgaagacatccagcccgccgcccccaccgatcgcccgctcaagggccggatcgccctgatcaccggtgcgtcgcgcggtctgggtgcagcggttgcggaacgctatgccatggccggtgcccatgtcatcctgcttgcccgtaccgtcggcggattggaagagaccgacgaccgggtgaaggccgtgggcggcactgcgaccctggtgccgcatgatctggccgatctcgacaagctcgacagcctgggccagcagatctacgaacgtttcggccggctcgacatcctggtcgccaatgccgggctgctcggcaacatctcgcccatgtcgcagcagaagccgcgcgactgggatcgggtgatgaccgtcaacgtctcagccaatcagcggctgatccggaactgcgagccgctgctgaagctgtcgacggccggccgcgcgatcttcgtcacctcgcgcgccgcccgccggatccgcggctattggggtgcctatgccacctccaaggccgcgctcgaggccatggtcaagacctgggcgatggagatcgagaacagccgcatccgcgccaatctggtcgacccgggggccctgcgtacccgtatgcgcgccaccgcctatccgggggaggaaaaggacctccagaccccgccagaggcgatcgccgagctgttcgtcgatctggccctgcccggcctgaccgccaatggcgagatcttcgtggcccagaccgcgcctcaggcaccggctcatggccccgaccatcatggtcacgaccatcatggccatgatcatggtcccggttgcggctgccactgaccggcgcactgcaccagaccgacggaacttccggggcgcctgacggcgcccctttttcgtggtcaaccgtcaggcgccgggaagctgttcgatgatcgcgcgcatcagatcttcggtcaggcgaagctgaggcggtttgccgtcgccatgggctgcccccgaggtcgggctgccgtcatccagcacgccgtgtaccagcgccacgccaaccatcagtgccagtgccagccgcgccttctcccgagcatgggtgccgccgatccgctccaccagatggtccagaacatccgcctccagccgttcacggatcagcggcatggccgcccggctgttgatggagctcatcaggatccggctgacccgctcgcaggcagccagaacggcagcatcgatctcgtgatcgaccgcctcgcgcccatgttcttccgtcagcgcagccgatagcacgccgggccggccggccatcacggtcaggcgggtcagaacccgtgccagcctctcgcgcgggacgtcgcgcagcagggcatcgaaggccgcgtcgcccaggcataccgcgaacaagcgttcctttgatccgtaatagcggatgaccagcgaaacattgacgtccgccgcccgggcgatttccctcaggccgaccgtgtcatagctgttcgcggcaaaggcgtggcgcgccgcatcgaggatcgccgctttggtcgcctcgctgttgcggggcctgctctctttatctgacatcacttcttcatcaaatcaacttcaagttatgcaaacacctgttgacatgtcctgggatggacatctaaggtttcagacgacgggtggtgctgccgtcgatctacggcaggtggcgcaattccgcagagccggcggacatcctctccctccccgatgccggcgcataccccagcgttcaggtacagctttcgggctgcgctgatgagggtttttgccgccacggcgcagaatttggacgacaggcaatgcccgaacaggacgcgcacggccgaacgcaggccgggcaggtgcgaccgacgcgactgaacacgcgggaacttctggaactcgccgccagtttgctgtcggcggccgaagcgggggacacatcggttggcgggcggcttggctcccttccggaggaactgctgcgagtgatcaacgacctgccgcccgaatccgaggaccggtcgtcggcattccgctttctcgatatcgaacaggcgtcagagaccgtcacgatcctgatccgacccaatgatcgcgatcaggggtggagctgaccggccttctgcccacacgataccggcgaacgcaggcggcgcccccgccctgcgacaatcgcggcgtatatgttatgtgaatccgacgggatctgcgcgcgaagaccatgataatgggtgcgttcgacgcttattcctgcccgttcacggcgatcgcccgcacgaaaagcacgtgaaagtagtgtaatagcgcgggcatccgctgccagaacaacattattgcataatatgggaaagactgcagacgccgccgaagccggtcagccctgcccgatcagctcggcaaaacgccccagatcgacatttccgcccgacaggatcacgccgacgcgttgtccgtgaatgtcgatggcgcgggaaaatgcgcccgcggcggcaaggcagccggtgggttccaccaccagcttcatccgcccggcaaagaagcgcatcgcctcgaccagggcggcatcctcgaccgtgatcacctgatcgaccagcgcccggatcaccgggaaggtcagccggccgggggctgcggtctgggcaccgtcggcaatggtctgtggcgtggggatggagacgatctcttcggctgcgaggctgcggcggacatcgtctccggcggcaggttccaccccgatcacccggcagcccggctgcagggcggctgccgcaaccgcggagcccgaaatcagcccgccaccgcccacacagacgaacagcaagtccagcccgcctgcatcgggcatcgccatcacatcctgcaacagctccagtgcggcggttccctgcccggccatgacatcggcatgatcgaagggcgggatcagcaccaggccgcgctcttcggcgatctcgcgcccgatggcctcgcggtcctgggtgtagcggtcataggccaccacctcaccgccatagccttccgtcgcctgacgcttgatcagcggtgcgtcggacggcatgacgatgaccgtctccagcccgagaaggcgccccgccagcgccaccgcctgggcatggttgcccgacgagaaagcgacgacgccccgcggggggcggggctctgccttcagtttcgcaagtgcattataagcaccgcggaatttgaaggcccccatccgctgcaggttctcgggcttgaagaacaggcgtgcgccggtcatcgcatcggcggtcgcagaagtcagcaccggcgtgcggtgggcaactccctccagccgcgctgccgcagcccggacatcctcgataccgatggcgagaccggtcatgtcgtcacctcttcttcttgcggtcggcgaaggggttttcgctggtgcgtagcaccacgcgcaccggcacacccggcaggtcgaaactgtcgcgcagaccgttcaccacatagcggacatagctgtccggcagttccttcggctggctcacgaagatcgcgaagccgggcggacgggtcttgatctgggtgatatagcgcaaccgcaggcgccggccgttggccatcggcggcggataattctcggtcatgcgttccagccagcggttcagccggccggtcgacacccggcgattccagatccggtagatgtcgaaacaggcatcgatcagccgatcggtgttgtgaccggccagcgccgagatcgtcaccaccggtacgcccttgacctgcggcatcacatggctcatccgccggcgcagttcggtcatgaaggcatcggcgtcggtgacggtgtcccacttgttgaccgccagcaccagtgcacggccctcgtcgacgatcagccgggcaatggtcatgtcctgcttctcgagcccgcgttcggcgtcgatcatcagcaccacgacatgggcgaagcggatcgcgcgcagggtctcgtcgaccgacatcttctcgatccggtcatcgatccgcgccttccggcgcatgccggcagtgtcgatgagccggatacggcggccggcatgcagccagtcgaccgcaatggcatcgcgcgtgataccggcctcggggccggtcagcacccggtcctcgcccagcagatggttcatcagggtcgacttgccggcattcggccggccgacgatggcgatctgcagcgccttctggcggccgatctcggccatggcccgttcttcggccgcggccagggtctcttcgtccgcatcctcgtcgatatcgacatcggagccgtcatcgtcgaaatcatcgaggccgacttcgcgggggccgtgctcggccagttcctccgcctcggcaccctcggcaccggcgcgggccgccgcgcgacgacgggcggccgcagcctcggcttcagcggcagctgcgtcctccagcgcctcggcatgggctgcaccatgggccgacagcacgtcataaaggtccgaggtgtggtcgccatgcgccgcggacagcggcatcggctctcccagccccaggccccaggcctcggcgaggcccatatcgccggcccggccctcgcatttgttcaccaccaccacgacgggggtctccacccgccgcagcagatcggcaaaatgctcgtcggaaggtgtgatgccggcgcggccgtcgatcatgaacagcaccagatctgcatcatcgatcgccgttcgggtctgggcctgcatgcgggcgttcagatccgacggatcctcgatctcttcgagaccggccgtgtcgacgacgttgaagcgcagattgccgagccgcgcctcacccatgcggcggtcgcgggtgacacccggcgtgtcgtcgacgatggcgatgcgccgcccgaccagacgattgaacagggtcgacttgccgacattcggccggccgaccagcgccacggtcagcatggacgcggacctccggaatggacatgaggtggtcgcgaagccgccacggtcgtcacgaccgccggctccacaggatgaagctgccaagcggacgcgaccccgcaggccgtgtgcctgcggggtcggcgccctgcatcggttcatgcgcatcaatgacgatgcgcgggccccacgtcaacgataagcgatcagcgtcgcatcgtcgcgcagcacatagagcttgccgtcggcaacgatgggcgaaatgttcaccgccccgccgacatcggtttcgctggtcttgctgccgtcggtcgggttcagtgccatcaggctgccggcactggatgccagataaagacggccaccggccagcaccggaccggtccagcggatcggatcctcgcgatcctcagggtcctcgaaggccggcagatcgaccacccagcgcacccggccgtcactgcggcgcatcgccaccaggcgggtcgagtccaccaccacatagacggtggtgtcggccacccagggggtctgattcaccttgaaaggctgctcccagacccgcaggcccgagcgaacgtcgaaggccgcgatcctgccaccgacggtgcccgcgaagaccatgtcgcgatcgatcaccgggtccgacagaatatcggtcagcgcgctcagcgacgatccggccgcggcgaagcccgcgagtgtctccgcccaaccgacccggccgctgtcaccgcgcagcgccaccagatcgccactggaataggccgcaaccaccagattgcccagaacgccgggggccgccccgcccaggatcatctgggtcgccggcacgccgccatggcgccacagctcgcggccgctgtcgccggcaagggcgatcaactgattgtcgaagctctgcacgaagacgcggccctcacccgccgccggcggcgcacggaatggggtatgcatcgacgtccgccacagctcgacaccgtcggcggggttgagcgccaccacgtcaccaaagccggtcgcggcgtagatccgcccgtcggcgatcgccagaccgccgccataggcgccctccagcagatcgctgtcgggcgcaagctccaccgaccagaccccgcgtccggtcgaggcatcgagtgccacgacattcgaatcggcgtcgagcacatagatccgaccatcggccatcaccggctgggccatcaggcgcttggccccgccagagcccacgccggcatccccgcgccaggcctcgaccggggtttccgggccggccagcgcatgcatggcgtggttgccgtagccgctggtctgcggccattcgccgttctgccaggccggcggtacagtgatcgcttcggacgcaaccgccggatcgatccggatgtcggccttttccggcatcacggcgattcgctcgcccggcagcgccggcttgtcatccgatccccaccagctgccgcaacccgacagcagcatcgcggtcaacaccgcaacacccgctgcgcgcaccggccgcgacgggcgacggacggcatccacctgccgtccggggcgaagactggtcatttcgcaggctcctgatctgcgtcggtcgatgcggcatcggcgggggcagcctcggctgcggcctcagaagcgatgggggctccgagcacgcgggcgtaagaggcggcacggccgcggagatcctgcggcgcatcggcgtcgtcggccaggcgcgcaaagatctcgcccgcccgctgggtgtcgccggccttgaaggcggcgagtgccaccagttcttcggcgagcggccgccagttctcctcgccgtcgatcaggcccgagacgcgggcgcggatctgatcgggcgtttcggtgcggatggccagcgatgcagccttgagcgtcgcggtcgccttgagagcgggatccaggtcgccacgggcggccacggcctcgaacccggcctgggcaccgtcgcgatccccggcagtgagcctggcttcggcagcgcgcatcagggcgagaccggcatagccgctttcggcatcggcggccagcgcctcgaacgccgacgcggcctgatccggcttgcccgaagcggcaagcgcctcagccgcggcataggcggaggcctgttcgttgcggcggttttcttcccaggcgcgccaggcgacatcggcggccacgcccaccaccaccagcaccgcggcgccgatgatccagggtccgaagcgtttccacagcttcagggccttgtcgcgacgcagatcctcttcgatctcgcggatgaactgttccgacacgccccgggaacctccttcagacgccacacttgtccgggtacacgggcagcgccacgtccgcccggtggacggccgttaccatagtcgttcggcatcttcatggcaaatcccccgaagccgcggggtcagcatcaccccggcaggtctccgggggccggtggcgcctcggggacgagatgcagatcatgcagcgccgcccgtgcccgcaccaccgatgccgccccttcacggatcgcctgggccccctggtcgaactccatccagcgaatgtggcccacccagggggcaagcaccagatccggcgggtcgccggccatgcgactgcgtgcgatccggtcctgcatgatgccgatcgagtgcatcatgacctcgccgatgccgatgccgccgacgcgtgcggcaaccgctgccgcccgacgctcgggatcgacgctgcgtccggtgaggcccatcagccggccgccgatccccagcagacgacgggccccgcgccgatcgacggtccctgccgccgcggccgtctgggcgctgcgggcaaggccatgggcgtggggggcgggatgaccacggctggtggggccgggttcgggatcgaccggccggggcacggcatccgccgcctggggcgaggcgacacctggtgcgggtatcgccgccgcatcgatcctgagccggcgcctgtagcctgcaagatcgccatggagggtcaccgcgatcaccgcctcggcccccagatgccggcagagcgacaccggcaccggattgaccaggccgccatcgaccagcagccgcccacccgcccgcaccggggcgaagatgcccgggatgctcatcgaggcccgcagcgcgtcgaccagatcgccatcggtgagccagacctcctggccgctggcgagatcggtggcgatcgcgccgaacgccaccggaagatcctcgatccgggtctcgccgaaggcctcccgcagcatcgcggtcagccggtcgccgccgaccagaccgccggaccccatcctgaaatcgcccagccggacgaccttgagccgggtgagatcccggacccaggcctcgaattccgcaagccggccggcggcatggaaggcacccaccaccgcgccggcacttgcgcctgcgatgacctgcggcaccaccccttcggcggcaagcgcgttcagcaccccgatatgggcccagccgcgtgccgatcccgatcccagcgccacacccagcaccggcggccgaggcgccgcggccggcccctctccgcgacgcgcagcggcatcgccccgtcgacgccgccggcgatgcggtcgcgccggatccgacgccggaaccggatcgggtgccgggggcgcatcgggggcgcgggccgggtcgccgcttcgcggatgctgcgtcgcggcagatgtttcaatcctggtgtcgcttcgggttggcgcggcgggtctcgtcatgtaatgctcgtccttgatgtcaggaccggtcgcccgggccggctgcgcgagcgaaaggaaatgcccatgcacaggctgttcgtcgctcttcctctcccgaccgcggtacgggaccagctcgccggcctgcgcggcggccttgtcggcgccagatggacggcgcccgccaatctccacctcacattgcgcttcatcggcgaagttgaggggccgtcggttgccgatgccatcgacgcgctcgacatgattgatgtcgtgccgctgaccctgtcgctcaaggggcttggtctgttcggccccagccggcgccccggcacgctttgggccggcgtcgaaggcggcgccccgcttgccgatctgcaacgccgggtcgacgccgcgatcgatggtgcgggcctgccgcgggagcgccgccgcttcacgccccacgttacggttgcaagactgaagcaatcaccggatgatcggctcgaccgctatctggcagcccatgcaggtttcaccaccccggatttcaccgtcgataccatgcatctttacgaaagccgcctcggccatgaggggccggtctataccagtctcggcgccttcggtgccctgcccgccccgacctatggtgagacattcgacgaagacggcctggatgaagaagccgaaccgccggtcctcgcagccgtcgacggcgaggtgctgccgaccttcgacgagcgcggccgcggccgcaccagctggggcggtccgccgtctccgtggcgggatgcggacatctggccgaatgcaggatggcggacacgcaggcggtgacctgtttcggaacggtgaccgtcttaaccacttggataccatcccccggctagtcttcgccgaaggccgcctttcggctggccttcggcaaacctgctcccggatcgagacgagatggcgcaagctgtggcgaacggacccaccggcaccgatggacgcacggccgatacggccacgggcgggggcctcgacgcgcggcgtctgatgcgccagcacctggccgatctggaccggcggctggccgaaaagtcacgacaggggcggatgcagattctggcctggaatgcctatggcacccggctggaactgttgatggtctccaccacccatatgcacgaggccgtcgcccgcgatcccttcctgctggtcggctcgcggaagttcagctatgcgcgcatgcgccgggccctgcagcttctggggctcaggccgatcgcgatcgagctgccgttcacgccgggcacggatctgccggacgcagcggtcgaagccgccgtccggcgctatggctgcaccgaaatccagtaccgcggcatcgccggtttcgaaatccgcggcctgtcgaagctcgatcccatgcaggcggcacaggctgccgccgccctttggggccgtgtggtccgggcccggcagctgctgacgcgatcgggcctggagatcgatctcgccagcctgcagagcggcgacaccctgctgctgtggagccgacagcagggccacaagccggacatcacccttttcgctctgatgatgctggtgctggccgatgccacgctggaccgcatggccgaagcagacgcgaagacagggaccgaaacgtcggacaagacggaaaaggccgcagacacccagcgtgccgagcgcgagccggtcggggaggatggtgagccggaccagctgggcagcgggcttgccgccgccttccatgtcggcagtcagctggaagtctttccgcccgagaacgaccgtcccggcacccagccggtggtcatgggcgaagcggtacgccagctgcgccagatgctggcggtcgcgaccgacgatcagctgctgatcggcgattttcaggcgccgctggtcgaagggccggtgcgtcagggcaagatctaccgcatggtcgatacgccccgcttcatcacccacgcccaaagcctgctcgaccggatcgagggcgaacgcatgggcggggccgcgctcaaccgcctggtgacttacctcaccggtgaccggctgatcgaaggcgtcttcaccatcaagcgctacgagatcgaccggccggacggccggccctgcggcttcttcaatgccaaatgcaccctgcaccggctgaatgccgccccggtctttctgggccttcagaacgagcgcattcgccgtgccccgggccgcaccaccacctatgacagccctcagcctcagccacagatgctgtggcccgacgatccggtgaccgaggcagatacccccgcctgaggtcagtcgggaatcagcaccagagaaccggtgacggtgcgcgcctccagccgcgcatgggcatcgcctgcgcgtgagagcggcaagaccccggcgacggtgggcgacagcagcccctcgaccaaagcggtgaacagcgcagacgtcgcctcgcgcagccgttcgcgatcggcgatataagcgaagactccgggccggtcgagcccgagcgcccgcatcggccccagcacgccgacatcgaccggcgggatcggccctgccacctggccgaagctgacgatccggccgaagggccgcaccagcgccgccagcttcgcgaaatccggcccgcccagcccgtcgaagacgatatgcacacctgccccgccggtcagttcggcggcggcccggccggcatcggccagcgcggtggcccccgtacccaccaccacccgttcggcgccggcttcctgcaccgcttcggccttggcgcgcgtggccacactcgcaatcacccgcgcgcccatagcggccgcccagcgcaccaggatgagcccgaccccgccgccggcgccacgcaccagcacgacgcgcccgtcgagcctgaggccgaggccgtagatcatcatatgcacggcaatgccgggaaagagcgccgcggcccccacctcccaggggatcatgtgcgggaagcgcaccacccgccccaccggcagcacccgatgggttgcataggcgccgagcggcggcccggcatgggcgatgcgatcgccgggtgcgaaacgatcgacgcctggcccgatcgccagcacctcgcccactgaagcaaggccgggtatgtcgaccccgccgccttcgagcggcagggtgccgtcgcggtaatagagatccagatgattgacgccgatcgcccgcgtcgccatcagcacctcgcccggtcccggccgcttcagcggcacggtcgccggcgccagcacatcggggccgcccggatgggtgacatgcatcaccgtcgcccgatcgggcagatgggtggtcgggctgccgggggaaagcggggtcggcggggtcgtcatcggatgcgcaccttcagggacgggcgtctgtcacggaaccgccccatagcacgcccgccgcgcgcccgcgtcaagcccatgtcgcgcgttacgcctgccgggcaagccgccccggcgtcaccccgaaacggcgacggaaggccgtggtgaagttggcgacatcgccatagccggcatggaaagcggcttcggcgatgctgcaccggccggcggcgatatcggcatgggcatggtccagccggcggccgcgcagccagccggcgatggaggtgccataggcggcgcggaacaggcgctgcatggtgctgacgctcacgccgcactccgccgcgatctcggcgagggtcggggcgctgccgtcgcgttctgacgcgatcgacagcatctccagccgctcgcgcagccggcctgcgcgttgcagatcggccggcttgagcccgctttcttccgctgtggcatcttcgccggccacggcagcaagaatgccggccgccgtctcgatggtatgggcctcggcaaccagccgcgccaccggtaccgtcatcggctcgggcgcgatcagggccgccgccagcgccgcaagccgggccgatggccgccacgacaccgcggccagatgccggccgcagaaccgtccggccgccgtcccgggctcgacgcccgcggcttccagccagggccgttccaggcgaagggtcaccttgcggacatgggcgccggtgtggaactggcggcgcagcagctcgggctcggccagggccacggcaaaggccgccggggcatcgggggtggcgacgcagatctggcgacggccgccgaaactcgcctcgaccagcccgtcgagcacgatcaccgcggtgagcgagggcacgatcagccggtcatggacgcggtcatcccgctcgatcccatcggtcgtgtgcaccatcaaccccggccgcggatgggcgacggtcaggccgccgccggccaaagctgctggctccaccccctccccggcgacatggcatcgtctccttcagatacgcgattgcgacttattctcatatatgccggccgctcgtgcaagcccctgcgggggcccttcccccctgacacggccgcacaagatttcgccgcggctgcacaagccatgaccgtggcgcataccggcgcaagatcgtaattgaaactcattcgcaattggggcaaagcaagcccttccgccggagacctgtgacccatgcgccagccctgcccgttcctcgttttgcccctgctcgccaccgtcgccacgggggcattgatggtcagtcaggcccgcgccgaggatgcgcagagcctgccgtcgctggaggtggaggacgagcggagcttcccgtcggatcccggccggaccgagggcagcaccagctatggctccgatcgtgtcgccgtgggcggcaagcaggtgcgcgacattcgcgaagtgccccgttcggtcagcgtcgccacccgcgcgcgaatggacgaccagaacatgacccagcttgaagacgtcgcgcggcgcacgcccggctttctggcactgaccaacgatcccggccggtcgagcatcttcgtgcgtggctacgaaatcgacaacgccctggtcgacggcctgccggcaccgatctccagcatctacggcacccagcccgaccttgcgatcttcgatcgcgtcgagctgctgcgcgggccctcggtgctgttcggcggcacgggcgagcccggcggcatcgtcaatctggtccgcaagcggccgaccgagatcttccaggcccggggcacgctggaggcggggtcgtggaacaattaccgcggggtcgccgacgtctccggcccgctttccgccgacggctcgatccgtggccgggtggtcggcgcctatcaggaccgggagagcttcaccgacgtgaccgaaaaccaggtcggcgtcggctatgccgcgatcgatgccgatctgggtgaggataccctgctctcgctcggcgcctggcggcaggaacgcgaggcgaccccgttcagcggcctgccggtctcgaccaccggccagtcgctgggcctcagccgctcgaccttcgtgggcgccgactggaaccggttcgagaacagctccaatgaagcctcggccagcctcacccatcgcttcggtgacgacagccggctgcagttcggcggccgggtggccgatcgcagtgtcgatctgaaatatgcctatggttccaccgcagtggatccggccatcggcaccaccgacctcatcgccattcagcgccactatgaagagcgcgcctatgcgctggatgccaattatctgaagccgatcgaagccttcgggcagcgtcatgaactgctgatcggggcggactggcggcggtacgtccagtccctggatgccggtaccgcccgcggcctgggcacggtgaacgtctacaacccgtcatccgacatcgccgagccggacatcgccatcagccagcgtacccgcaccgaacccgaacagttcggcatctacgcccaggccaccatccgcccggtcgaagactggaccgtgcttctgggcggccgcctggcctgggccgagacccgggtgaccaaccgcaacaccggatcggtgtcgagcgtcaaagacagtgcagagttcattcccgatgtcggcatcgtctacgacctgacgcccgacatcgcgctctacgccaactattccggcatctttcagcagcagaccggcaccaatgccgccctggaagcactcaacccgcgcaccggagagcagtacgaactgggcgtgaaggcgaagcttggcgacagcggactgctcggcaccttcgacgtcttccggatgcgcgacaaggaccgggcggtcgcggtgagcgggaccacctactatgccgagggcgcagaggtcgaatcccgcggcgtcgaggccgagatcgccggcaccatcctgccgggctgggaagtcgaggccggctatacctatacccgcaccgaatacctcaagaacgccaccaccgcgtccggcggtacttacagcacctatacgccgaagcatgtggtctcggccttcacccgctacaccttccaggacgggccgatggctggcgtgcatctgggcggcggcgtgcgctggctcagctcgttctacaatgtcgccggcaatctcaagatcgaagaagacggctatgtcgtgaccgaccttcaggccggctggggcttcgcgcccggctatgacgtcacgctctcggtcaacaacgtcttcgacgaagtctattacgaccgggtcggcggtgcggggttgttcaactattacggcgcgccacgcaacgtgctgctgtcgctcaaggccagcttctgaacgaatgagaaagctccgaggacgccgtcgcatgccccgttccgaagcccgcgtggtcacccaactcggccagcgctacatgaccctgctctgccggcatttccgacacaaggtgccggcagaggtcaccggcgacaccgcccgtgccgatttcccctggggggcggtcgcccggatggccgcaaccccggaccatctgcaggtgacctgcacggcaggcaaccccgccgaccttgcccgcacccaggacgtgatcgccatccacctcgcccgcttcgccttccgcgacaagcccgagatcatctggcagccgctgcccgactgatcagcgcccgcctccggcgcagcggaaggtgatgttgatccgccgctgcccggtcgccgggtgggatccgtcgcgcagctctttcaccccgtgatgggcaagccgccaggcgccgccccagaccacgacatcgccatggaccaggtcgatattggtgaccggatccctgcgcgacggcccgccgaactggaacaccgccggcaggccgagcgagaccgagacgatcggctgggtgagatcgccctcgtcacgatcctgatgcatgcccagccgtgcgccaggggtgtagagattgatcagacaggcatcgggccggaagccggggaaaccggccgccgttgcggcccgatcggcaaggtccccgaagagcgccggcatctccggccaggggcggccactctcggggtcgatcggatcgtagcgatagccgcgccggtccgacacccagccgagccggccgcaattggtcatggccaccgacatgcggcgcccgcccggcgttatcagatgccggaaaggcgccgcggcggtgacggcctgaaccgcctgcagcaggccggccgcaaccggcagcgcgaaaccatcgagcagatgcgcaccgggcgcgctccgccgcggcagatcgtcgaagagcaggccgttggcgggcatgaggccgttcctctccgtcaggcggcgtcatggaagatgatgccgagcgtccgccgccggccgctccgcacccgtgccaccccgtggcgcatggtgacgcgatagtcgccgcgcgatcccctgaccggccgctgattgaccgcaaagatcacggcatccccttgccccagcggcacgacatcgggccgcgactgcatgcgcgggcgctgctcggtcagcacgaattcgcccccggtaaagtcacggccgggcgccgaaagcagcaccgcgatctgcagcgggaagacatgcgcgccatagagatcctggtgcaggcagttatagtccccggggccgtagtcgagcagcagcggcgtgggccgcctctggccggcggcgtggcagcgggcgatgaagtcgcgatgcgtgtcggggaaccggacatccaggcccatccgctgatgccagccatgagcgatcggcaccagatacggccaggccacctccctgatggccaagaccagttcgggcagcggatgcgcgaagtacttgtagcggccctgcccgaagccatgccgggccatgatcacctccgaccggaaaccctcctcccgctcgtagagccccgcaagcgccgcgcagctccgttcatcgaacaagcctggcagcactgcccggccgcctgcatccagatcgccggcgacggcgctccagtcggtggtgttcagccgggcgatcgggtgttgctgcatgggggcctctcggtcggatcagatgggaaagacggaaccggatcatgcggttccgtcccgtctcccgcacctcgcggccggacagagaagtcagtttccgtcggcgcggaccacccggatgttgttggtcgaccccgcctgcccgaaggggatgccggccaccaccaccaccggatcggcgggcccggccagttcctgctccatcaccgtgcgggtcgccttctccaccatctcctcataggaatggatttcttccgagagcacgctgtgcgcgccccagagcaggcaaagccgccgcgagacaggcaggttcggggtcgtcgccaggatctgcgcggcggggcgacggcgagcgatgcgggctgcggtcgtgccgctggaggtgaaggccaccagcgccggagcaccgagtgccacggcgaggtcggcggcggcagcggccaccgcatgcggcgcgctggtttcctcacgcgggcccgaggcatcgacgatgctgcggtagaatttgtgctgctcggtacggcggatgatccggtccatcatctccaccgcttccaccggatattgaccggcggccgattcggccgagagcatcaccgcatccgccccgtcatagatcgccgtcgcgacgtcggaggcttcggcgcgtgtcggcgtcggggccgcgaccatcgaatcgagcatctgcgtcgccacgatcaccggcttggcggcgaagcggcaggcacgcaccagctctttctgccggccgggcacgtcctcgggcgggatctccacgcccagatcgccccgggcgaccatcaccgcatctgcgagtgcgacgatctcgtcgacatggtccagcgccgagggcttttcgaccttggcgacgagccctgcccgatcgccgatcagcccgcgcgcctccagcagatcacccggccgctgcacgaaagagagcgccacccagtcgacccccagctccagcccgaaggccagatccgcgcggtccttgggggtcagcggcgacatgtcgagcaccgtgccgggcaggttcacgcccttgcggttggagatgacgccgccgatctccacctcggcatcgatatggtcgtcgccgaggccggtaacccgcagccggacccggccgtcatcgatcagcagatgatggccgggcaacaccgccgcaaagatctcgggatgcggcaaggggatcgcctccggtccgccctcgctgccgttcagcacgaagcgcagcgcctgaccgggcgtgacctcgatccggccgtcacggatggtgccgacccggatcttggggccctgaagatcctgcagaatgccgatcggccggtgatgcttgtcttccagcgcccggatggcggcatggacccgggcatggtcgtcatggctgccatggctgaaattcagccggaaggtatccaccccggcgcgaaacagcgcctcgagcatggccgggtccgcactcgcgggtccgacggttgcgacgatcttggcgcgacgcttgcggcgcatgatcacgaacggcccctggggccgcctccctcgtcatgactggggccgccgggggcgaccatgggatcggcaagcatgggctgcgccgatcccggttgcaagtctcccggtgacaagtctcccggtgaggggccgtcgcgcgcgcccgtcttcacccgccgtgccgccagacggtgatgaaaggccggcgccgggcgcccggccgtttcggccatgccccgcacccgggcctccgccccggcgatcagctccgggatcagggcggcttcgggcaggttcgcccagtacttcaccggcatttccgcgcgcatcgccctgggtttcaaccgagccggattgaagatgccggcgtaataggtcagccacaacgcctcggtttcgtcggccagatccgggcgcgtggcgggttcggtcgagaccgtcaacgtggtgccgtcgaaagcggcactgccgcgcggtgtcaggatcatccagtccatatcggcgaagcggccccggaagaagggggcggtgcgggcaacgacgtagtgatcgggctcgaaccaggcgacgaaacgccgccggccggtcgggcccggcggccccgcctcgcggaagcgcacgaaagcggtcatcttatgggcatcgcgccgcaccgccttctccagccgcgtcgctgcgacgacatccggatcggtgcgctgcccaagcagctgccggtcctggaccagacgccagagcagacggtagagcagtccgaaccggaccggatcggcatggcagatcaccgaccgggcaaggtcgagaaaagccgccggcacgcccggtgcctcggcgccgggggccggatcgggaaggggcggcggcggatcgaacaattgccccccgtccgccggttcccaggccaccctttcgggcggcaccccggccatcagcagggcgcgcgccgcccgccgccattcctcgaaatctccccgtccggtcaacgcggcccgcatgcggctcctcccggttcagaacagtgccagctgtgccggcggcgccaccagcgcccgcagatcctcgcgatcgatcagcctgagcggcgtccagccccgggcggtgatgaagggcttcaccttgggcagcgacacgcgcagccgccccagatcatcaagccccagccgacgataccgccttgccgacaggatcgccgtgacggtcttcaccccgaaccccggcaccctgagcagcatctcccgcggcgccccgttaacatcgacggggaagagctggcggttcaccaacgcccaggcgagtttgggatcgatttccagatcgagcatgccgtccggccggccggcggtgatctcacccggcgcgaagccatagaagcggaacagccagtccgcctgatagagccgatgctcgcgttccagcggcgggcgaaccggcggcagccggcgcgaagcttctggaatagggctgaaggccgagtagtagacccgccgcagcccataggcctcatagagcccgccggccgtggccaggatcccggcgtcgctggtctcgcaggcgccgacgatcatctgggtcgactgtccggccggcgcgaagcggtgccgcttccgggtgcgcagggttggctcggcgctctcttcgatccgtgcgcggatgccgcccatggctctccggatctcctgcggccgcttctcgggggcaagctcggcgagagcccgttcggtcggcagttcgacattgatcgacagccggtcggcgaacagcccggcctccgcgatcagctccggcgcggcatcggggatggtcttcagatggatatagccacgaaagccgtgggtgagcctcagctcgcgcgccacccgcaccagttcggccatcgtgtgatcgggggagcggatgatgcccgacgacaggaacagcccttcgatgtagttgcgtcgatagaattcgagcgtcagccagaccacctcttccggcgtgaaccgcgcccgggcgacattgctggaggaccggttgatgcaataggcgcagtcgtagatgcagaaattggtcagcaggatcttgagcagagagatgcagcgcccgtccggcgcataggcgtggcagatgcccatgccggtggtggagccgagcccgccggtcgccgccgaatcgcgccggccaccgccactcgatgcgcaggaggcatcgtatttggcggcgtcggacaggatggccagacggtctttcagcgacatcttcatggatgttcactatatgttctgaaggcggccggtcaaggccccgcctctgcctctccgctgcgccgcaccacctgctgccgccaggcctcgggcgtctgcggcttcacatagagggccacaacctgcggatggtctgcggtgagcgccgcttccagacgttcgatacaggcctcaatggcggtggtggtggtcgtgtcttcgaattctgcgctcagcgccaccaccacctgttccggcgccagatggacggtgaccacgccgttcaccgcccggatcaccggatcggcatgcgcgcgttcgatgatggcagcctgcaatgccggcgccgcccgctcgccgatcagcagccccatgctctcgcgcgccaggaagacggcggttgccgccagaaccagaccaatgccgatggaggcggcgccatccagctccggcatgtcgagcagatcggcggcgagaatgcccgcggctgcgatgacgatgccgagcagggcggcgctgtcttccaggagcacggtgaagaccgtcggatccttgctgcgccggatggcggtcagccaaccgagatcgcccttccgcgcccggaactccagcagcgcgacccgccaggaccagccttcgaacaggaaggccagccccagcaccacatagctgacggtcaggttgtcggccggctccggcgccagcacatggcggatgccttcgtaaagcgacacccccgcccccagggcgaagaccagcaaggcgaccacgaagctccagaaatagagctcgcggccatagcccagcgggtggatctcgtccggcggccgggatgaacggctaaggccgaggaggaggagcagttcgttgcaggtatcgaccagcgaatgcaccccctcgctcagcatggccgagctgccggtgtaaactgcggcggcgaatttcgtcaccgcgatcgccagattgccggcgagtgccgcatagatcgttcgtttcgtgccggcgctcgccgtcattggcaatcctctcagccctggggcagcgcataggcgatcagttcatcgccgatcggcgtttccatgaagtgatgcccgccggccatgatcaccagatactggcggccatcgatctcgtaggtcatcggcgtcgcctggccgccggccggcagcacgtcggaccagaccgtctcgccggtctcgatgtcgatggcccggatcaggttgtcggtggcggcggcgatgaagaccaggccgcccgcggtcaccaccgctccgccgttattgggcgtgccgatatcgaccggcaacatcgaggggatgccgaaggggccgttggtgcgggcctcgccgaagggccggtcccacagggtctcgccggtttccatgtcgatcgcccggatgccgccatagggcggctccttgcagagcagcagggtgaccggcagacgccagccggcattgacgttgatggcatagggcgtgccggcctgcgggtcgccggccccttcctggccgccgaattccccgcgttcctcgcttcgcggcgcccagcccagccgctcggcttcctcgcgcggaaccaggcggttgtggttcggcatgtcgttgtaattggctatgatcacgccgcggctgggatcgacggcgatgccgccccaatcggagccgccgttatagcccggatactccacccaatgagtgtcggtggtcggcggggtgtagaagcccttatagctcgcctgtcgatactgaatgcggcagatcatctgatcgatcggcgacatcccccacatcttcgcctcggtcagatcctcgcggcgcagcgtatggtagagcgagaagggctgggtggccgaccgctcgtcgggctcgacaccaccctgcggcaccggcctttcctcgacaccggtgatcggccggccggtccggcggtcgagcacatacatgtcgccctgcttgctgggcaggatcagcgccggcaccgccccctctccggtcgggaaatcaaccagggtcgcctgtgagcccaggtcgtaatcccagacatccttgtgcacggtctggaacgaccagacgggccggcccgtgttcacgtcgatcgcgaccagagaagtggcatagcggttctccgcctcagaccggtcactgctccaataatcgaccgccgaattgcccatcggcagatagaccagacccagctcttcgtcgccggatgccgtggtccacatattgggggtgccgcgggtataggtttcgccctcgggcggcaggccggtgatatcagggcggaccatgtcccaggcccagcgcagctcgccggtgacggcgtcataggcctggatcacgcccgaaggggcgctgcgcttctgaccatccagcacctgatggccggtcacgatcaccccctgcacgatcaccggcggcgaggtgatcgacaccatgcccggcaccaccgggcccatgccctgcttgatgtcgacggcgccgttctcgccaaagccggtacagggcgcgccggtgcgggcgtccacggccagaattcggccgtcgagcgtgccctcgatgatccgggtcgcacagatttccgcagccggcacgtccggtgcttcgaaatagctcaccccgcggcaggccgccgtataggggatgaaacgatcctcgacacccgggtcgtggcgccagcgctcctcgccgctttcggcgtcgagcgcgatcaggatgttcttggcggaacagagatagagcgtgtcgccaatcttgagcggggtggtctcggcaccataggacccctcggccgcctcgctcggcagatcgcgggtgtggtagacccaggcccgttccagcccgtcgacattggcaggtgtgatctggtccagcggcgaccagcgacgggcggcataggtgccgccataggccggccagtcggccccggtatcccgcagagagggatcggtcatttccatccggcccgggggcggcagattggccagctgacgttccggcgcattctggacgacgacgacaccgaccagaaccgccgcgacgatcagcaccaccacaccggccaccgccccgcttgcatgcagacggaccggacgcagcatcggcgtcagggccacggcgatcagcagcagcaccagcggcccgaccagccgcggcaccagcgcccatccgtccatcccgacttcccagaaggcccagagcagtgtggcgacgaagaccgccgcatagacccagaagccggaccagcgtcgcatggccataagcccgccggaaatgatcagtccaagccccgccggcaggtagtaggccgagccgccgagcgccagcagccagccgccgccgatagcgagcaccaggccgatcagcaccaggacggcggccagaatccacagcgcccagggacgacgcctccgttcggggacgggaacggtttcgtcggacatgtctctgctctcccgtgatgcttggtacgcgcaccctgcgtacgcatttcggcaacgccgggatgacgccggacgttcccgaaaagcttgactatcttatgctcactctgactatatttgatcgcccggccgtgccgggatttttcaccccctggaaatgctcaacttgagcattaatgccttccccggggatgcttcgggagatcgagccgatgaccgcctttcagcccgccgtgccgatgccggccccgctccgccatctgatgcccgagatcgaatgggccgtgcatgccgaagaggtggcgcagatccgcaggctcaagcgcgagcgtgatgccgtgattctggcccacaactatcaaacgcccgagatctttcacggcgtcgccgatatcgtcggcgacagcctggccctggcgcgtgaggcggtggcgaccgatgccgcggtcatcgtgctcgccggggttcacttcatggccgagaccgccaagatccttaatccggaccgccgggtgctgattcccgacgacatggccggctgctctctggccgactcgatcaccgccgccgatgtggcggcactcagggcccggcacccgggcgtgccggtggtgacctatgtgaacacctccgccgaggtgaaggcggcctccgatatctgctgcacttcgggcaacgcgctgaaagtggtcgaaagcctgggcgtgtccgaggtgatcatgatccccgacggctatctggcgcgaaacatcgcggcgcggacccgggtcaggatcatcacctgggatggcgcctgcgaggttcatgagcgcttcacccctgaggacatccgccggatgcgcgcggaacatgccggcgtcaccgtggtcgcccatcccgaatgcccgcccgaggtggtcgctgaagcggatttcgccggctcgaccgccgagatgatcgacttcgttgaccgccggcgcccgccgcgcgtcgccctgatcaccgaatgctcgatgagcgacaatgtcgccgccggcttccccgacatctcattcgtgaagccgtgcaacatgtgcccgcatatgaagcgcatcacccttcccggcatccggcgcgcgctggaaaccatgagccacgaggtcacggtgcccgccgatatcgcccgggatgcgcgccgggcggtggaacgcatgctcagcatccggtgacggccatgttcacgcctctcgacccaccgatcgaaacactgacgaccggggtggtcgtggtcggcgccggtgccgccggtctcgccacggcgctcaatctcgccccctgccaggtggtggttctggcgcatgggcctgcagccaccggctgggcccagggcggcatagccgccgccaccggaccggacgacagcccggcctttcatgccgccgataccgcggccgccggcgcaggtctggtcgatcccctggtcgccgccctggtgacggcggccggacccggctgcatcgactggctgcaaagcgcgggtgtgaccttcgaccgcggtaccgatggccgtccggcccgcggtctcgaagccgcccacggccgcgcgcggattcttcacgccgggggcgatgcgaccgggcgggcgatccttgccgccctcaccgcccgggcggccgccgcaccccacatccgccggctcgacaatgccgaggcaacagccctgctgaccgatgcccggggccggatcgccggcatcatcgtcgacctgaccggccgccggctgatgatccgtaccccggccgtcgtgctcgccaccggcggcatcggcgggctctacgcccacagcaccaatccgcccggcgccactggccgcggcctcgccctcgccgcacggatcggcgcccggcttcgcgacctcgaattcgtgcagttccacccgaccgccatggatctcggcggcgatccgatgccactcgcctcggaagcgatccgcggcgccggggcggtgctgatcgacggcgccggacgaccggtcatggccggcatctccggtggcgacctcgccccccgcgatgtcgtcgcccggcaggtcgccgccaccatcgacgcgggcgatcgggtattcctggatgcccgcgccgcgatcggccccggctttgccgagcgtttcccgaccgccgccgcggcctgcaggacggcagggatcgatcccgcatcgcagccgatcccggttgcgccggctgcacactaccatatgggcggtatcgccgtggatctcgccggccgcaccggcattcccggcctctgggccgcgggcgaagtggccgcgacagggctgcacggcgccaaccgtctggcgtcgaactcgttgctcgaagccctggtctgcggtggctgggtggctcgcgacattctttccacctcccccgatgcccgcgctccggtcatccggcaggccctccgcaccgggcgggccggaaccggcgagggcgcggtcgcgatcgggcgcctgcgtgccgcaatgtcccgtcaagccggcgtgctgcgcgacgccgcaggcctcgaccaactgatcggtcttgcagccgccatcgaggccgacccgcagctgccggcggcgattgccgatcgcgccctggtctgccgtctgatcgcggaagccgcccgtgaccgccccgacagcatcggtgcccatcagcgcgccgacaccacccccctcgccctccgggagcgcagccatgtccctgcctgatctctctcatcttccggacatcctggtggagccgatcctgcgcgcggctctgatcgaggatctgggccgtgccggcgacatcacctcggccgccgtgatccccgcgggggcccgcatggcggcggtgatggccgcacgtcagccgggggtgatggcgggtggcaccgtcgccgccctcgccttccgtctgctcgatcccggggtggagacgcggatcatcatccccgacggcgccgcagtggtccccggcgacgtggtcatgacgatcgaggggcctgcccgctcggtgctgggggcggagcgggtggcgcttaacctcgcctgccggctggccggcatcgccaccgccaccgccggtctggtcgccgccgcagccccccatcaggcccggatcacctgcacccgcaagacgacgcccggcctccgcttgctcgagaaatatgccgtgcgtgccggcggcggtgccaatcatcgcttcggcctggatgacgcggtgctgatcaaggacaaccatatcgcggtcgcaggcggtgccggcatcgccatccgtcgcgcccgcgcccatgtcggccatctggtgaagatcgaggtcgaaatcgaccgcctggatcagctggacgaggttctggaagcgggtgccgatgcgatcctgctcgacaacatgacaccggcagagcttgccgaggccgtggcccgcatcggcgggcgtgcgatcaccgaagcctcgggccggatcacccgcgagacggtcggcgccgtcgcagccagtggcgtcgatctgatctcggccggctggctcacccatagcgcgccgatcctggatctcggcctcgacatgccatgaaggtatagcacgcctgatacgcgcatctgatccaccgctttaaaccttctttcaggattggagggtgatagtctggatcgcttcatactctgcgggacgggcgacacgtgactgaagacggcgaggccggcggctcttccagccgcatcgcgacattgctgctgaatgcgacgggtagtgacctggcgatgttcctggatctgatcgccgcgccggccttcgtggtcgatcctgccggggacggcttcatcttccgcgcgaacaacgcggcacatgcaactgccacgggcctgagcttccgcgagaaggcggggctgcggatggacgagttcctgcccgacgacgtcgctgtccaggtctgccgcaaatatgcgacctgcgtgaccgaacgggtgccgctgacctatgaggagtgccttgaactgccggcgggccgtcggtggtggcgcaccaccctgatcccactcagcggcccggacggcatggtccggcgggtcatcggcaccggcaacgacatcacggtggtccatcagctgagcgaacgcgcccatgccctggtcgtggaacaggaagcgctgcgccggcgcctgacccggacgctgaagaccgccgtcgacgcgctcgccacggccgtggagacgcgggatccctataccgccggccatcagcgccaggtcgcggagctgtcggaagcgatcgccgccgccttcgatctggacgacgaaacccgcgagatgatccggctcggtgccgtgctccatgatgtcggcaagctggggggtgcccaccgaactgctcgtcaagcccgggcggttgcggcaggaggaatacgccctgatccgcgcccactgcccgcatcggcatcgagatgatggacgggatcgatctgcctgaaatcgtccggagcatcgtaaccgatcaccatgaaaggctggacggcagcggctatccgcgcgggctgaccgaccgacagatcgccctgccggtgaggatcgtcatggtggcggatgtcatcgacgccatgctgaccgaccgtccctatcgacgccatctggaccttgcggcggtgaccgaggaactctcccgccatggcggcaaggcctatgatcaggaagtggcggccgtcgccctgtctctgatccgcggcgacctgcctggcttcacacttccggaaagctggcacctgcatcgggcgccccgggctctctgaggtgagcagagaggcggttcagtcttgcagattgcggcggaacactgtcccatcatgggccggcatcccgccggcccggtatcgggtagtgcatggtccgcagaaggccactccctgaaccggctgatggcttcagggaaggagatgccgctcatgtcccgcaatccgctggacggcttcaccgtcgatcgcgaccggatcggcacgatcggccgcgatctgcagcgtccggaatgcatcctggccgaacgtgacggcacgctctgggcggccgatgcccgcgggggcgtcacccgcatcgccgccgacggccgtcagcatttcatcgcccaacgcgccgatgcccgcttcgccaccgccgatcaggccacggccggcgcgctcgaggccaaattcacccagggtaccctgcccaacgggctcgccttcgcccgcaatggcgacatcctgatctcgaatttcggcaccgatcttctcgaagtcatgacccgcgacggcgaggtccgcacgctttacgacacgatcgacggccagccgatcggcaaggtgaatttcgttctgcgcgacagtcgcgaccggatctggctgacggtctccacccgggtcaatccctggaccgaggcggccgcccggcgcgtccgcgacggctatatcgcggtggtcgaccagaacgggctgcgggtggtggcagaggggttcgccttcaccaacgagatccgcttcgacgcaaacgaagactggctctacatcgtcgagaccaccggtccgcacatcacccggatgcggatggtcgaggatccggccggggtgcggctgaccgatcgcgagatcttcggccccacccatctgggcggctgccccgacggcatcgcctttgatgccttcggcaatctgtggtgcacgctgatcatggtcgaccgtctggtcgcgatcacgccagagggtgagctgcgggtgttgctggacgacggcgatcccgagatctcccgcgcctatatggccaaattcgatgcgggcacgatcaccatcgacgacatgatgcaggcccaagggaccattgccccctggatggcgagcgtcaccttcgggggccccgacctgcagaccgtctatctgggcagcctgcgcggcaccaccattcccttcttccgcgcgcccgtagccgggctgccgatgatccactggaacgagccgcgctgacggcagcccgtcagccggcccggaagaaggcgatggtcatcgcgacaccgatggtgatgatcaccgccttcagccagggccgcgggatgcggcggcccagccgcgcaccggccatcccgcctgcaaccgccgccaccgccatcaccagagccggctgccaggcgacgacgccggccgcggcataggccgccaccgcaatcgtcgtcagcaccaccgacatcaggttcttgagcgcattggcggcgttgagatcggcaatgcccatgacggtgaacagcgccagcagcagaatacccaccccgccgttgaaatagccgccatagaccgagaccagaaacagcccggccaccatctgtgccgggccgccggcccccatgcgggtgagtgcgcgggcgatgcggtcgccggcggcaaacagcagggtggctgccgccagaagccagggcaccagcccgcggaacacatcgtccggcgtcaccaccagcagcccggcccccagcaggccgcccgccagtgcggcgatcagcagtggccagggccggcggccgtgaaaggccgggcccatctcggcgcgatagccccagcagctgccgacataaccgggcagcaaggccaccgtgcccgtggcattggccatgaccggtggaacgccggcctggatcagggccggcagggtcagaaagctgccgccgccggccagcgcgttcagcacgccggcgacaaaggctgcgccgatcagcagcgccagcccgggcagatcatggacgacaaacatcaggcgggggtccgagacttcaggtcatcatatgtttaacgcaaaacggacggccgcatccggaaaggatgcggccgtccggttgcgttcggcgaatcagtccctgcgcatcgcctggacgcgcgccagcgccttggacagagcctcacgatcggcaaccgcctgggcacgccgctcgcgattctcctccaccacctcttccggcgccttggcgacgaaggccgggttgtcgagccgcttatcgatgccggcgatgtcgcggtcgagcttggtgatctcgccttccagacgcttgatctccacggcggcgtcgatgacgtcggcgatcggcagcagcaccacctcgccgttcacgatcgtctcgaccgtgcccgccacttcgccgtcgacgaactcgatccgctcggcccgggccagacgggccagcgcatcgccatgggtcgccgcacggctgcgggtcgcctcggacgcgtcacggaacagcaccggcaccttggcggccggcggcacgttcaactccgagcgcacgctgcgcacggcagagaccgcctcgatcagccagccgatctcggcatcggccgccggatcggcgagcgtcgcgggatcgagcaccggccaggcaccggtaatcgcctgcgcaggcgcgcggctgccgggacgggtttcccagagctgctcggtcatgaacggcatcatgggatggagcagcagcaggatctgatccagcacccaggcgagcgtcgcccgggtttcggccagagccgcggtctcgccgccctgcaggatcggcttcgccagctccagataccagtcgcagacgatatcccaggtgaagcgataggcggcctgggccgcctcgttgaagcggaaggcttccatcgcctcggtgacggcccgggtcgcccgggccgcctcgcccacgatccagcggttcagcacatggctgaccgatgtcgggtcgaagccctcgacgctctccgcgccgttcatctcggcgaagcgtgccgcattccagagcttggtcgagaagttgcgataacccgcaacccgcgcttcggccagcttgacgtcgcggccctgggccgccagcgccagcagggtgaaacgcaccgcatccgcgccgtatttgtcgatcaggtcgatgggatcgatgacgttccccttcgacttcgacatcttctggcccttttcgtcgcggaccagggcgtggatgtagacggtgcggaacggcacgtcgcccatgaagtgcaggcccatcatcatcatccgggcgacccagaagaagatgatgtcgaagccggtgaccagcacgtcgcccggatagtaacgggcaagttccgcggtctgttcgggccagccgagggtgccgaaaggccagagcgccgagctgaaccaggtgtcgagcacatcgctgtcctgggtgaggtcgacggtttcgccgtaatgggccgccgcggcggccttggcctcggtctcggtttcctcgacgaacaccgtaccgtccggcccgtaccaggccggcacgcgatggccccaccagatctggcgcgacacgcaccagggctggatgttgcgcatccattcgaaataggtgttttcccactgcttcggcacgaagacggtcttgccggtctccaccgcctcgaccgccgggatggcgagcttgggcgcatcgacataccactgatcggtcaaccagggttcgatgaccacgcccgaacggtcgccatagggaacggtatgggtgaccggttcgatcccctccagcagccccgccgcctccagatcggcgacgatccgctcgcgggccttgaaccggtcgagaccgcgataggcggccgggatcaccggctcgtcgacgatgcgggcatcggcgtcgagcacgttgatcatgtccagaccgtgccggcggccgacctcgaagtcgttgaagtcgtgcgccggcgtgatcttgaccgcgcccgaccccttctcggggtcggaataggcatccgccacgatcgggatccgccggccggtcagcggcagcaggatttccttgccgaccaggtcggcatagcgctcgtcatcgggatgcaccgcaacggcggtatcacccagcatggtctcgggacgcgtcgtcgccaccacgatatggcggcccgagccgtcggccagcggatagcgcaggtgccagtaatggcccttcacttccttcggctcgacctccagatccgagatcgcggtcttgagcttcgggtcccagttgaccaaccgcttgtcgcggtagatcagcccctgcttgtacagggtgacgaacaccttgcgcaccgcagcggagaaggccggatccatggtgaagcgttcccgcggccagtcggccgaagcccccagcctggtcagctgatcgaggatgcggccgcccgactgttccttccaggtccagatccggtcgatcagcccgtcgcggccgacgtcgttgcgggtgatgccctgctcggccagctggcgctccacgaccatctgggtcgcgatgccggcatggtcggtaccgggctgccacagcgtgtcgcgcccggtcatgcgccgatagcggatcagcgcatcctggatggtaaaggtcagcgcgtggccgatatgcaggctgccggtgacgttcggcggcggcatcatgatcgtgtacgggtccgcccccgagcgcacatccgcgcggaaggctccgctcttgcgccagccttcgtaaatcggcgcctcggcctcctgaggcctgaaggtcttgtccagcatgccgttccgttccgctgtcttctggggcggtcggtcgggcccgaacaggctcaccggccgccgatctgtgcagggccgggcgcggcgtcggccggatgatccggcctttcgtccccgtccggcgtgatcagggcgtgcccgcgggcacgcccgccggacagcctgcggttcacgaacgcagcgagcgttccgcgagccgctggatttcctcacgtaccagacgttccaccatcggcggcaggttctggtccagccagtccttgagcagggggcgcaggatgtcggcaaccagctcttccagcgtccggccgccaaaggccgcctggggccgcccctcggtcggcccgccgccggtcagggcctggccgagcgtcgcgaaggccgcgaccgtcgccgcacttgccgcctgcgacatcagcccgtcgccatcggctgtggcaggccgcggggccggtgccggctccgggcggggcggcggcgcaggttcgggttccggctcggggtccggctccggttccgaggcgaagtcgtcatcctcgtcgtcctgaagcgcatcccagggatcggccgcaggtgcctcgggcctggcgggctcgtcgtcgaacagatcgtcgtcggcagacgccgcaaagcttgggccggggccgaaatcgtcatcgtcgaaatcgttgccgccgcgcggatcgggttcgggctccggcgccggatcgtcgaagggatcgggctcgaccacatcgatcaggtcgagcacatcctcacgatcgtcccgcggcggctgcgtaccaccggccgcagccggtgccgcggcaccaccctcttcaccgtcctcttcggcgatgatgcgccggatggaggcgagaatttcctccatcgacggttcctggttttgagtcctgtcggtcatcggccccttggggctcctcgcgcgtgtccggttgccgccactctaaggcagtcggccgatgaatgccagcaacgacgaaccggccccgctgcgggcggggccggtcggtccggcatccggggtgggtcggagagggcgcccctccggtcagtcacccgtcccccaccaggcatcacgtaccttgcggtagttgtcctgggggtcgtaggtgggtacgtcggcggaaatcgcctggatgtcgagcgcgcccaacgccgccgccagttcgaaaccggcgacgatgacattgcgctgcgcccgaaccagattgacccgggcgataaagagttcctgctcggcatcgagcacgtcgagcgtggtgcgggcgccgacggcagcctcttcccgcacgccttccagtgcgatctctgccgcacgcacggcggcgtccagcgaggcgatcgaggcctgggcggaccgcagctgctcccaggcggcggtggcaccctccacggcctgacgctcggcggtcatcagctcgccgcgccgctgggcccgggtttccttggcctgacggatgccggcgaactcgccgccgccctgatagagcggcacggtgacctgggcgacgatccggctgtcttccgtccggtcgagcgcataagagctgtcgcgctcgcgctgatggctgccgaccaccgagacctgaggcatgcgggtcgcttcggccgaattcacctgctgctcggcgacatcgacggtgtagcgggcggcccgcaccgaggggttgtcgtcacgggcgcggccgatggcgtcggcgcgagtgacgggcagatccggaaagggacgcggcggctccagcgtctcgggcgtgcggccgacgacgcgaagataggtcgcctcggaactcgccaatgcgccctgggctgcggtcagatcggcccgggcactggccagccgggcttcagcctgggcgacgtcggtccgggtcacctcgcccacctcgaaccggtcgcgcgtcgcctgcagctgacgctccagcacgcggacattgttctcgttgagattgaccacggcacggtcacggaacacgtcgccataggtcgacgccgcctcgcgcaggacgtcctgctcgatcgcccgcacctgctcgcgggtggcgagcacctgagcctcggcctggcccagctgtgcatccacccgtccaccggtccagaccggctgggtgatctgcagggtgaccgagcgcggatcggtgccgtatgtcttgctgttctggacggaggttccggcacgaccggcactcgcctggatctgcgcctgcggcctgcgtcccgccagagccgtggggatgttctcgtcgacggcgcgcagctgggcacggatcgcatcgatgcgcggattgccggcataggccgagaccagcgcatcctgaagcgattcagccgaagcgacgaagggcgtcgccagcatggtgccggcggcgagcaccgccgcgagtaccgatcgtctcaccgtcccgtctccccatccgtggatgtcgaccgggcctccccgcccggcagtcgcgcattccgggtcccgtcacccgggatgcgcgatggtcccgtcgtcagaaaacgaagccgaccttcttgcggaaggcggcgatgtgcggcgtcgaggcatcgaacagggtccggcgggcgatcgccccggcataattggtgaagatcgtcgcgcggccgacgcggccgtcgtcgttcatcaccgcgaccaggcggccaccatcggccagctgatccagcagggccttgggctccacctccagggcgccttcgacgacgatcacgtcgtaaggcgcctgggcggcatagccgtcgaccaccgggcccgacaccacggcagcattgctgacccccagctgatcgagcagttcactcgcctgttcggcaagttcgggctgatcctccagcgccaccaccgccgaggcgaggcgggcgagaaccgcggtcgaatagccggtggcgcaggcgacgtcgagcaccgcctcgttcgacttcacgtcggcggcctgaagcagccgcgcgaagagcatcggctccatgaggaaacggccatggccgaccgccacatcctcatcgacataggccacggcccgatggctcgcggggacgaagcgctcgcgcggaaccgcgcccatggcttcgatcacacgttcgtcggtgaccttgttggtgaggagctggctcagcaccatgttgcggcgggcatcgctgtagtcgtgcatgctatgggctctcggctgcttccggtcggtcagacgacgacgcggcatcgggtgacgcatcgccgcaacttataccgggggccgcaggggatgacaatcacgccgtccaccgcagatgcagacgggccgtgacgggggccgcccaagccgatagactgggcgtcgcgacggatcatcggtgtggctgcgattgcggggttgaccgcacctgccgacctctctataaacgcgatccgtcacgggacggtcatcgacgcaagtcggcgacacggcttgaagacatcgctgcctgaatgatcatggatcgacagatcacggatcggaacggcggccagcagtgaagacccggtggccgggtagcaaagtggtaatgcaggggactgcaaatccccgatcggcggttcgatcccgcccccggcctccagctcttccatcctgccccggcaggatgccggcataccggagacttccgagcaggctttggaagcgaccgaaaataaagctggacaggccggcagagcgatgataaaagcccggcccacagacgacacggacgggacgccccaccgaaggccccggacgcactgatccccgatagctcagtcggtagagcaggtggctgttaaccaccgggtcgctggttcgagtccggctcggggagccaattgaaaacgccctgcaggttcgcctgcagggctttttcttgtctccggcacaccgctcagcctcttgcgttgacgaggccatgcccgggtcaccggacggatcaccccacggcacacgcgaagatcttcgctccttcggaacctgatgcgggaagcgcgcaaatggcggttttctgcgggctttgccagggtgcaagccagttcacaaagcggtaccgacgcggtagtctggcccccgccggcaacccgtacaacgaccggcgagccgcttgggggagcagtatcgtgcggcatgggttgcgacggacattccaggacacggccgttcaggcgcggccggccgacgcggctccggaagacggagcggcgccactgcatatcccaagggaggatccatgcgcggccagatgatggacacgcagcttctgatcgcaccgctgatcaggaacgccgccaggtttcacggcgacgtggagatcgtgtcacggacctgcgaaggccccatccaccgctacacctatgcggatgcctataagcgtgtgcagcagcttgccaatgcgctcgcctcgcgcttcggcatcgccatgggcgaccgcgtcggcaccctggcctggaacggctatcgccatttcgaggcctattttgcggtctcgggcatgggagcgatcctgcacacgatcaacccgcgcctgttcctcgagcagatcgagtacatcgtcaaccatgccgaggaccgggtcatcctggtcgacctgaccttcgtcccgatcatcgagaaactgatcggcaagatcccgacggtcgaggccgtggtcatcatgaccgaccgggccaacatgcccgagacctcgatccccaacgcgatctgctacgaagagctgattgcggatcagtccgacagctacgacttccccagcttcgatgaaaacaccgcctcgtcgctgtgctacacctcgggcaccacgggcaaccccaagggtgtgctctattcgcatcgctcgaacgttctgcactcttatggcgtgtgcatgaccgacacgctcggcatctcggcaaccgatgccgtgctgccggtggtgccgatgttccatgtcaatgcctggggcctgccctatgcctgcccgatggtcggtgcgaagctgatcttccccgggccgcggctggacggtcccggcctggccgaactgatcgagatggagcgcccgacggtgctggccggcgtgccgaccgtgtggctcgccctgctcaaccatctggacgagatcggccggcgcatggaaggcgtgcgcatcgccgtggtcggcgggtctgccgcccctgaatcgatgatccgcaagttccaggagaagcacggtaccttcctgctgcacgcttggggcatgaccgaactcagcccgatcggcaccgcctgcaccttcaaggccaagcacctgtcgctggaccaggaggccaagtacaagctgcagaccaagatcggcaagccggcctatggcgtcgaaatgcggatcaccgacgacgagggcaacgagctgcccaatgacggtgtcgccttcggccatctgaaggtccgcggtccctgggtgctgaagtcctatttccgtcgcgatgacgagaacatcctcgacgaggacggctggttcgacaccggcgacatcgcgacggtcgatcaggacggctacgcccagatcgtcgaccgcgccaaggacgtcatcaaatcgggcggtgagtggatcagctccatcgacctcgaaaacgcggcggtcggccatcccgacgtcaaggaagcggcggtcatcggcgttgcccatccgaagtggcaggaacgtccgctgctgctggtgatccggcgcgaaggtgcgacgctcgacaagcagggcatgctcgactacctcgagaccaaggtcgtgaagtggtggctgcccgacgatgtgattttcgtcgaggagctgccccataccgccaccggcaagctgctgaagctgaagctgcgcgaagcctatggcgactggctgatgaagcaggccggctgatccggcagcctttggcgcatacatgaaaagggcggaatccagacgggtttcgcccttttcatttgaatccaccgctcatcaggcgcggtcacgaaaaaggggatgcagccacaaggtctgcatcccctcgcctgcttccggggggatctgcctgacacaaccagtgtcggcagacggaagcataggatcaccggccgcgagcgtcggacgagccccgcagccagccgtatcttcagagaatggacgacagcttcatagcaaccgtcatgtcgccctcgaccttcagcttgccggtcatgaaggccatggttgccgacagatcgccggtcatcagccggtccagggtttcagacgaacagcggatggtgcagtcagcgtcacgatccgcggccgagacctcggccggggccgaccggccgtcgatgaagatcgtgccgtcctccagctcgaacttcacggtcgacccgagtgcgctgcccttggcagccttctcctgcatgcgccggaccagatcgtcgatgcccatgcttcacctccccatacaggccggcttggaccggtccctgattgacgttaacgtaaacgttaggcttaacgacgtcaagagcgcctcgctgccagaatgcctgtccggccgccgcggttccagacgtatgacaatcatcttcggatcacgacacgccacataattcaaccatgagaccccaagagaaaatacgtcgttgcaagtaccgcggcatatcagctcggtgtaaaatgaggtcctcgacaggcggcacgaccggcgacggggagcggcacgccatggacgccatccagggacgacccgtcacatgttcatgcagcattggagcccgctgctcctgcccttgacgcagaatctgggggtgatcgcgcttgccgccctcgctttcggcgctttcgggcaaagccgcctgcaactgagccggctgacgcgcggcatcgtggtcggcctgatctttgccggctctgcgctgatctcgatggcaatccctgtagagatcgcccccaatatcgctttcgacggcagggccgtgctggttctgctgtccgcgccgttcggcggcccggtggcaacgctggtggttggggccacgacggtcacctcacggctgctgcagggcgggccgatcgcgatccccacggccctgtcgctggtggtggtcagcctgatgtcgatgggctggtgggccttgcggcgcaagaccggcatccggatgattgatctgttcgttgccggtgccgtggtgggcgtgccggcgatggtattgatcgcagccatgcatggcctgatccacgacggtctcctgctgagacagttcggtccccttctcgtcctcagcgggatcgtggctaccgtggttctgggcgggcttttgacggttgaacgccggcgcctgaccgccgaacgcgccctgacgtcggaacgacggcgctttcaggccatcgccgacaacgtgccgggcgcaatcctgcagatccgcctggatccggatggtgacattgcggtcctttacgcgggcgccggcatccgcaatctgaccggcggcctctcccccgagctgatccgttctgatccgcgccggctggatgaaatggccctccgcgacggccagcgcctgctgccggccatcaaggccgccattcgcggcgagaccccgcccggtttcggcctgccattgcccggccgcgacggggtaacgcgctgggtgctgctctatgcgaccacaccgcgcccctcggccgatggccggctgatcgccgatgtgctggcgatcgacggcaccggcctgcatcgcatcgaggaggatctgcggaccgcgcgtgcctcggccgaacgcgccaacgccgccaaatcaatgttcctggccaatatgagccacgaactgcgcacgccgatgaccggggtgctgggcatgctcgacctgctggccggcaccgatctggatggccggcagcggcggtggatgacagcgatgcgccggtcggccgaagggctgatgacgctgctcaacgatatcctggacctctcgaaggtggaggcagggcgcctggtcctgcacgaggaaccggtcgccatcggtcggctgctggacgatgtcgtcgggctgttcgaaggccgggcgtcgcaaaaaggtatcaatctgtcgatccgccgcggtccgggcgttcctgaaacggtgctggctgatcctatgcgcctgcggcaggtgctgatgaatctggtcggcaatgccatcaagttcaccgagaacggcttcgtcgagatccgcgtcgacggcaagggtgagggagatcatccttcctttctgtccatcgccgtcgccgacaccggcatcggcatcgccgcggacgcgttggatgcaatcttccagccctttgttcaggcggcggatcgctctggcgccaccactgccccaagcgattcggcgcccacgccgggcaccggcctgggccttgccatctcgcgccggctgaccgcggcaatgggcggtgagctcaccgtcgacagcctgcccggcgtcgggtcggtcttcacgatcacgctgccctgtcgggccgggagcggagatgcagccacacggaaagccggctcccgtcccccgtcccggccaaaggacagcgagactgccggcacattggtggccgtccccgctttcaaaggccgcaggctcctgatcgccgaggacaatcccgtcaatcgggaactcctgaccgaggctctgcggcgcatgggcttcgacgtggctgtcgcagaagacggtgtggctgccgtcgagatgtcggccaaagccgccttcgataccattgtcatggacatgcagatgccacggatggatggcgtcacggccacccgtcggatccgcgcgcgcccgggaagggatggcaaggtcccgatcctggccttgtcggccgacgccatgccggaaaaccgctcacgttatctggacgcagggatcgacgccttcgtggcaaagccggtgaactggggcgaactgcgcgacaccctgacaggcctgctcgatgacggccggccgccctccgggccggttacggaaagcgagccatccggcggcgccgacaggacggccccggtgctcgacccggtacggcgtgatgagattgaaaaggccctcggcaccgaacgcacccgcgccctctacggcatgttcgccgaaagtgcggtcaacacccatgaacagatcgccgcagccgccacggcaggagatgcggatgcatggcgcagtgccctccatgccctgaaggggctggcggccaattacggctatcaccgtctggccgccgcctgtgcgtcactggaggtgggcgccccggatacgaccgcggcatcccggctggaagccgaggtcacggccgcacgggaaaccgtggcggccggctgatcattccccctgccccgacccgacggccgcaaccgggcaatggatgccatgcatgcttgtgaatgccggttccgcataggccagaatacgatcgtcgaacctgtcgggtcctgaggcgacaatcgggacggttgcgaaaatcgcatcgtcgtcggcattttccatctcggcgtccgacgcggcacctggtgcccgcccgcctccggtcagccaggcgccgccgcccggcccgtgggccacaagcagcaccaggggatggtgtggggtggccccgtccagcgtcagcgcatcgaagccgtcggcctggccgcaccagtccgtcagatccgcagtctgcgtcgcgcgggcatccacggcataggtgaagggccgcgaccagccgtcctggacggctgccgccggcaacccgaggctcgcggccggaacccgaccggttgcggcgccgctgcagacgatgtccgcaaccccgtccgtatcgcttgcagggcatggcaaatgcccgcttcgggccagttcggccgccagaacggccatgaccgccgccatccgtcgatcggtcgcggcccctcgtgccgagacggtctccgcacgcaggagcggcagaacgctgccaagtagcagagccagcacgaatacggcaacagcaatttctaccaggacgaaaccgtcttcggtattcacgcgtctcaggcgattcagactcgacaaatcgtgaccccttgcgtatgcaatctttaaacgagatgtacttagaaataatgcatcttgaacgatcttgatccacatcttttggtttaattctataggtagtggatttttattatgaacatgatcaacggtagcaaatcggagactgggggacgagatctggccgatgcgctgatggcgcgtggcctgctgaccgcagatgccgcccggctggtccggcgcgaggcggagcggcttcctggcggatcgctgctgcgtgcgatcgaacatatggggctggtcgacgaggccgatctcgtctcggtactggctgcggagtcgggcctggccgcctggccgggccatccggttccgtcggattcagccgggctgtcagctgaggcgctggtcaccgccggtgccgttccgttgggtgtcgaacggggcgagctgcttctcgcaatgattgatccagacgatctcacggctgcggaaaccatccgccgccggctgggccatgcggggcagctgcggcgcatggtcatcgggcgaaccgccttcgcccggctgatcggccggttgcatcgcaatgatccgatgatcgacgccatgatcgcagcagcggccggcagcggcaccgctcccggcctgacgatcgcggccgagcacatgcccgaagacccgttccgcgaccggccgcccgccgatgccgaagaaagcgcggtgacacgtctcgccgacatgctgatcgccgccgccgtccgggccggcgcgtccgatctgcatctcgatccggcgccgggacatctgggcattcgcctgcgaatcgatggcgtgctgaccccgttccgcctgctggatgccgccatcgcctcagggctcgtcacccgtttcaaggtgttggcggggctggatgccgtcgtcacccttcgcccgcaggacgggcggatcaccagaaaaatcgacggcctggcggtggaaatccgcatcgcgacccatcccaccgttcacggcgaggccgtggttctcaggctgctggatgccgaccgccggttgcgccagctcgacggtctgggtctgacgtcgcgcatcgtcgaggggctgcgccatatcgcccgccggcccgacgggatcgtggtggtcgcgggccccaccggcagcggcaagagcacgaccctgcgcgccttgaccggcctgatagaccgccgacgccttgcggtcgccacgctggaggatccggtggaatatccgctggacggcattcgccagaccgacctgtcgcgtctgccggagttgagcttcgccgacggcatccgctcgctgatgcgccaggatcccgacgtgctgctgatcggtgaaatgcgcgacgagaccaccgccgccatggcctatcgtgccgccgtcaccggccaccgggtgtacaccacactgcatgcgggcgatgccctgggcaccatcgaccggctgcgcgatctgggacttgcaccgcgtcgcctggcgggtgttctggcggccatcctggtccagcggctggtgcgacggctgtgcccggactgcgcgcccgggccgggcatcgccggccgcggctgtccggcctgcggcttcaccggctttcgtggccggataccgatcgccgaactgctgatccccgacgacgccttcgacgatctgcttgccggggatgccgcacgcccgcacctggccgcacatctcagccgatgcggtcatcacagcctgctggccgatgcccgagaggtcgagcggcgcggcctcagcacccgcgacgaaatcgaggcggtggtgggaccgctggaccggccatgatcaatcgttccgatcccgcccggcccatgatgcgactgccgacggcagacacgccggatgccgtcttgcggcgctggcggttccgcgcggtcgacgccgatggcaacctgttccatggccgcattctggccggtgatgtcgacgcggccctcggtcagctggaggcgcgcgggctcgatccgctctcgatccgtcccgttcgggagggtctgtcccggttgtggcaagggcttacccgttccggcagcctggtggcgggcccggccgaacgtcatgcagcactcgccgaagcctggtctgcggcgggcctgcatctggcagccgcgcgcgatctgccggcagcgctggatgccgcggcgcagggcggtatttcccgcgcagctgcaaaaggcttcgccggtatggctgcagccatccgcgccgggcagagcccggccgaggcggcgaccgaagccggacgggatctcgggcccgtggctgcggcggtctttgcggtcgccgcgcgcaccggacggctggcgccggcgatcgacgatcttgcccatcatcacgagaccgaagccgccatccatgcccggatcgcccgggcgctgcgttatccgatcgtgctggccgtcaccaccttcgcctctctcgtcgccctcatcggcggtgcgctgcctgaacttgccgggctgatggccgaactcggtgttgcaggcgacgacccgacgctgcaattggcaatcgcaatcggcgccgctccagctctggccatcggggtcatcatcggcctgccggcagcactggtagccgggctgctgatcgcccgccggcatccggccgttgcccggctgctggaccgctggacaccgatcgtccggctgcgccatcaactggcggcggcacgcagcctgcgcgccctgatcctggccgccgaggccggggcaccggtcacagaggcgctggacctggcggcgatcggcgccgcagatgccgaacttgcccggcagctcggcaatgtccgccgcctgatcattcgtggggttccgccggcagaggccttcaccctgctcgaaccctggcccgccgtcgcccaggcaccgctggttgcgggtgcggcagccggtcggctgcccgacgccgcccgcagcgcgtcccgcgccctggaccgcagcatcgaacgctcggtcgatcggctgactgccctcctggagcctgccctggtcatgtttctggcactggtcgtcgccggcatcggccggctggtgctgggtgcgctgtattccgggctggccgaggtcggtggatgagactgcgcacgtcctctccgccccgccgggttctgctgctcgatcgtgaccgccggctctgggtggcaacacggggcgccaacgatatcaccctccgcccgggcccggaaacgccggccgcctggcgcgccctggccgcaacggggcgccgcgaggggctgcgtcgtacgctgccgttgatcgttgaagacgaccggccacgggtcgcaaccattgccctgccccggctggggcagcggattcgccggcagatcgaagcccgccgcgtcatcgccgctgcaggcgaactcggccttgatcgcggcttcgtcgccatccggcccctgccgcccgacggcggagcgggcggtggcggtatgggccgtggcgctttgggaatcgatccgtcccgacggccggacaggctggcactcgccttcgtccctgcctcggcagaagttgaggcctgcaccaggtcggcggcaattgccgggctgcatcttcggccgctgcccccggtgctgacagccgcaatggccctggcaaaaagtcaccatgcgcagtggctggccctgcacgtaccggtgccgtccgatcagccgtccggcgatgcaatcgatcagatcctttgcgaagccggtttgccggtcttctccagccgccgcccgctttcgggcctcacccccgtcgaagccgccctggacgggagccgggcagtccgtcgccacctgcatcggcatcacaccactcccgatctgatcacgctgctgatcgacgaccatggaccactgatccaccccctcccctgacggggaggagacagagctgcgccatcatcggccgccggtcgtcgccatgccagtcgccgcgatgtccggccccaccagcccggacagaggtcgtcagccggggccgctcacccgtctggccctcgcagccctgcttgacgaggccccaccgttgcgcatccggaccttcgggccgatgtctgcctccggcacggtcgctgcccggccctggcgtgatcagccgatccgcagccggaatctggccgggctggcggccgctggcctgctgtttgccgccctgatcctgcccggcctgcaggccgccggtctggtggacgaggcgatggttgccgcccagcgcaaccttatgctcgccacgggactcgatctgcgcgcggcagcggccggcggcaccgatcccggccgtctggccgcgggcatgcgcgttgcctctgccctgggtggacttgtcgccatggaacaggcggcgccggtggacctgctctgcgtgctcgaccgcctggcggtgctgaggcctgaaggcttggccatcacggggctggatcatcgacgcgacgggaccggcccggaggccggccggctgacgctcgagatcgagatcgcccgcagcgatgccgcggcggccgatgccctgcgacagcgttttgccgaaaccgtcgcgaccgccgggctgggcatgaccacgattgccgacccgcccccgccccgggcggccgcccgcccctgacccgccaggctccggcactcagtggcggcgacacggaccctgccgggaacacggcccccgaaggcggcccgttccgcggccagctgatcctgaccccccttccggccgatgccggcagatcaggtacggcctgcaggccgcggctttccgcccgacgcttccgacggcatgccgcccggcgcgagcccgcggccatggacaaagatcccgctggccgcctggccgtgcgcgtgccccggctggcggctctggccctgggctgcctggccgtgatcgccgcagatctgacgatggcactggaggtggaacgggtacgggcgcatgccgaagatctggcccggaccgccgaggcggcacgggggcgtttccggcaggccgaagccgcggcctggcggctggatcagggagtggcgcggcttgtctcggatccgcggccactcttcacaccgccggcgccgggcccgttgctccggcagctgcatgatctggccatggcggccggcatcggaaccgtccgcctgtcgctcagcgacgccccggcggaggcggtcgcaccacggccggcagatcgtcggctgccgcatccgcccgcggcggaggctctgccccggctcaggccggttctggtcatcgccgaactgaccgcgccgtcggatgccgaaatccgtgccgggcttgcggccatgcgggccgcactgccgggccgcgccgtgatcgaccgtctggatctggccgatcgcccggatgaaggccgggcggatgcccaggcggtgttgcgtttcaccaccatcgatccgggcagcctgccacccctgcccgacggccaggccatggacccactgacccctctccttacccgccacaaccttgcggcgcccgccatcccgccggacccgcctggaaccgttgtcgcccttgccctggagccgtcggagcaccgccgccgcctgagcagcccggaccgaccgaccgcggctgagccgcctgcggtcgcacgccggatcaagcttgacggcattgcacgtggaccgggatcggactggcgggtctggatcaacggccggcggattgaaatggcggagccggcccgtcccggcgagcccgtcgtcgaagcggttggccgggacaccgtcagcatccgcctggcggaaggcaggagcacggtctctctcgccctggggcgggagatctgtctcggcatcgacggcatcctgcccgacgaggtctgtccatgaccgccatccggcccttcctgatcgtcctcgttcttctcgctctcaccgcctgcggcaccgccgatccgcgcgaccgggcgctgggtctggagcgccgcgactatcgggcgatcggaggcacgcctgcagcgacaccgtcgccggatacaaggccggctccgccgccggtaccgccacaactgccaccgctggaaggggatggtgagctggacgatcccgcgcccggtccggaagcccgggccatcctgtcccgcccggtcgacatccgggtcgccggccagatcccgatcgccgaggtcgtggaagatctggcccatcaggcgggtgtgggtgtggtgatcgatccgacccttgccggcatggtccgggtcagcctctcgggcgtgcctctcggcagcgcactgacggcgatcggccgtcaggtgaacttcgtctaccggatcgagggcggagtgcttctggtcgaacgcgaccggccggtggtccgcatctaccgcatcgatcagccggatatggtgcgccgggtggatggcggtgtcgcagcctcgtcggaactcgacaccgtcggcaccggcagtggcggcacggccgaccgcaacggctcgtcgatcgccatccgcaatcacacggacggcgccttctggaacgatgccatacgcacattggcggccgcccttggtatccccggcgatgatgccgcccagatcgccgatccggcggatgaccgccggccccgtttgagcgtgaacccacgcaccggcgtgatcgccgtctatggcgatcgccatgcccaggacgtcgtccgccgggtgattgccggcctgcgtcggaccaccggacgacaggttctgatcgaggcccgtgtcgtggaggtcgcactcgacgagggctacgaggccggaatcgattggtccgcgatcctgtcgggagacgtcaccatcgccggccggttcggcgcaccggccgcgcggatcgcaaacggggtcgacgatgtcctgggcatccgggtgagcggatccgacatcgacgccctggtggggctggcggcgcgctttggtgcggtgcgcacgctctccagcccgcgcctcaccgtgctcaacaaccagacggcgctgctcaaagtcgccgagaacgcggtctacttcacgctggatgtcgagcgagagaccgatgacgacactggcgacgtgaccctgacggtcaattcgaagctgaacaccgtgcccatcgggctggtgctgagcgtgcagccggcaatcgcggccgacgagcgctcggtggtcatgaccgtccggccgaccatcacccgcatcgcccgggaggtcgccgatccgggcgtcgccatcgcctctcagaaccaggtggaaagcctggtgccggtggtggaggtccgcgagctggactcggtcctgcgcatccggtcgggcgagatcatgatcatgggcgggctgatggaagagcgcgcgcgcttcgacgaaagcggcgccccggtgctgaaggatctgccctgggtggggcggctgtttcgcgccgacaccgatgccagccatacggtggaactggtggtcttcctgcgcgccacgatcctgcccgacgacaccggcggcaccatcgccccggccgatatcgacctgtatcgcggcttcaccaccgatccgcggcccctgcccttccccgcgccttcctcctcccctgcagtcacaccgccgtctgcaccggcggcgacacccggccgtcccgtcccagaaagcgaaagcgagccacaatgatgagcatccgaacccgttccgcagccagccatcccgacccgaaacattatggcccgacacattctggcccgagacattctggcccgagacatccggccgccgggcccgacataaccgaagacgatcgcggcttcaccctggtggaggtggccattgcgcttgtcgtcatcgccctgctggtcggcaccgttctgcaggcccaggggatggtcggcaacagccgtgcccaggccttcgtgtcggaggtcggcgccatccgcaccgcattcggtcaattccaggaacgctatggcgctctgcccggcgactacaccgatgcggcagcgcttgcgagcggcgtcacagccggcgacggcaatggcatactttcgggcgacggtgccagtcaggaaagcctgaatgcctggcgccatctgaccgccgcccagttcctgaccaatcttaagatgccgccggccggcacgtcggcgccgtccacgccgctgggtgggcagtatcagctggtgtcggcgacggtcggggcaacgagcggggtgtggctcaggatcggcagcatgaccaccggttcaaccacaggtaattcaacgcccctgctgaccgtcgatcaggcgcgccggctggacatggaactggatgacgggctgccggccaccggatctgtggtcaccagcacggccgcctgtcaggtgaccggcagcaatatgtacaatctggccgcaaccgatacctgcctcattcaggtgctgatgtagtgaggtcggtccggttctgtccgccggtggcagcattggcgcgtgtggcggtattgggtacggccctctcggctctggccctgccgccaccacccccgggagatccgctgccgccagagccggggccacctgtcctgcgggatctggttccgcgcatggtcaccccggtccgggatgtcagcccggcgatcccgccacccaaagctctccatgtcccgcgagccgtgtcgcgggcagatgaactgtaacggtggttcccaggcccggctggctgtcgagcagcagccggccgccatgcaactcgacgatcgccttggacagggggaggccgagcccggtgccttcaaaacgacggctcaaggcactctcgatctgaccgaacggggtcaaaaccttgggcagatcctcgggggcgatgccgatgccggtgtcggtcacgatgatgtccatgccgccatccctgcccggcactgccgccaaggtcacccggccccccggctcggtgaacttgaccgcattggagagaagattgagcagcacctgcttcatgcgccgctcatcgaccagaatcggcggcaggccgggcggcagctcggtctccagggtgatgccgccggcatcggcacgcgcctgaaccatcccccgggcacgcgatgccatggcccgcagatcgaccggccgctcgtcgagatccaggcggccggcttcgatcttcgacatgtcgaggatatcgctgatcaccgccaacaaatggccgccactctcggtgatatcgtgggcgtattccaggtagcgggggttgccgaccgggcccagcgcctcaagcgcgatcatttcggaaaagccgatcaccgcattcagcggggtgcgcagctcatggctcatattggccaggaactcgctttttgcacggttggccagctcggccgtctccttggcctccagcaaggccgtctcggcgcgcctgcgttctgcgcccaccagggcaagcgcgatcagatcggccagggagcccacgaaattgacctcgtcctgagcccaatgccggggcgagccgaaatgctcgcagcacaggataccgaccacccggccgtcgacccggacggtggcatccatcagggcgcccaggttgtcgccatagcgcggcagtgtcatcacctcggtcatggccggatggaaacgggcatcccccaccaccagcgcgcgttcaggcagcaatgcctcaaaatagcgcggcattccggccaccgagatatgccgtccatcggtcggcagatgactgccggcacgcgcatcgaaatgatcgatgcacatgaaatcggtcggatccggagcgtgcgtacccgcccgggtctgcatcgtatccgccagccagacggaaacccggccgacatcgatgatctccgccgccgtttcgctcaccacccggataacgctggcggggtcgccggtaaacaggccgccgccatgggcgatcgcggcaatggccccgttctggcggcgcaggcgggtctcgcgactgcgcagcgcatcctcggccatgcgccgatcggtgatatcgtgcaccaccaccagcagggatgctgcaccgccatagcgcagggcacaggcgctgagcagcccccagaaggcacgatcaccggcccggatcatcggcgcttcgatccgatccgccgcggcccggccggtcaattcggccatgatcagcgccgccgccgccggatctgcgaacagccggtcgaagatcagcccgccttcggtctggccgccgaccagatcgtccagcccgaaggcatctaccgcggcccgattggcgaaaagcagacgccggccgtcctgcatcacgatcagcatcggcagcggcgccgcctcggcaattgccctgaaccgctcctcgctttcagccagggcgcgttcacgccggcggatatcggtcgcatcgcgggcgacgaccaccagcccaccatcggccgtggcgcgctcgctcaactccagcaatcggccatcggccatgtgggcatcgatcagcgcatcgctgcgatgatggacgatgtcgccgtaacggcgcatcgccgcctcgaccgaaaacagcctgtcgccagcataggcgccccgatcgaccgcggcgcgcaccagatcctcgagcagggtgccgggcaccagcaggtccgcgaccacctgaaacagatcaaccatgcgacggttcacgatcaccagcctgaggtcgcgatcatagatcgcgatgccctcgcgcgtgctgtccagggcatccagcatcaggcgatgtgcagcccaggctcgggcttccgcctccatgcgatcggtgatgtcggtcgagacaccgcgatggccgattacccgaccgcgcgcgtccaggatcggccgccccgcttcttcgatcacccggcgacgcccgtgggcatccagcaattcatagcgcaggccatcgaaggcgacaccggccgccatctcgtccaggtgccgtcgccagcgccgctcttcggcgcgccgccaggccatggccggcaattcggcgcggcgggtgccgatcagccggtcggccggaattcccagtcgatccacgatccggcgggaaacgtagatgaaccggccgtcggcatcggtttcccagatccagtcgctggcgatgccggcgacatcacgaaagcgctgttcctgctcgctgagccggcggttgcggtccgcaagcaaccgcgcattatgcgtcaggctccccacggccagacgcgcccgggcggccgcactccagaccagtgccgacatcagcagaagcgcgatgacgaccagcggcaatgtgctctccagaagcgcccgaccgggttgatcgggcctccaggtgacccaggcgacgggggtaccatccggaccatccagtgccagggcggcatccccctgcggcatcgtcagggccagggtcacgtcaggcagccccccgattatgtcatgccccagaaaattgcgatccagacgctgaaagatgaccagcgcgtgaccgggctcctcggttggctgaaccgtgccctcggttgcgaaaggcgcgatgcgggcggccaccgcaaaaacgatgctgccgtcgatcctgatcgtccgtttcacagaccgcggctcctgcccgcctgtcgccagagcggtttcgaccaggggtgccagcatcgacggaagggtatcgatctcgtctgcagagaatccttcgccggcagaaagatagaccggtggtccggaggttcccatcaccagactgccgtcgacggcaaaggtgcggcgcagataggccccgaaattatcgtcgagccaggcgtcgtcaaacggagggctcgttgcggcgacggcctcgtcccaccaggcgtagtcgaccacggtccgttccagggtcgacatgcgggcgttcagcagatcgcggatcaggcgctgctgctggttcagtgccgtctggtcctgcacgccggctgcggtcacgacgatcgcgcccacaagaaccagaccgatggtcatcacccccaggatcggccggatcagccggccaaagctgacatcggacgtattgacagcagaatgcggcagcgatgccgaggctccgccgtcatcatgatctgcgtttccggccgccactgtctgtgcggatggagtcttgtcccgatgccagccgatgcgcacctgcgcgatgccctcttgcgatcgaagccactgggcgatcgaggccgctggcgcgatcggggccacagtgcccctgccgtcctcgcccgccggtcgtgatctcccgcacgaccgtgctcccccatccagcccgggaagtgttgcaggcccccctgacggacgcaaggcagaggctggcatcgtggcatttttccagaccacgtccgacatgcatcatcgcccggcccccgtcagaggccgggcgatgacggatgatggccaacgatcgggcggatcgggcgatcaggcagcgtgggttctggccagcttctcccccagcttgcccggtacctcctggagcacggcctcaccggcctcgatcaccgccagaccttgtgtcgcagccgccagatcgtcgatcagccggggcagttcggcatcgggcaccatcgcttccagccggtcccaacccacgggctgggccaccgcttccaggcccaggatctgaccgcgggccgactgaatggcggcatgcatgcgggcggtggcactgcccggtgccgtcatccgcaccggcctcaccggttccagcagtaccggatccgcctcgcccagggcctcggtcatcgccatgcgggccgcggtcctgaaggccatgtcggaactgtcgaccgcgtgatgcaggccatcggtcagagaaaccgccagatcgaccaccgggaagccaagcggcccgctgaccatcgcgtcgcgcacgcccgcctccacggcgggcacgaaattgcgcggcacggagccgccgacggtccggtcctcgaaccggaaaccttcgccgcggccaaggggcgtgagttccagggacacatcggcgaactggccatggccgccgctctggcgcttgtgccgcgcccgggcagccgccggccggcgcggcgcctcgcggaaggcgatacggggtggccgggtctccacctcgatgccgaagcgcagcttcaaccgctccaccgccagggccagatgacgggccccctggccgatcagcaccgtttcggacatgtcgggacgcgcatcgatccgataggacggatcctcttccaccagccgcgccagggcggcccccagcttggcctcgtcggcagccctggtcgccgccagaaccaggccggccaccggcatcggcaccgatgctcctccctcggcgatcacacctttggcatcgaccgtcacgccgaccggcacgttttcaagccggggcagcaccaccacctcgcccgcaaccgccgcatcggttcgccggatcatggccgggccgtcgaacatgccgatctggcccagacgctgaccggcgaagtcatccccttcggccagccgccccgaccacagccgcgcgatcccgacccggcccagatgcggcagatgcagcaccttgaacagccgggcccgcatccggccgtcgtcgtgaccgcgcaggaccgcatcttccccctcgtctccggcatcgaccgggtcgagcacgccttcgcggcaggcggtgacggcgacatccggcgtctcgtggcgcagcgccttcatcagccgccggaccccgaagccttcaagcgcattgccgaagaacaccggcacaatggtctcgcggccgaattcccggccgaggtcgcgatagatggtcttgcggtcgggatggttttcctcgagcagctgttccaacaggacatcgtcgaaatcggccagcgtttcgagcatcacctggcgggcttcctgctcgcgggcgctgagcgaggcgggcagccgtaccacctccgatgccgatccggggcgatatcgataggcgcgttcactggccaggtcgacatggccgaccacccgctcctcgcccgaggcgccgcgttctcggatcggcacttcgcgcagcaccagtggccggcggctggcggattgaagggcgtcgaggatggtggcgacgcgcacgctcaaagtgtccaccttattgatgaacaccatgtggggaacgcgcatttcctcaagcagggtgaagatcggcgccagcgcctcgacccgggcgggatcggggtcgcagaccaccaccgccacatcggcgacggtcagacaatcgcgcatgtcctggcggcaatcggcggcgccggggcagtcgagcatcgtccagcgctcgccaagatagtcgatgcgggcggtgttgagggtcagcccgcccgagatctggccgcgtgcttcgggccaggcatcgccccgcgcagtgccgtcggccacacggcccagccggccggtggtgcccgagatccacagcatggcctcgagcaggctggtcttaccggttccataaggtccgataaggacggcgcaccgtggcgccgccggaactctgtcgggcatggcccccgcgggcctgccctctgccgtgttggtggacatggcatcctccccagcatccggaatggatggagatcgtccgatgtcgggtgtcacgggcgcgggcggcagcaggacaagtcggcacagaagaggcgcgccgcgcgtcggagcggatcggacgatccgtcccttccttggcagcggaaccgtcggcggcgatgcaggatgcccgcagcgaaggcggccccgtcagatcgcgggccgttccgtatcaccatccggtgatatgacggcctcgttaccccccgatgctcgcgcggccggccggtcgaggcaagcgaaaccgttatccgatgccgatctgtcgcagccatcggccgcagccacgggatgtctgccccccgcttgactccacctgcgagccggactagaacaaaaagagaacaaacggacgccccccggtccgctgaaacggccccgcaagcccggcccgcacaggccaggcctgcatcaccggcccctcttgcaggccggcctctcttgcaggaaggcagcgatgataccgatcaggccgacgaccatcgcgccggcaccaggccgggtggtccgcatcttcagggatggcccccgccgtccgcgcacaccggccgcggccgatgaccgggtcgtcggcaccgcctcttccatagccgtgcagcccggccggccgcacagcctggccatggcggagctgcacctgatggtcgccgggaccacctgccctgctctcatttcgacaccaccgctcctttcgtcaccggccggttctgccggtgttccttccaccccgtggccagtgccggaaggcggcccaacgacggaggatggcatggctttcggatccgcgacccgtctcgccccccctttccccctcacccagcgcgatcccgccatccgggtcaggccttcgcgcctgctcgcggccgctgccgcagcaaccgcacgggccgcggtcgaccccgaccctcaggccagcgacgatcagctcgacgacacggcggcagccggtcttgccgcagcccaggtgcccgatcgggtcgagcagctgcgggcggtgatcgcccggatcgagacccgcggcaatgccgccaccggagatgaccgtggccaggcgggcgccgtgatcggcaccggtcatgccgccatcgatgcccgcctgggcgaaggcgggctcagcctggcccggctgcatgaaatcgtgaccgcggaagcgggggatcatccttcggccggtgccgcccatggtgccgggctggggcttgccgccagctgggccgcggcggcagcgcgcctgcgcagcggcccggttctctgggtcggcggctggccgcccccttatgcgccggggctggcgggtttcgggctcgatccctcccggctgctggtggtgccggcccggcgtagtgccgaacggctctgggtgatggaagaggcggtgcgcagcggcgcggtcgccgccgtggtgggagaggtcgccgatgccgacccgctcgccacccggcgcctgcaattcgccgccgccgaaggcggagcgccggccctgatgctccgcccggtcgccgccgggatccttgccgccaccgccgcccatgatgccgatcccgccctgttgctcgaccgtctgccggccagttccgccgccagtcgctgggcggtgaccacggcccccggcacagccgcgcaatggccggccgcggcaggctatgccgcccgcccgatcggccggctgcactggcggctggacctgctccgtgcgcgcggcgccctgcccgcccgcttcaccgtcgcctgggcggccgaggggccggaggcgaaccgggacggtacgaccggtgcgggcatgctggacgtgatccacggcccgggtgccgtggcggcacgccaggtcgtacacggcctgccgacccgccagaccgggaccggcggctggttcggccgtaccctcacccgcagcctgggcaaccggccgctcaccgccggctgacccgcccccggaaccggacgcccgcgccggcacggggccgctgtcccgccttgccccggggttcagtatctctcatgtccagccctcacgccgatcccgcacgccctgccggcaccggctccggccggcgcattctggctctgcatctgccattgctcgccgtcgaccgccagatcctgatcgcgcaggcgagcggcgatgccgatgcggcccggcactggcgccacggcccagccgcctgccatgccccgggcccgcgcgggccgatgatcaccatccccaaccctgccgcccgggccgccggggtccggacgggcatgacgctggccgaagcccgggcacggaccgccggcgacatcctgctcgccccggcagacccgcggggcgaccgccgcgccctggcctggcttgccgatcttgccgaccgcttttcgcccgcagtcggcctcgacggcgatcaggggctgcttctcgacatcaccggggttgcgcatctcttccggggagaggccggtctgatcgcccgggccggtgccctgatccgcgggcgcggcttcagcctgaccgcggcgatcgcccccacaccgctcgccgcctctgccctcgcccgggcccaggcctacacacatgcccacgcacaggcccatcccccggcagatgccaccgtggtggtggcacatgaccgggccggtcccgacgagacccgggccgccctcgcccggctggtcggccccctgccgccggagatgatcagtctcgatcgagaaagattgcggcgggttgcggaaggtctggcgcggctcggcatccggcgggtcgatgccctggatgcgctgccccgcagttcggttgccgaacgcttcgggtcggggctgctcgacctgctcgaccggctgtacgaccgggcgccggatcccctgcatccccgccggccgtcggcgccggtcgaggtgcggatcagctgggcggagccgatcggacgggccgaggatatcgctgccgccaccgccgccctggtcgatgatctggtggccgatctgggcgccgccggcctcggtgcccggcggctggcgctgtcggtccatctggtcgatggccgtctgcatcgcgccgagctgggcctggcgctcgccagccgggagccacggcacatgatgcggctgctggccgaacggctggaccggatcgatcccggcctcgggatcgaggtcatggttctggcggcgcccgtggtccagccgctcgccgatctggaccgatcgctgccggggcttggccaggccccgctttcagccggtaccggcggcgctgccgtcgccgccctgatcgaccggatcgatgcccggctcggcaatggccgggtccgggcggtcaggatcgaagccggggtgatgcccgagacggccatcaagctgatccccgctgccatcgccccgcagcgggctgccaggattgacgacggcccccatcgggtaacggcaccccggccggcgcggctgctcgcccggcccgagccggccctggtggtggcggccctgcccgatgatcccccggcccggctgcgctggcgcggccggctgcatcgggtgcatctggccgatggccccgaacggctgaccggcccctggtgggaaagtcccggcgccccggccgaggcccgcgactattaccgggtcgaaaccgaggacgggctcagactctgggtgttccgcagccgcggatcggccgggctggtgctcgacgggggcggggccgccgatgacgtagcagccgcagacgactggttcgttcacggcatctttgcctgattttccagaccattgtccctggaccctcagctatcgccacaggttccgcaccgatgcagcccgtcccccatgtcgagttcgagatcaccagctgtttcagctttctgcgcggggcgtcgcatcccgaggaactggtcgcgaccgctgccgccttcggctatgaccgggttgcgatcgccgaccggtccagcctggccggcgtggtccgggcccatgtctcggcccgtaagctgggccttgccctgcatgtcggcgccaggctcgatcccgaagatgcgccgccgatgctgctctatccgcgcaaccgggaagcctatggcaggctctgccgcctgctgaccctgggcaagcgtcgggcgcccaagggtgcctgccggctgaccctggccgatattcttgccatggcggaggatcacgagatcatcctgctgccgccgatgtcgtgtcctgcaaccggcccccactccgactgggatgcccatgccgcagccgccagccggctggcggccgccttccccgatgcggtgcatctggcggcgcgccatctgcttgccggcgatgacgacgcccgcatcgcccgggtcgatgcgctggccggccggctcggcatcgacatgatcgccaccggcgacgtgcgcatgcatgtaccggagcggcggatgctcgccgatgtgatgacctgcatccgcgagcatgtgaccatcgaccgggccggccggcggctcgcccggaatgccgaacggcatctgaagccaccgcctgagattgcccgccgcttcgcccgctatcctgacgcccttgcagctgcccgccggatgtccgaccggctgaacttccggctcgacgaactctcctatgaatatccgatggagaccggcctgcccggcgaaacaccccagcagaccctggagcgccggacgcgggaagggctcgcctggcgctatcccgagggggcctcggccgggatccggaaacgggtcgaaaccgaactcgggctgatcggccgcaagggctatgcgccctatttcctgacggtggacgagatcgtgcgcttcgcacgcgatcgcggcattctggcccaggggcgcggatcggcagcgaattccgtggtctgcttcctgctcggcatcaccgccgtcgaccccacccgggtcgacctgctgttcgagcgtttcatcagcgatgcccgtgacgagccacccgatatcgacgtcgatttcgagcatgaacgccgggaagaggtgatccagcatctctatgaaaaatacggccgcgaccatgccgcacttgccgccaccgtcatcagctaccggccgaaaagtgcgctgcgcgaggtcgcccgcgccatggggctggacgaggataccgccggccggctttcgggtcagatctggggtcattccgacgagccgctcgaccgcgaggccctgcgggctgccggaatcgatcccgatgcgccgcggatccgggcgaccatcgcgcttgcccgcagcctgctcggctttccgcgccatctgtcgcagcatgtcggcggcttcgtactcacccgccgaccgctggaagagacggtgccgatcggcaatgccgccatgcccgaccgcaccttcgtcgaatgggacaaggacgatctggatgcgctcggcatcctgaagatcgatgtgctggcgctgggcatgctgaccgcggtgcgcaagggtttcgagctgatccggcagaccaccggccagagctggaccatggccaccctcccgcccgaggatccggcggtctatgacatgctctgccgggccgatgcggtgggggtgttccaggtggaaagccgggcccagctcaacatgctgccgcgcctgaagccgcggacctattacgacctggtgatcgaggtggcgatcgtccggccggggcccattcagggcgacatggttcacccctatctgcgccggcgcgacgggctggagccggtggattatccgtcggacgagctgaaggcggtgctgcagcggaccatgggcgtgccgctgttccaggaacaggcgatgcgcatcgccatggtcgccggcggcttcaccggcgaagaagccgacgaactgcgccgggccatggccgccttccgccgcaccggatcagtgaaccgtttccacgacaagctggtctcagggatggtcgcccgcggctatgaccgcgactttgccgaacgctgcttccgccagatcgaaggcttcggcgagtacggttttccggaaagccatgccgccagttttgccctgatcgtctatgtctcagcctggatgaaatgccatcacccggcggcctttacctgcgggctgctcaacagccagcccatgggtttctatgcaccggcccagctggtgcgcgatgccgcagcccatggggtggagatccgggcggtcgacatcgcccgcagcgattgggattgcacgctggaaccgaccaccgccgccaccggtgcggcaggtctgccggcgctgcgcctgggctttcgcctggtgaaggggctcgcggaagcggatgggcggcggatcgccgagcggcgaccgcccggcggctatgacagcccggccgccatcacccggctggcgggggtggcaccggcggccctgatgcgcatcgccgaagccgacggtttccgtggcatggggctggatcggcgccgggcgctctgggcgctgagccggatggaggccggagcagccctgccgctgttcgccgggctggatgatggcggcagacccgcagaggcgccggcccctctgccggcgaccccggcggcacgggcgatggtcgaggattatgcctcgaccggcctcacccttcgccgccatccgatcaccctgatccgcgccgagctggaccggcgcggcgtggtgccggtttcggcgctcggcggcatcaccagcgggcggcgcacgtcggtgaccgggctggtcaccacccgccagcgaccgggcaccgccaagggcatcgtgttcatcacgctggaagatgaaaccggctatgccaatctgatcgtccggcccgagattcgtgatcgccatcgcgttctggttcataccggtcgggtgctcaccgcgcgcggccggctggagcgatcggggcagatcatccatctgctggtcgaaaccctggccgatgccgagccgatgctgaccgccgcggtcggacgtgccgacgaccgggccgcggccgaacatctggcggcccttggcatccggctggacgcgaccgcgccgacgacgaccccgcccgctggccagatccgcctgcgatcgcgcgattttcactgacccccgatcgcaggggacggggcgggccggcaccatgatctcatcaaccatggatcgcagatcagcttcatgtctatgatgaaggcggatgtgcttcttccgtgcacggcaccgcatgtcccaacaaggccatgcagttgtcctcgccttatcacccgggtgcatccgtcggcttcctataaaggaagatgacgtttcagatgaaccagcacccgccccggtcgggccgttccagccgcggggcgcgcgcgcatgaacggatggcgatatatggccgacagcctctttctgcgtgaattcctacgcgcccctctccgcacgggagcccagcaaccttcgagccgcgccctcgccgccgccatggccgccgagatcgaccccgcggccgacgggccggtggtcgaactgggccccggcacgggcgtcgtgacccgggcgctgctcgaccgcggcattccggaagatcgcctgatcctgatcgaactcaaccccagctttgccgaccatgtccgccgcatgtttccgcaggccaccgtgctcaacggctcggccttcgacatgcgccggctgatcaccaccgaaatcggcggtggtgccgaaccgcagattgcaggcgtggtctcgggtctgccgctccgtggccggcccgatgccctgcggacacggctgctggaagacgccctcgacctcgcccgaccggccgccggccgcttcgttcagttcacctactggtatgacagcccggtgcccttcgaccggacccgggtagacggccgccgcacgcgtttcgtaccgttcaatctctggccggcctcggtctggacctatcgccgccatccggatctgctgaccggctgacgccggacgcggccgatatcaagacggtcccgccgctgcacgatccggcgggcagccgccggcagcggctcccatcccgacggcaccgcccaaccgcgcggccggcagcagcagtgtcgccgtggtgccgatattcttttcgctgtcgagtgtcagcgagccgccatggagttcggccagcatccgggccagcggcaggccaagccccgtgccgtcgaaccgccggttcagcttgctgtcgacctgaccgaaggcctccagcgccacctccagctcgtcgcgggacatgccgatcccggtatccgccaccacgatgcgcaacccgccatcgctgacgcggccggccgttatcgtgacccgtccaccggcaggcgtgaacttgatcgcattggacagaaggttgagcacgatctgcttgatcttgcggccgtcgccggaaaggacgggcaggcccggcgaaacctcggaacacacgctgatgcctgccacctcggcccgttcccgcagcatgccgaccgcctggccgatcagcgcgtcgaccaccacctgttcctcgaccagttccagcttgccggcctcggccttggacagatccagaatatcgttgatcagcgacagcaggtgctggcccgatacccggatatcctcgacatattccctctgcttggcgctgagatctccggcataacccgccgtcaggacttctgaaaacccgatcaccgcattcagcggggtgcgcagctcgtggctgatattggccaggaactgcgacttgatccggttggccgactcagcctgttccttggcggccctgagcgccacttccacccgcttgcggccggtcacatcccgcagattgaccaccacaccgcccaccgccgggtcttcgatccggctgcggccgatcgcctccaccgtcacccagtgccccagcgaatgccggaggcggaattccagcacggcggtcacaccagggtctgcaagagccgcgcgatagacttcggcgacgcggctgcgatcttcgggatggagcagtgctgcaaaggcggtccccgccacctctcccggtgcccgccccagaacccgccgcgtgctggggctcgcaaaggcgacgctgccgtcgcgctccagcaccagaaccacgtccagcacgttctcgatcagggccttcagccgccggtccctcagatcggccgcccgctccgcctcggtctggtcggtaacgtcgcgcgcaatcgcgatcatcgatacggcgccgccgctctggggcgaggcgaggcgcatgacgagggtctcgcaccgcccgatcgcaccgtcgggacggcggaaatcaagggcaccgcgccagctgccggtctccatcacctgatcccggatcgcctccagccgccgcggcagatcctcgcccgccagaacatgatggatggtgtagccccccacccggccggcatccagcccggtcatccgggcggcgccgccattccatccgatcacccgcgccgcggcatcgaacaggaccacgccgtcattcgtccggtcccagagaagcccggttccgtcgatcagatggcgcggcgacgacgagatccgcctggagcgccaccacagcccgcccgcgaccagtgcaccggcgaccgcaagcaacagaaggccgccgccaagggccgccccgggcagctgcacgataccgctcagatgaagacctgcgcagatgccgacgcccgcaaacaacagggccgcggcgatgagtgcgggctcaagcccggcacaggcggtggccggcaaggtcaaaaccggcgctgcaggcagaaccggagacacagatgccccctccggctgccccgcatcggcgggcatgccggtctctgacggctcgcgcgaaaactgcacgcctccccaggccacgtcgtcgaacctcttgacccgccaccccctccggccatcgccggagacggttacgccgcttcgaccacggtatcgggccccatggtgatgaagacaccatcgggcccgtcctgatcgctttcccggtgttcttgttcgctgtcggagcgaagtcgacgatggactcaaccaccaatgatgcagcttgtcaacataaggtcactcgtcgcgaaccaccctcgtgcggaacccgtcgcttccgcgacttagaatcaccgtctcgcgattcaccgttgtcttgaggtgcacctctcgaccccaaagtgtgtagacgtgatccagggtcttctccgcataacccagctgcagatcccggccgtcatggacgtgttccagcagcagcccgcggctgcggccgtaatcgccgtcgagcacccggatcatcggcatggcattggtgccggtctggcggatcagccggtcgcgcacctcgcgccagccgctttcattcgacactttcgccaccaccagatcattgccgcgcggttcataggcgaacaggtcctgatcgcgcatcagctcctcgtccaggaagcgccgcaggaagctggcatcccgctcgctttcgcggatctggaacagcttctgccgggtggcggccgcaggcgctgccggcagggcgcgccgcggatcccagggcccctcttcctcggccaccagcctgtcccagatcgcgagccccaggcaataggggttcacgtcgcccgggatgcgccgcaccacctgattgtggcggaccaggaattccatgtggatgtcgggcggcagccccaacgtgttcatgatcgcgcggtgccagaagctggcccagccctcgttcatgatcttggtttccatctggggcagaaagtagcgcgcttcctcgtccacgataccgatcagatcgcgctgccagtcggccagataggcgccgtggtcgcgaatgaacagcagcaggtcggggtccggatccagcggcagccgttccagatcagcgtttgtcgccgcctcgtccagacgtttgcgggcatggatcgcagcataggggtcgggcgtacccgtcgcccggtccagcgcccgggcgcgctgttcggccggcgacagccgcggcacggccgggttgcggccgatgttgaacgacagcgcatgggcggcatccagaatcttctccaccgcctccagcccgatcgaggggtcctcgacatagctgcgcacccgatcggcatgcatcttcacctggcccaggatcagttcggcgcgggtgccgcgggcaaagtaaaaattgtttttgaagaaatcgttatggccatagacatgggccatggtcaggatctgcaggcacagcgagttgtcgcgcatcagataggcgatgctcgggctgctgttgatcaccatttcatagggcaggccggccacgcccaggtcgttgagcgtgcgctggcgttcataggatttgccgaacgaccagtgtggatagtgcgacggcatgccgtgataggccatgaagccgatcatctggtcacggtcacagatctcgaattcctggtcatagcaatcgagttcatattccgcgaccttgtcgcggatgcgcgcatcccattcttccagatcgcgcatggtccagctcatgcccatgggggcaggccctcccggtcatgtccgacgagacggggaataacggggcgaggcatggcggatgcgccgtcaggcgcccgcggccgcctcggccggtgcctcctccgggcgtttctccttggtcaggaaggcccggaaggccggccagacatcctccttccgctcgatcgacagcatgtggaaattcggcgcagtcacgcggcggaagacatccagcatcgtggcatcgcgaaaccgccaggcattgggtttgatctcgccatagccgaacaggttcgacacctcgcacagctcgttcgcggccgcgaccgtccggtcattgtccgacgggaagttgtcgccatccgaacaatggaaggaatagatgttccacagcgacggatgatagcgctcgcgaatgatctccagggccttttcgtagccactggaaatcagcgtaccgccactttcgccacgatggaagaaatcatgctcgttcacctcgcgcgccaccgcatcatgagcaacgaacacgatttcgaccgtgtcgtatttggtgcgcacgaactgatagagcatgaaaaagaagctccgtgccagatacttcttcatcgtatccatggagcccgaggtatccatgatgcagatcaccacggcattgctttcgggttccacctgcgggcggatacggtgatagcgcagatcgtccttgcggaagcggaagcgggtaccggcgacggttccaccgtcttcatccgccatctcatcctctggcagttcgtcttcgatatcctcggctgcatcgagatcaggatccgaaacgggcggcatgccggtcgccatccgccggcggacgcgggcgatggccgtccgccgtttcgacatgtgaacgcggatgccgctcttgcgatagcccttgcggcggtgggtgcgctccgaaatcacctcgcgcagcttgcgccgctccatgtcgggcagttccagatcctcgaacatgatctggatcagctcgtcgagcgtgatctcggtctcgtagacgtcgcggccggcctggtcgccggctgggccctggccgggcttgccctgaccgtcgcctgccttgccgaccacctggccttcggcggtatcgccatcgccctggccgacgccgccctggttgtcaccgaagatgaagcggtattccttgatgccgcggatcggcaccttgatcgtcttctcccgcgactggccgatgatcgcctcctcagcgaccagatcggcgatgttgtcgcggatcgcccggcggaccttgtcacgatgccgctggcggtcaccggcgctgcgatcactgcgcaggccttcgctctgggcatagtcccggaaaatcgtcgccatgcagctctgccatccctctgctgccgcgatcggccggcgaggcccggaacgggcccgccggccgatcgcgatctgctggatcggaccgccgcccgcctcaatccttccagagattgttggcggcgtatttcagcaccacgtcggccgaatagctgttgtagccattgcccagcaggttcttgaccagctggtcgtacttctcccgctgatcctcgtcgcgggtccgggccttggtgatgatgcggctgatgtcgcgcacggaattggtcagcttgcgctcgatcgcatccttgagcggctcataggacgaataatgcaccttctcgccgcggcgggtggctgcccagagataggcgatgacctcctgccggaagccttcggccgcggtgccgatgatcgcgatctgctcttcgatcgatttcaggaaagcctcgtcgggctgcaactcctcccgcgtgttgcggtccttgaccttggtgcggttgatataggcttcggcatgatcgaggtaattctggaacagggtctcggcctgttcctcataggcatacacaaaggcgcgggtgatctccttctccaggatctccagataggccttgtggatggtgtcctgcagcagctccagataatgcttgcgccggtcgtcgggcatttcactccctttgaccatggcgatcagcgcctcgcggatatggatcggcgtgatgccgtcggggctgtcggcaagggcattgtccaccgccttgacgatgaaacgggtggaaatgccgctcatgccttcggaaatcgcctcgtcgcgcagttcgtcgacatcgatcttcttcgcccggcccttctcgaccacctcctcgccgttataaagcctgagcttggtcatcagatcgcatttgggcgtcggcgccagccgcgacaggatcgcgaacatggccgccacttccagcgtgtgcggcgcgatgtgatggcgatagcccgatttgcccaggatcttcgaatagatcttcacctcttccgagagcctgagattgtagggcacccggatcatcacgatacgatccaggatcgcctcgttggtgtggtcggatttgaacttctgccactcggcctcgttcgagtgggcgacgatgcattcatcgacataaaccgtgccgtgccgcccgggggcgggcacgaatttctcctgggtcgcggtcaggatggcgtggagatattcggtctcgttcttgaagacctcgatgaactcgacgatgccgcgattgccggcgtcgaaggcgccgttcaggtccagaacccgcggatctccctcggagaagcgatcgagtttcgagatgtcttcagacccgatcaggaccgacgtgtcctggttgttgggatcgaccggcggtacgaccgcgatgccgcgccgggcgcgcttggaaatcgaaacggtcctgaccggcatctcttcataccggccgttgaactcctccttcagccgccagcggcagatcgggcagagatcgccgtcgatgcggacgttgagcatcttctcgaattcccggcgcagatggcggggaatcagatgcaacggctcctcgcggatcgggcagccgtcgatggcgtagatgggcggggcttcctccagcccgcgttccagccgttcgaccagcgaacttttccccgagccgaccgggcccatcagatagagcacctgccggctttcctcgccctgcagggcggcggaatggaaatagcgcacgaactgctggatggtgcgttccatgccgaagaactcgtcggagaagaaccgataggtcttcaccggctcgtctccgaacaggcgctgcaggcgcgggtcgtcggcaccgccgaccagatccacgccctttttcatgatcatgtcgtaaatgcgggcatgcgccagtttggtgatctcgggattgtcccggaccttttccagatattccagaaaagtgccggaccagtcctgcgaggtgcgttcctcgcggtccttctcgatcagactggcgaaagaggttttgggctgctccatgatcgcccttcccgtccgttgaagcgattgccgcgggggccagccagagcccttgcgtccggttcgcgtccgccgacgtcggatcgaccggcccatgcggccggataagggtcaccctgatcgccgaacgacggcagacgtgaaggtctatcgcgcatgtcgcggttcagagccgcgatcggttcccgaacggccctgccgtacgccatccggaccggagcgatgcgggttcattcaggctccgatatgaatcacttgttgcccggacacgcaggcttcaagaagaaatcgccctgcggccacaccgccggccggctccgcccccgcgcaggccacggaaatccggccgcactgcggcattccgccgcgccccgatgacccgacaaaaatttgcccgcccccgatcgacttgtggatccgggtatgcatcagggcatgaagggtgcgcccggctcgggcccgtcatccataccagccgcgacgtctgcaagccgggcttcaagccgctggatccgccggaccagcccgtcgatcagccggtcctggcgcaggatctcggccgaagcctcgtccagcatgcgctccagatgggccatgcgttcttcgatggcgatcaggcggtcatccatgggtgtccggctcccgggtcatatagcgggcatcggcttcatagctggcgagcttcacggcaagcgccgagcccggcgccacatcacgcgccctgaaacccatcgcggcccatccgggtgccgacccgccgacggccgtcaatgccagacgcggcaagccataatcgcgggccagccggtccagcatccccacaagctgtcgggcgagccccgcccccgcgccgcgggcagcagggccacgtcgtgaatatacaggcagtcggcgtcgccggggatcgcgcccagcaggctgtccaatgccggcggccggcggtcgatccagggatgggtcaccgcataaccgaccatccggtcatcggcgatcgcggcgaagcagccggccggaaacaggcgcagccgctcggccggaacctctgcacgttccgggaaatcgagatgcaccgcatcggcaatctcgttcaaacggtcgagatctgcagccgtgagcggccgccaacccgcgcggatcatcctctcatctccggagctggtcggatttcaaggtttggacgttggcatgtcccctgatccggagcaagggcccggaccccggcgccgacgtaaaaaaaaagcccggggcgagcccggggcgaaggtcggcctttccgtgaatgcaatcgccgcttccgcccgaccatctggtcgccgcggaagccggggcagagcatgccccgggcgcatgtcgcggccatgaccgccggatgatcgttcgatgacggtaccgcagaggtgaacggacccgctcagggataggcgcagacgtcggacgacacctcgacgaagctgcgattgctggcccggatcgcaaagcggtattcgcggtcaccgatcaccatgctgtgctgcaacggcagggtgccggtcgcctcggtcgcccgaccgccgatctcgatgaagcgcagcgtcaccggctgcgacggatcgaaccaggcctcgcgatcgcccttgtcgttgaccgaggtctcgccccggccggtgacggtgatcagcccatcggcgaaggtcaccgcatcattgctaccggtcgacagcggagtcggcagaatgaagcgcttggtgaccggccccccctcgcagcgccgctcgttgctgaccgcgccgatcacgaaattcagccgctcgggcttcaccccgtcggccatccggctctgcgcgcgggtcaggatctcggccagctgccccgtcgggacatccttctgatagcgctggcgccactgttccacctcgatcaacgcgctttcacgcgcttcgcgcaggcgggcattctcggcgcccagttccgaaagcctgacattcaggtcggcgacggactgttccagtcgccggacctcgccttcggccagcatcgcgccggtgcgataggcataggcgcccgcaccggcaatgatcgccagccccgccagccatttcagcatcatcatccgccggcgccgcttttcgcggcggcggccggcgttcagccccagtgacatgccgtcttcgttcctcgtcagcgtccgctatgggtgtcagaccggcagccgtcgcagttcctcaccgcgatcgccaccggccggtaccgaccgcggcgccaggcgcggcgtctttcggccacgctcccgcgctcgggccatactaagaccgcgtcgggcccggcgggtcaagtggcgaggtcggggcaagtgcggtgatcaggagcggatgagcgggtgcccgcaggcgacaacgtccggatcccggccgtgagaccccatgaggcaaaacgcaaaaaaagccggcccgaacccggaccgacctacggaaacacattcatcagaatgcaggaaagtggcacccccaacgggaattgaacccgtgtctccgccttgaaagagcggtgtcctaacctctagacgataggggctgagccttgccttcgtggccggtctgcggtgcctcagggcgccgctgccgtccacggggcgtacacatattcggcgtcgggcgctgcgtcaagcattttacgaagagagatcgcaaggcgggtacgcggccgctctccggcttgcactcaggcggggcttgcgccaccattcgcgaccttccaccccagcggatcagcgcccgaccttgttccttcgccgagccatgaccggtgccgtgctggcgctcctggtgctcaccgcatccgcggatgcggcggaggggccgatgcgggtggtgtcgatcaatctctgcaccgatcagctgctgctgcgtctggccgaccccggccagatcgccggggtcggcccgctgtcgcgcgatccgaagctgtcggtcgaggccgcacgtgcggcgaccgttccccaggtggccgcctcggccgagacggtgcatgccctggagcccgatctggttctggccggccggttcggcgccacggcagcagcagccgccctggagcggctggggacacgggtcgaacgcttccgccccgccgccagcgtcgacatgatccgagacggcctgctgcgcgccggcgacctgctgggccccgaggcccgcagccgtgcagatgcagaagtcgcccggctggaagcgcgcgccgccatgctgaccgcacgggcagccacgctgccccgccgtccccgcgcgctgatgctgcgcgcggatggcagcatggtgggtcccggcgggcttgcccatgccatgctggtgatgggcggtttcgacaacattcttgagcatcggttcgacccggccgggcgtgcccgccgtggtggtgactggcgggtggagctggaagccgcgatccgcgcccggcccgaggcgatcctgatcgagagcatgcccggggccgcaccggccctggtccaccgcctgccccgccaccccgccctcgcccgtctggcggcattgggcgagacggcgcccgaaatgatccgcgtgcccggcaatcttctggtctgcgggctgcccgacgccctcgacatcgccgaagccctgctgcccgtagccgagcggctgtcggcaaaaccaccaattacaccggaagccggcggcgcacccgaaggagacgcctcgtgagcgacatggcgatccgccgggtgacctggatcctgctgattgtcctgcccctgatcgtgggctgggtctcgctcggttatggcccgtcgggttggatcgcccccgatccgcgggtgctgctcggcgtcgatgccccctccaccgcctccgaaatcgtgatgctggagctgcgcctgccgcgcaccctgatcgcgatgatgatcggcgcggtgctgggcgcctgcggggccgcacttcagggcctgacccgcaacccgctggcagagccctccaccctcggcgcctcgtcgaccgcggcgctgggcgccgtgaccgcgatctatttcggccatgccggcgtccttgacggcccggcaccggctgcagccggtcttgccggcgccgccatcggcctggcactggtgctggcgctcggccgcggcggcgggctgtcgctgatcctggcgggcgtgggcgtcggcgccctcgccaccgccttcgtctcgcttgccctcactttcgcccccagcccctatgcgacgctggaaatggtcgactggctgatcggatcggttgccgatcgcacgcttgccgatgccggactgctcgcacccttcgcggccgtctctctgctgctgctcaccggctgcggcgccgggctcgatgccctggggctgggagagcgcaccgcccgttcgatgggcgtgcgccttggccggctgcgcctgcaggtggtggcggcgaccgcgatcggggtcggatcggccaccgccgttgccggcggcatcggcttcgtcggactgatcgtgccccatgccctcaggcccttcgtcggccatcgccccggccggctggtgccggcaagcatggcgggcggcgcggtcctgctgccgctggccgatcttgccggccggctgatcggcgacggcaccgaaatccgcgtcggcgtcgccaccgcgctgatcggcgcaccggtcttcctgcacatcctgctgacccgggcacgggtggagcgtggctcatggtgagtgccatgccgaccctcgaccttgcggatgtccgcgccgtgctgggcgatcggaccattctggaccgggttaccctcactttgccggccggcggcctcatcgccctggtcggtccgaacggggccggcaaatcgaccctgctcgcgatcctggccgggctgcttgcgccggccacgggcgaggtccggctggacgacgaacccctcgcccgtctgggcgaccgtgcccgggcgcgggtgatgggctatctggaacagcagccggaatgccattggccgctgagcgtcgcagccctcgcccggctcggccgcctgccccatcgcggcgccttcggcagcctggatccgcgcgccgacgcagcggcggtcgaagccgcgctcgcccgcaccggcatgaccggctttcgcgaccggcggatcgatcatctgtcgggcggagagcggatgcgcgcccatctcgcccgcgtgctcgccggcgagccgcgggtcatccttgccgacgagccgctggccgggctcgacccggcccatcagctggaggtcatggcgctgctgcgggagctcgcggcccagggacgggtcgtggtggtggttctgcacgatctggcgcttgccgcccgcttcgccgaccgggcgatcctgctgggcgaggggcgggtcctggccgatggcccgcccgagacggcgctcgacgatgccgccctcgcccgcgcctatggcgtttcggtcacgcgggtggagatcgacggccggcgggtgccgctgccgaccgcccgcctctgacggccagaacgccgcaacaggccggcggcgtcagcgggcggccgccacgtcgtcgatgaacatctgaacgtcgtcgcggccctgccagcgatcgcgcctgaggccgcccgccacatgcaaaggcataccgcgcgcctgaagcagcgcgctgccgatggcattgtcggccgcacggaaggccatgcccttcagccgcgagccatcctcggcgcccatgatcacccggatatgcccctggccgacgacatccgccttcaggatccgcacgcccgacaacgcgaagcgcggctgggcattgccggtcccgaatgggccgatacgctccagcaccgagaccagatcggtggtggccccgccgaccgccagcacgccatccaggcccagccgcggggccggcggctcgccgccggtctgggcgacgatgcgttcggccaggaaggcatgcagatcgaccagctgcgccacctcgaccgtcagcccggccgccatggcatggccgccgccattgaccagcagcccggcctgacgcgcggccgtcacggcggaccccagatcaacgccgggtacagatcggccggagcccttgccgatgccggtggtgctatcgaccgcgaccacgaagaccgggcgatggaagcgttccttgatccgccccgcgacgatgccgatcacgcccggatgccagccgtcgcccgcgaccaggatgaagggtgcatcggcctggcgttcggcggcctcgagcgcttcggcctcgaccgccgcctcgatctcgcggcgttcggtgttcagccggtcgagttccatggcgatgccggtagcctcgtcgggatcgtcggtgccgagaaggcgcgcgcccagatcggcctgaccgacacggccgccggcattgatccggggccccagcacatagcccagatgataggcttcgggtgcctcgtccagacgggcgatgtcggccagtcgcgccagcccggtgttgcggcgccgggccaagaccttgatgccctgagcgacgaaggcccggttgacaccggtcagcggcacgacgtcgcagacggtgcccagcgccacgagatccagcagtcccatcagatcgggcggcttgacgcccagtctgtcatacacgccgccgtcacgcagggcccggttgagccccaccagcagcagaaaggcgacgcccaccgcggccatctggccatgggggctggtttcgtcgaaacggttgggattgaccacggcgagggccgctggcagttccggctcgccgatatgatgatcgacgaccaccacatcgagatgggcggcccgtgcggcctcgagggcggcgaatgccgtggtgccgcagtcgaccgtcaccaccacccgcacgccacgggcggcgagcgcggtcatggccgcggcgttggggccatagccctcggtcatccggtcgggaatatagaccaccaccggcacgccgatcccgcgcagaaaccgggtgacgagtgcggtggaggtggcgccgtcgacatcgtaatcgccgaagaccgcgatcggctcacgcgcggcgatcgccgcagccagacgatcgacggcccggtccatatcgcgcagatgcgacggatcgggcagtgcgacacgcaggctggggttcaggaaatcgtcggcatcgtccaggccgaccccgcgccccgccaggacccgcccgacgatctcgggcaggcccaggcgctgggcaagggccaatcccaggcgctgatcggcgagccgcgtttcccaacgtcgtccgccaagcgagcgttcgacgccgagaaccgcggcatcacggagcagaacgtccatgggcaggttcgatactccggagaaggagggtcgctcggagagagcggccggatcagtcgaaggcggtcttgcggccgaaattatgctcggccgagatcacccggacggtgccggtcttggaccgcatgatcaggctctgggtcgaccagtggttcacgcccacgcgatgcacgccgcgcagcatcgagccgtcggtgacaccggtggccgagaagatcacatcgcccgaggccagatccagcaggttgtagatccggttgaggtcggtgatgcccaggcgatgggcacggccgcgctcgtcgtcattgcggaacagcagcttgccctgcatctggccgccgatggcgcgcagcgccgccgccgccagcacgccttccggcgcaccgcccgaacccatatagatgtcgatgccggtatcgggacgcgcggtcgcgatcacgccggccacgtcaccatcgccgatcagctggatgcgcacacccgcttcgcgaaccttggcaatcagttcggcatggcgcggacggttgaggatgcaggcggtcaggtcggaaatctcgacgcccttggccttggccaggctcttcagattctcttcgaccgtgttctcgaggctcaccacaccctcgggcaggccgccgccgacggcgatcttgtccatatagacgtcgggcgcgttcaggaacttgccctcttcggccatggccagaaccgcaagtgcgttggggccgccggtggcgcagatggtggtgccttccagcgggtcaagggcgatatcgaccttgggccccttgccggtgccgaccttctcgccgatgtacagcatcggggcttcgtcgcgctcgccctcaccgatcacaaccgtgccatcgatttcgaggctgttgagcgcgcggcgcatcgcgtccacggcggcctgatcggcggccttctcgtcacccttgccgatcatcttggcgcaggccagcgcggcgaattcggtgacacgcacggcctcgagggccaggttgcgatccatgctgtaagtgatcatcgctctcgtcttgtagccgttcagcgtcggtctgaaacccgcgggggaaaataacgcaacgaccgcccggaatcatcaaggttccggacagccagattgcggccgggtcgcgccgacgacggatgtcatcccactccggcgataccctaagcccgaagcgcctccggcgccagaggctgaatcgggggatggacaccccgaagatggaaaacgggcgggacatgcagcctgtcccacccgtttcctcgctcgtcgcctggatcagaggctgttttcgatccggatcatccgcggcggctcgatcaccgccggcagggcggcgatggtgtcgagcgcccggcgcagcgccgcctcggaggtggcatgggtggtcagcaccaccggcaccgcctccacctcgctgcgcccgcgctggatcaggctttcgagcgagacctgctcggtggcgaaggcacgtgccacatcggccagaacccccggctgatccagcaccatcagacggatatagaaggcaccgacatgggcatcgatcggcgccgcggccggcgcacccagcgccagggccggcaccgagaaggctgggcctgcatggccgcgggcaatgtcgatcagatcggccaccaccgccgaggccgtggggccgcggccggcaccgcgaccctggaacatcgtgccgcccacggcatcgccttcggcgaccacggcgttgaacacgccttcgacatgggcgatcggcgccgacagcggcaccatgcagggatgcacccgctgttcaagcccctgcccggtcatccgcgccacccccagcagcttgatccggaagcccagctcctcggcaaagcggatgtcgtcgatggtgacgtggcggatgccctcgacatggatcgcatcgatatcgggccggccaccgaaggccagcgccgccaggatcgccagcttgtgggcggtgtcgatgccgtcgacgtcgaaggtcggatcggcctcggcatagcccagcgcctgggcctgggccagcacgtccgagaagtcgcgaccggtggtccgcatctcggtcaggatgtagttgcaggtgccgttcaggatgccgtagacccggccgaccgcattgccggccagaccttcgcgcagtgccttcaggatcggaataccgccggcgaccgccgcctcgaaggccagcgccagaccgctttcctcggcggctgccgcaagctcggggccatgggctgcgatcatggccttgttggcggtcacgaaggacttgccgcctgagaaagcggcacgggcaagatccagcgccgtcccctctgcgccgccgatcagttcgacgaccacatcgacgtcatcgcgccgggccagtgccacggcgtcatcttcccagcccaggcctgccagatcgacgccgcgatcccggctgcgatcacgcgccgagaccgcggtcacctcgatcggccgtccggcacgggcggcgatcagcgccgcctggttgcgcaggatctcgatgaccccgacgcccacggtacccaggccggccacacccacgcggagcggcacggcatgcccggaggcggcggagaggggactggcgttcatcggacttcctcgagtgcttcggcaggtttcagggcctgttcttcacggtattccttgaagaaccgcttgatgttgcgcaccgcctgacggatgcggtgcttgttctcgaccatggcgatgcggacatagccgtcgccatattcaccgaagccgatgcccggagacaccgcgacatcggcgcgggcgagcagcagcttggagaattcgagcgagcccagatgcttgaactcgtcggggatcggcgcccagcagaacatcgaagccttcggcgtcggcaccggccagccgatgccgtgcaggccttcgaccagcacgtcgcgacgctcgcgatagagcgtccgcatctcctcgacgcagtcctgcggaccgttcagcgccgcggcacccgccacctgaaccggggtgaactggccatagtcgagataggacttgatcttggccagcgcctggatgagacgccggttgccggcggcaaagcccacgcgccagccggccatgttgtaggtcttgctgaggctggtgaactccaccgccagatcgcgcgcgcccggcaccgacaggatcgagggcggcggcacgccgtcgaaatagacctcggcataggcgaggtccgaaaggatgtacatctcgtggcggcgggcgaaggcgaccagcttttcatactgggcgacgtcgatcacctcggaggtcgggttgcccggatagttcagcaccatggccaccggcttgggcgaggtgtggcgcacggcatattccagctcggccaggaaatcatagccggggccatggggcacatggcggatattggcgccggcgatcacgaagccgtagggatggatcggatagctcggattggggaccaggatcacgtcgcccggcgtggtgatcgccgaggcgagattggcgagcccctctttcgagccgatggtcaccaccacctcggtctcggggtcgatctccaccccgaagcggcggcggtaatagctcgacgccgcccggcggaggcccggaatgccgcgcgactgggaatagcgatgcgtcttcggatcgcgcactgcctcgaccagcttgtcgacgatatgggccggcgtcggggtgtcgggattgcccatgccgagatcgatgatgtcacggccggctgcgcgcagccgggccttcatctggttgacttcggcgaagacatacggcggcagccgccggatccgcgcgaattcgtctgccatgggaccacttcccgtcgatcgtctcgcagcttggagaccaggtgaagcaggtggcggaacttccgtcgcccgcaagggaggttcgaacgtctccgggcgcgggatgcgtcggcgccggggcgccgcccccgcacggcgcccgtcgtccgctacaggggaaaattttcgctttttagcggatgcccccggtgggtgcgatgaaaatttcaaaatccggggccatcgagcctgccggcgcctggatccgcgcgatccgggtggcgggcgcccccatctcggcgagacgacgggatgcggcctccagccgcgcggtggccagcgccgttccctgatcggttccggcgacgagcgccaggctttcgtcccgggctgcggcgatgcgccaggcggcgcgcagttcggccgccgcggcatcatcgatcgcggcgctaccaggggcgaaaccgatccggcccaccgaaagcccgggccgcggcgcctcggggcggttcgccaccgcagcagcggcggcggcagcctcggcgatcgcctggccggcacgggcctggtcactcgccaggtcctggcggatttcggtccgttcggcaagcggggtcaccggcggtgccttggccggcaccgaattcagggtcgggaacggcgccgccgcaaattccgcgcgggcagcccggatatcgggatcggtgccggcgccgggcccttcggcacaggcgccgagggcgagcgcgaacacgacggccacggccatgccgccgcccgcgcgtcccgcgaaattccgtcgcatccccaccgaggcagcgttgagccccgccgcctgcacccgtatcatggccttcacctcgacctcgcagtaccaccgatcgccgactgtggcggcgcaactataagggacgtaaggatggccgagcaaggagccgaccggggaagcagcaccggcagccgtgacgacgccgacgccttcgcacgcaacatgcgcgaggttgccgagcgcagccagcagatcatccgcgattttctgtcgcggaacgaaggcctggacacgtccgctcccgccgatcccctgaacctcaccaccgctttcacccatctcaccgagcgcatgatggagaacccggcccgtctggtcgaggcccaggctgcgctctggcaggattatctcaatctctggcaatccaccgccagccgcatggccggcggcgaggcgaagccggtcattgcgcccgagccgtccgacaagcggttcaaggacaaggactggagcgagaaccagctcttcgacttcatcaagcagtcctacctgctcaccgcccgctggattctgaacaccgtgcacggtgtccagggcatggaccccgacgaagcccgcaagatcgacttctacacccgtcagttcgtcgatgcgatggcgccgtcgaatttcgtcaccaccaaccccgaagtgctgcgggcgacgatcgagagcaagggcgagaatctggtccgcggcctcaacaacatgatccgcgacatggagaagggcggcggcgagctgcgcatctccatgaccgacgagaaggctttcgagctgggccgcaacgtcgcgaccgcaccgggcaaggtggtgttccagaacgggctgatgcagatcctgcagtacacgcccaccaccgagaccgtgcacaagcggccgctgctgatcgtgccgccatggatcaacaagttctacatcctcgaccttcagcccaagaactcgttcatccgctttgcggtcgaacagggccacaccgtcttcgtggtctcgtgggtgaacccggacgaggagatggcgaagaagaccttcgaagactatatggtggaaggtctgatcaccgctctcgacaaggtgaccgaagaaagcggcgtggccgaggtcaacgtcatcggctactgcatcggcggcacgctgctcgccaccacgctgtcctatctgaaggcgcagggcgacaagcgggtcaagagcgccaccttcttcaccaccctcaccgacttccgtgacgccggcgacatcaaggtcttcgtcgacgaggcccagatcggcaacctggaaaaggtcatgtcgaagaagggttatctcgaaggccggaagatggcgaccgcgttcaacatgctccggtccaacgacctgatctggagcttcgtggtcaacaactacctgctgggcaaggatcccttccccttcgatctgctctactggaacagcgacgccacccgcatgccggcggcgatgcacagcttctatctgcggcatatgtaccgcgagaacaagctggtggagccgggcggcatcaccatgcgcggcgtgcccatcgacctcagacagatcgacatcccggtctacatcctgtcggcgcagcaggaccatatcgcgccgtggaaatcgacctatcgcgccacccagctctattcgggcaacacccgcttcgtgctgggcgcctcgggccatatcgccggcgtgatcaacccgccggcggccaacaagtacaactactggaccaacaaggatctgcctgccgatccggaggcctggttcgccggcgccgagaaacatgccggctcgtggtgggtcgactgggcgaaatggatcaagcgcctgggcggcgcgcaagtgccggcccgcaccccgggcgaggttctgggagtgatcgaagatgcccccggcagctatgtgaagatgcgtgactgacccgagcctctgacgaagatcccggcggtttctccccaggaggaaccgccggttccgtttcaggcggtgacggtctccagaaaggccctggccgcccgccccagatagcgctcgcgatgcaacagcaggtgaaatgcccgctgcggcaggtcgagcacggggctgcgcaggctgccgagcgccagcccgcccgcgaccaccagagcggagagcgcggtcgcccccgccccggcctccaccgccgcccgcaccgattcgttcgagggcagctccagcaccacattcagggtgtcgggatccacgcccaggccggcgagtgccacctcgaactcggcgcgtgtgccggacccccgttcgcgcagcacccagggggtttccgccaactggccgggggccacacgcggcagcgccgcccagggatggcctgcccccaccaccagcatcagccggtcgccgggcagaagccgttccgacagcgacggatcctcgaccggcccctcgacgaagcccagatcggcggttccggccctgaccgctgccgcgacctcggcagtgttaccgattgcgatctcgacggcgaccgccgggaaatcggccatgaagccgatcagccgcgcaggcagccagtaattggcgaccgtctggctggcgtgaatgcgcagccggccacgcggattgccggcaagatcggccagggcctgttcggcagccgcggcccgggcaagcactgcacgggcctcttccaggaagatccggccggtctccgccagttcgatgccgcgcccgacccggtggaacaacgccaccccgtgacgggcctccagcgccgcaattgcagccgaaaccgtcgactgggtcagattcagcgcccgcgccgcccgggtcacatgggcatgctcggccaccgcgacgaagattctaagctgttcgagggtcatggcgccgtcaccgcccggcggcgttcatggccaagtgcgatggcgaaggcgatctgcccgaccagccccgctgccgccagcaccagcgccgctgcaagtgccggctggctgcccagtccggccagagacgtgcagagcgcccccaccgccatctgggtgaagccgtagaggccggaggccgagccgatgatcctcggatcgaccccgattgctttggtcaatgccgccggtgccgccatgccgaccccaagggtaaaaacgaacatcgccccgaccgtcgccgtcacgctcatcatgcccgacagcgtcgtcgccagaaagaccagcgcgcccgccacgctcaacagattggcgcgcaccatcagccggtcgatcgacacgcgtccgatcagtcggctggcagccatgctgccaagccagacacccgagatcagaatgccaagatagattcccacctcgtgtggcggccggtgcagttcgccggtcatgataaagggcgccgcagcaatgaatgcatacatcgacgtggtggcacagccgccgccgatggcgtagccgaggaaggcccgagaggcgaagaggcggcgataatgcctgagaaccgaacctccggcggccgcccccgcccgccggccggtttcgggcagcagtcgccaggcacagacgagattggcaaacccgatcacgaccagtgcatagagcaccgatcgccagccggcggccgataccagcaggccgccgatcagcggcgcgaagcccggccccagcgttaccatcaggttcatgagggcaagtcgccgggcggcgtcctcaggtgccgaggtatcacggaccatggcacggcccagcacgagccccgcacagccaccgaaggcctggaacagccgggcggcgatcaggctgccggcgccaggcgccaacgccgctgcgatccccgaaagcgtatagagacagagcccgccaagcagcaccggccggcgaccgaagcggtccgagagcgggccataaaacagttggcctaccgccagccccaggatgtacaggctgatcgtcagttgcagcgtgccggctgcagcatcaagtcccttcgctgcctcggggagggctggcacgaagatatgcatggcgagggtgccgctgaaggtgatcagcgccaaaagccagagcggcgcccgtgggggcgccgccgtcggatcggatgggggagacacggctggggtcatccggacatcatgccgccacgccgcctcctggggcaacggcttcggcatgtcggatggccggccggatcagccgagcaccgagaccacggccagcggcacggcgccgaccaccagggtgagcatcaggcccaggatcaccgggcggatgccgcgggccttcaccttgccgagatcggtgccgaagccgatcgccgccagcgccaccgtcagcatgatcggggtcgccgccgcagacacatgacggacctcttccggcaccacgcccaggctgttcagcccggcaagggccacgaagccgaccgcgaaccagggaaccggcaccttggccgcggccgcctcggcatcctcgatcgcgtggtcaccgcggcgggcggcccggtctgccgcccagaccagcaagccgaccaccggggccagcatggcgacacgggcgagcttggcaatgaccgaaacttcaccggcggccgtgccgtgctggaagccggccgccaccacctgcgccacctcgtgcaccgaggcaccgatccagaggccgtaggcgcggtcgtcgaggccgagcgccgtgccgagcagcggccagagggccatcaccgccgtcccgaacagcgtgaccacgcccaccgcataggcgatctcgtcatcgcgggcccgcacggccgagccgacggccgccgccgccgaggcaccgcagatcgccgtgccgccgccgatcacagtggccagtcgcggctccacgcccaccagccggcccagcggccgggccagcgacagcgtcacgctcagggccgccagcgcggccagaataccgtcgaggccaagccccaggatgtcgccggcggtgacctgaagcccgagcagcgccacgccaaggcgcatcagcggcttggaggcgaccgccagaccgggggccgccacggcaggcgcccggccgatcaccgcgcgcaggacaagccccagtccgatcgcgaccagcaccgggctcaccgcctgcatgcccgaggcgcgaaccatcaggatcgccgtgccgccgatcacgccggccagcgccagccccggcagtttcgccgcaagccgtggcagggctcctgcggtttcagtggtgggaaggctcgccatggcgtgatctccggtccgtcctgcccgggggtgatttttgcacctcccggggtgtggttcatgaccgaaagatgaccgttggcgaccgttcgctccaatgaattatacagcttgttctgatcgattttagcgaacgatcaggatatcggcaccaccgcggcgcccagcacctcacgggcgatctcctggtggctcgcggcaagccccgaataatgacgggccgtggccgcaagccggggcatgccctcctcgcccagatcgcgcagcttcttggccggtacaccgccccaaagctcgccggtgacgacccgcttgtcattgccgaccagcgcccccgcgccgacgatggcgcccccttcgactacggcaccgtccagcacggtggcgctcatgcctacgaaggcaccgctcatcagggtgcaggcatggatcatcgcgcgatggccgatggtgacgtcgtcgccgatcagcgtcggatgcgccagacggctgacatggacgatggtgccgtcctgaagattggtgccgcggccgatatggatatggtttacatcgccacgcagcacgcagccataccagatgctgctctcgggcccgatctccacctggcccaccaccaccgcacccggcgccacgtaacaactggcgtcgatcttgggccagatgccgtcgaagggcaggatgatcgcaccggggaagcgcgcggcaagttccgccgccggcaccggatcggccggcggggtgatggtgagttcggtcgaagacatgacgtcagtcccttgttcttcttctgaaaaaggctggcggatcaccctcaggcgacgtgatccagtcgcccctgatccagccgcacccgacggtccatgcgggcggcgagttcaggattgtgggtggcgatcagcgccgccacgccctgatcccgtgcagcggaaaccagcaggccgaacacccgttccgccgtttcgggatccagattgccggtcggctcgtcggccagcagcaggcggggccggttggccagcgcgcgggcgatcgccacccgctgctgctcgccccccgacagccgcgccgggcgatgatcggcgcgggcagacagccccatcagatccagcagctcagccgcgcgggcacgggccctggaccgcccctgccccgccagcagctgcggcatcatcacattctcgatcgccgagaactcgggcagcagatgatggaactgatagacgaagccgatggtcgcgcggcgcagccgggtgcgcacgccgtcatcggcacggccggcatcggtgccgtcgatcaccacccggccgccatcgggccgctccagcaggccggcggcgtgcagcagggtcgacttgccggcacccgaggggccgatcagaccgaccatctcgcccggatgcaggcggaaatcgatgccgcgcagcacctccagcacctggccgccctgttcgaaacggcggaccaggcgttccaggatcaggacgggctcactcatagcgcagcgcctccacgggatcgaggcgggcagcgcgccacgccggataaagcgtcgccaggaaagacagcaccagcgacaggccgaccacgctcaccacatccgaccagaccacatccgccggcagtttcgacaggaagtagatctcggccgaaaacagctgcgtgccggtcagtgcctgcagcgcctggcggatgctttcgatattggtcgcgaaggcaagccccagcacgaagccgatgaaggtgccgacgatgccgatcgaggcgccggtcatcatgaagatcctgaggatcatgccccgtgtggcccccatggtgcgcaggatggcgatgtcccgcgacttgtccttcaccagcatcaccatgcccgagatgatgttgaaggcagcgatcagaataatcagggtcaggatcaggaacatcacattgcgctcgacgtcgagcgcgccgaccagggtcgagttggtctgttgccagtcggtcagcaccacgccgcggtcggcgatgatcgatccgatctcgccccggatcgccttgacgttctgcgggtcggtgacgtcgacctcgatcgcggtcgccgcatccccggtctggaagaaggcctgagcggtgtcgaagggcatgaagaccagcgagctgtcgaattcgaacatgcccacttcaaagaggccgaccaccggaaaactcacctgccggggcatgccgccgaacggcgtcgccacggtgcgtggcgagatcaggttcagctcgtcgccaagccggagccccaggcgctgggccatgcgggtgccgatcagcacgcccttgccctggaaatcctcaaggctgccggcccggatgttgttcgcgatcagggtcttgcgctcaaggctttcgcgggtgaagccgcgcaccagtgcgccgcgggcatcgtcgggcccgctcgccagcacctggccttcgaccatcggcagggcgcggacgaccacctgggccttttccagatcggcagcgattccgccataatcctggatgccgcgccccgaggcactgaacacggtcatatgaccgttgaggcccaggatccggtcgaccagctggtcgcggaagcccttcatcaccgccagcaccacgatcagcgtgcccacgccgagcgcaatgcccagaagcgaaaagccggcgatgaccgagatgaacccttccttccgccgggctctgagatagcggaaggcgagaagacgctcgactgtcctgaacatgcgggttccgttggccagaggatcgaggggatgggaaggatgcgtgcgggccgactttaggcacagcccggccacggtgcaaccaaatgccccgtcatgcagagcggatcacgacatcgtcacgggatcggggccggaaaccggtccatgattccaggatcccctgcgagcggagcgggtgacgatgccacaggatcttcggcttgacgccctgcagaacgggctgctgcacagaatagagagctatgtgccggtgcgcggacggccggcaccgccgcgcccggccctgatcgaggcgttccggcgccatcctcgccacctctttctgccgcgctaccgcccggcggatcagcctgaggggccggcacgcgccccgggtgatgccggctttccagagggcgcctatcacgaccgcccgctctgttacgtcgacgagcacggtatctccctgcctgcctcctgctccgagccgggcttcattttccatctggccgagttgctggacgtccggcccggtcatcgggtgctggaaatcggctgcggcaccggctggctgctcgcgatcctcgcgcacgccgccgggccggatggaacggtggtgggcgtggagatcaaccccgctctgcaggctctggccgcccgcaatcttgccgcggcgggagcaaccaatgcgatcgccgtcgcaggtgacggcctcgcagccgccggcccgggccccttcgaccgcatcatcatgaccgcctcggcctggcagctgccgaccaggattctcagcctgctcacggaagacgggctcgccgttcttccaattcgtaacaaaggcttgtcagaagagattcacgttttggagcggcgcggtccggcgctggtgtcgcgcctgacacgcctctgccgtttcgtgccgctgaccggtcgcgatggcgcggatgaaaatcttctcatgcctcgcctgaccgcagaccccgacatcgcccggcttggcgaaaccgggcggccacgatcgctcgacttcggccaaccgataccggatcgaatgatgccgccggcgctcgcctttaccgcctggatgtcaaagctggagccgcgcttccgcgcctggcggctcggcccgggtgacgggccgccatccctgttcggtgatccggagaggcatggtttcggtctggtggacaagtccgccggatccgccaccctctggcgcgcaggccaggtgatcgcttatggcgacgagagcacacgcgatgcgctcttcgaccatctggcgcgatggacggcacaggacgggccgacgggttatgctttcggcctcggcatcactgccgcccgagggacgtctccggtctcacaccacgcttatcgcaagcgccggggcccgctcgatttctggtggtggctgcgcccgcccgccgaacggctgtagtaacccgacattttcatcgcccctcccgctccagccgcgcgcaggccgccgcaatcgcattctgggcaggatcgtccagccgctccccattccaggtgaccgtgccgtcggccgcgatcgtcacctggccgagatcgacctcggccgcgcccagcggctggtccttgaaatagccgaagcgttcgagcggcagccccagatcgatggtgatgccgcggccgagggcgcgttcggccgcgcgcgccccgtagccgccgtccagatcggcaggtgcgacggggtttccatcgacgtcgacgcccggctgataggtcacgtcggcatccggcctgtggacggtcaggcggttgcaaaaggcccggtcgaccgtgacggtcacgccacgacccgtgccatcgatgcggatcggtgccgtagcatgctcgccagccgccaccgcgccggtgtataagccgagaaggacaatcgcgccgatccccgccgcacgtccggtcgcccgccgaccgggtccgtgacgtccctccggtcgcggcgccctcgacaacgacagaaaccgaagcgacccccggggccgctgacgcaggccctgtgcggcttgtgtgcagccccgccgccggagcatcggatcggtcttcccaatcggcattgccttacccgtccaggagcttgcgggaatgctcaaaacctatttccagctcgatcagctcggcaccacggtccgccgggaagtcgtcgcaggcgtgacgaccttcctgaccatggcctatatcatcttcgtcaatccggtgatcctcgccaacaccggcatggatcagggctcggttttcgtcgccacctgcgtggccgcggcggtcggctcgctgatcatgggcctttatgccaactatcccgtggctctggcaccgggcatgggtctgaacgccttcttcaccttcacggtcgtgatggagatgggctacacctggaaccaggccctgggtgcggtgttcatctcgggcgcggtgttcttcatcctggccctgctcaaggtccgggaatacatcatcaactcgatcccgatgacgctgaagctgtcgatctcggcaggtatcggcctgttcctcgcgatcatcgcgctcgagaacgccaaggtcatcgtcgaccatccggcgaccctgctgacgctgggtgacatcggccagcccaccgtgctgctcgcagccctcggcttcttcgtgatctgcgccctgcactatcgcaacatcaccggcagcatcatcatcggcattctgctggtgaccatcctgtcgatcctgctcggcctgaaccaggcgcagggcatcgtcagcgcgccgccgtcgatcgcgcccaccttcttcgaactcgacatcgccggggccttcgaggccggtatgttcggcgtgatcttcgccttcctgttcgtcgacatgttcgacaccgccggcacgctggtcggtgtcgcccatcgcggcggcctgctcgacaaggacggcaagctgccccgcatcggcaaggccctgctggccgacagcggcgccaccatggtcggcgccgtcttcggcacctccaccgtcaccagctatatcgaaagcgcatcgggcatcaatgccggcggccgcagcggtctgaccgcggtggtggtcgcgatcctgttcctggtcgccctgttcttctcgccgctggcgggctcggtgccggcctatgccaccgcacccgccctgctcttcgtggctctgctgatggcgcgcggcctggccgaactcgactgggacgacatgaccgaggtggcaccgggtgtgctggcggcgatcagcatgccgctcacctactccatcgccaacggcatcgccctcggcttcatctcctatgccgcgatcaagctgctggccggccgggcccgcgatgtctcgatcgccgtctgggtgctggccgtggtcttcgtgctgaagttcgccttcatcggataaccttctgataacactaaaaacggcgatgctccacatggtgcgtcgccgttttcatatgtcggaacccgaatgtgcaccgcaccatcgcacggatccgcacggttcgaagcttgcccgatttcccccgtttttgtaatgacctgacgatttttgcgttttttgcaccgcacacatgcaaaaaactggtgacggacgtcacattcctgcgtactctccccttgccgacgtaaagggcaccggcagacagaaccggcccaacgtctagggagggtgtaaccggcgcaagccggagggatcgaccgcaagagcatccggtggccacgatgccaccacgccgggttgaatgcgcggcgccaggagccacggcgatcccaggagagtaaagagttcaggcgtcccggcagcaacgatcgggccgcccacaaaacaacaatgataacaatcagctacgccgatcggttgccgtcgaatcggacgtggtgatcagcaccaagcggaatcttcgatcaaggccgtgcttgcacggtctttttttttgcgcaggagcggtcacccgtcagtcgccctcggaccggctgtcgcgtgccgcatatcgctggggcgtggtgcccagcatccgccggaacatggcggtgaacgcgctcgggctgtcatagccgagacgggctgcaaccatggccaccggcatgccctgcgacagcagcgagaccgcttcgaccagccgtgcctgctggcgccagcgcaggaagcccataccggtctcacgcgcgaaggcgcgggcgagcgtccgggtgctggcgccggcgctttccgccagccgttcaaagcccgcatcttcccccggatcgtccagaacccgccggcacaggcgttgaagccgcggatcgcgcggccagggcagatgcagcggcagggtgcgcggcgcctgcaattcatgaagaatcagggccgccaccgcctcgccgcgactaccatctgcatagtccacgggctcggccacggccgccaggatcagctcgcgcagcagggtcgtgacctcgatcacggtacaggcagcgggcagccgcttcgccggctcgggcgccacatagaccgtgcgcatcgacaccggcccgatcatccgaaccgaatgctccaccccgggcgggacccacagcccgcgcatcggcggcaccagccagatgccgtcggccgcagtgatctccataaccccggccgcagcatgaagcagctggccacgcgggtggatatgcggcggaatgaccgtgcccggcgtcagttccttggccatcgccgccaccggccgggtgacgtgctgatagtcggccgcgtcggtgctgcgcatgcccctgccctccctatcaggcgatggcgtcctgtccgattctcgacgatcttcgaccagacatcgcctatcggtcgaccttagactgaaaccagatcgccgggaagcccggtatccctgctcccttgccaccccgcgccgccggaccgccgccatgacccacgcccgccgcgtcatcagtttcatcaacgtcgcccatgtggtcgaccacatgttcatgctgatcttcccgaccgcggtgatcggcatgaccgccagtttcgacatgtcctatggcgagctgcttaccctgtcgctcggcggcttcatcgccttcggcgccggctcgctccccgccggctggctgggcgatgtctggagccggcgcaacatgatggcggtgttcttcttcggcatcgggaccgcggcaatcctgaccggcttcgcctcgggccccacgggcatcgccgccgggttgaccctgattggcctgttcgccgccatctaccacccggtcggcacggcgatgctcaccgcccatgccgaccggctgggccatgaaatcggcgtcaacggcgtgttcggcaatctgggggtcgcctttgcggcgctgatcaccggcggcatcacccagtatctggggtggcgtgcggcgttcatcattcccggcgttctggtgatggcggtgggggtggccttcctgctgctggtgccggaccggccggccccggcccccaagaccaaggcctccgccgggccgattccgcgcagtgtgatggtccgcgccttcgccattctggccgtggtcaccatcgccggcgggctggtgttcaacgccaccaccatcgtcatgccgcagctcttcaccgaacggctcgccgatctcgtctccacgccgctgggcgtgggtgcccttacctgtctggtattcgtgctcggcgccacctcgcagctgatcgtcggccggctgatcgaccgctacagcctgcgggcggtcttcgtgccgctcgccgccctgcaggcgccctgcctgctgctggccgccaccaccggcggctgggtgctgctgccgcttgcggtggtgatgatgttcgcgatctttggccaggtgaccatcaatgacggcatggtcgcccattataccgccgaccgctggcgggcccgggcctatgccgtgcgctatctggtctcgttcggggccagcgcctgcgcggtgccgctggtcgccttcatgcatgatcacggctcgggctttgcagggctgttcccggtgctcgccgctttcggcggtgcggtcttcgccggcgccctggtcttcccgggccggccccggcggcagccggcgatggccgccgccgagtgatcccgcatcggtcgaccgtgcagcggctcagccggccacgtcgatcaccaccttgcccgtcgcccgcccttcttccagatgggcctgggcatcggcagcatgggccagatcgaagcgcgccggatcgagcagcggcctcatccgcccgctgtcgaccagggccgcgatccggcgcatgatctcgccatgatgttcacgccccacatcgtgcagcacggggatgatcatgaacaccacatgcagatccagccccttcagatgcatcagggtcagatcggccgggaactgggacacgatcgtgaccacacggccgttgatccgtgcaccggcgaaagacgtcacgagatccttacccccggtcgcatccatgaccacgtcgaagccgcggccgccggtcaaccggccgacataggcctcgacgctctcctcgcgatagttcaccgtctcgtcggcacccagatcgcgggcgatcgcggccttctcgggcgacgagatcgtggtggtgacatgggcgccggccgccttggcgatctggatcgcgacatgcccgacaccgccggcaccgccatggatcagcacccgttcgcccggctgcacccgcgcccggtcgatcagcccttcccaggcggtgatggagaccagcggcagggcggccgcctcgcggaaccccaacccggccggcatgcgggcgatcagccgggcatcggcacgcatgtattcggcataggtgccgtcgacggtctttacaccgcccggcgaaccgaacacccggtcaccgaccgcgaagcccgtgacgccctcacccagcgccacgatttcgccggccatgtcgcagccctggatgcccggcagggccggcgccatcggcggaccgttgcggcggatcttccagtcgaccgggttgacgctggcggcgtggatcttcaccagcacctcgccgtggcgcggcggctgcaccggcacccggccgggcttcagattgtcgggatcgccgaagccgtgcagcacggcggcggacatttcgcgcgggatcgtggtcatcctgtcggtctccggaatgaggggcattgtgtagaaccgcattgaagcgcggcgcgattcatgatggaaatgaatagtctcaatcctaagaaacacatttcttcatggatggtgggtgatgagccagcccgatctggatgtcgatctgctgcgcagctttctggcggtggcggagaccggcggtttcaccacggctggtgaacggcttggccgcacgcaatcggcgatcagcgtcaagatccgccggctggaagagattctgggccggcgggtctttgcccgcaccagccggtcgctggcgctgaccgccgatggcgaattgctgctgggctatgcccggcgcatgctggcgctgcacgacgaaaccctgcgccgcttttcggaacccgaggcggagggggagctgcgcatcggggttgcggaatacttcgtgccccgccatctgccggcggtgctttcggccttcgcccgtgcccatccgcgggtgcgggtagaggttcgcgccgccatgggctcaagcctgatggaggcactggaccggggcacggtggatctggtgatcgccaaccgtgatgccggcgtcgaccgcggccgggtgctgatgaccgagccgctgcgctgggtggcggccgccgatttccggatcgatgccgaagcaccgctgccgctctgcaccctgcccgcgccttgcatttttcgcgcccgggcgatcgaggccctcgaccagcggctgcggcgctggcgggtggtctatacctcggaaagcgtgtccggcgtctcggccgcggtgacggccggcctcggcatcggcgtgctctgcgactcgaccgtgcccgccgggctcaggctcttgaccgacgaacacggcttcccgccgctgggcgaggtggaactcgccgtcttcggggaggccaaggcgccgccggctctggcccagtccttcaccggcttcgtggccgagcggctgcgcgccctgcttcccgggcgatgtgcggcctaggccggggcttgcgcaggcccccgccctgcccgatcatgtgtggcgatttccgcgacggatgagcgcttcccatggtcagcaacaccctgcccgacggcctgttcctggcctgggctgcgattttcggcatcggcatgctgggggcgatgtcgcccgggcccaatctgatcatcaccatgcgcaccacgctgacccgcggccgcgcccacggttttgcggttgcaaccggcctcgcctgcggcaatgccgtgcacgcgaccttcggcctcgtcggcatcacggtgctgatcgcgagcacaccctgggcctatgacgtgctgcgctgggcgggtgccgccttcctgatctggatcggcgccaaggccctgttctcgcgccattcgccgatcgtggccgccggcatggcagccgagaccacggtcgagccgcgcagctaccgcgcctcgatgatggccgggctcgccaccaatctgctcaaccccaaggtctcgatcttctttctggcgctgttcacccagatcatcgacccggcaacgcccgagccggtgaagatcctctatggcgcgaccatggttgcggtggaacttctgtggttcggcagcgtcgcctgcttcatcggcagccccggcatccgccgccgcctgcttagggttggcccctggatcgaccgcctgacgggcggggcactgatggcgctggggctgcggctggcgctgctgcgcagcgtctgagccgggctactgtaccagcccggccagcatgcccgaccggatcagctggtcgatgccataggtgacggcaatggcgaccaggctggtggcgcccgccttgatccacatgcgcggattgcgcggtgcgcccgatgcctcggcgtgctcatccttccggtcgtggcgcacgccgatcggcaggaccatgaagaacaacagccaccagacgatgacatagaccagggcggcggtgaaccagctctgcatcgggcgagggctcccgtatgtgcaaggattatgatgcacgacgcccgccgggcgcatcggaccggcgggcgtcgcacaaaacccggatctgaccggacgaccgctcagacctgctccagctcgaccagcgtgccgttggtgtccttggggtgcaggaacaggatcggcttgtcatgggcgccgatcttcggctcgccatcgcccagaacccgcatgccgtcggccttcagcttgtcgcgcgcggcatagatgtcctcgacctcgtagcacacatggtgtacgccgccggacgggttgcgctccaggaacctggccaccgggctgtcctcgcccagcggatgcagcagttcgatcgcggtgttgtcgagacgcacgaagacggtggtcacgccatgggccggctgatccttggcggccgaaacggtggcgccgaaagtgttccggtacaggttcgccgccgcctcgatatcggggacgacgatggccacgtggttgaggcgtccgatcatcggctctgtgtctcctcacgatggggccggaaccgcttgccggcacccgttcttgctattgattgcacccggtattcgcccgcccccggctgcggatatcgcgggggcggacggaaggccgttgttgcgttgcgtcctgtccggccgcaacgcaacataatgacctagattcgcacgacatgcacgtcgatcaagggcttcttgccacgacgggtcctgagccggcgacgcagggccagtcgggcgacctcgtggatgcgctcgtccttcagcacctcgtcgtcatccagcccgtcgatcgcctcggccagatcctcgaccagatcggcggccaggctgtcctcgtcgtcatcggggtcggatacacccggcagcgccacccgcggatccgccttcaactcgccatactggtcgacgaccacggtggcgaaggcggccccctcgtagagcatgcgcttgcgggcgcggatcacctcgccatcggcgggcaacacctcggtgccgtcggcgatcagatagccgctggcgatcttcgcgatccgccccggcgtccccggtgccaggcgtaccagcgcaccgttctccaccgtcaccgcctcgggcacctgcaggctgcgggccagcgcgacatgctcgatcagatggcggggttcgccatgcaccggcacggcgatgcgcggcttcacccagcgatacatccgggccaactcgtcgcggccgccatggccggagacatggatatcggcatcacgctcggtgatcacctcggcgccctgacgggccagctggttcagcaaccggccgatcttgcgctcattgccggggatctggcgcgaggacagcagaacggtgtcgccctcgcgcagatccgccgccggatgctcgccccgggcgatgcgggcaagcgccgcattgggttccccctggcaacccgtcaccagatagagcagacgctcggccggcagccggtctgcctcgcgatcgctggcaagaagatcggcgatatccagatagccggtctcggtcgccgcccggatcatccggtcaaggccgcggcccagaaccaccaccttacgcccggcatccgccgcggccttcaccaccgtctcgacccgggcgatgttggacgcgaaggtggccacgaagacctgccccttgcgccccttgaccagatcgcccagcttggcgcgcacatcggcttccgaccctgcatccgcttcgcggaatacgttggtcgagtcgcagaccatggcgaggacgccttcctcgccgatttcacgcagccggtcctcgtcggtcacatcgccgaccaggggttccgggtcgatcttccagtcgccggtatgcatcaccgtgccgaagggcgtgcggatcgcaatcgcattcggctcggggatcgaatgggtcagcgacacgaattccatgtcgaacggccccagttgcaggcggccgccgagcggaatttcggtgatgtcgagttcgcgctcagaaacgccgttttccttcagcttcgcgcgcaccacggcggcggcaaaaggcgtggcgtagatcggcagccgcagccgccgccagagatagggaaccgcgcccagatggtcctcgtgggcgtgggtcagcacgattgccgcgatcgcgtcgcgccgggcttcgaggaatgcgatgtcgggcaggacgacatccacaccgggcagccggtcatcggcaaagcccaggccgaaatcgaccacaacccaactgccgcggcagccatagagattgagattcatcccgatctcgttagccccgcccagcggcagaaacagcaattcctcgcccggctcgatcctcacggtcgggggtagcgcgtcatccttctgtcgtgtcatgccttctcggaaatgttgagccggtggatctccagcaggccgaccagggtgatatccgggtcggcatgctggatcgcatcggtcgcgttgaagaagatgggggcgagtccgccggtggcgatcaccgtcatcggcttgccgtattcatcgacgatccggcgcaccagaccttcgatcagcccgacatacccccagaagacgccggcctgcattgccggcacggtatccttgccgatgaccttctccgtgcgttccacggcgatcctcggcagtttcgcggcggcgcggtgcagcgcctccagtgacaggttgatgcccggtgcgatcacgccaccctgataggagccgtcggcgccgaccacatcgaaggtggtcgcggtgccgaagtcgatcacgatcaggtcgccgccatagatcttgtgggcggcgatggcgttcaccaggcggtcggcgcccacttcacgcgggcggtccatatcgatccgaagcccgagattgacctcgggatcgccgatcatcatcggctcggagcggaaatacttcaggcacagctgccgaagcgaaaacttggtctgcggcaccaccgacgaaatgatcaccgcatggacgtcgtcgacggtcagcccctcgagcgcgaacagctgcagcagccagacggcgtattcatccgccgtgcgccggccgtcggtgctcgcccgccattgcccgcgccagccatcgccgtcatgaaccgcaaacaccgtattggtgttgccgacatcgatggtgagcagcatgggcgtgttccttcccgtctcatctcgttcatgcgccgcccgttaccggcggtttcgcaaacaccacctcgccggccgccagccggcggacgctgccatccggctgtgtgagcagcagcgatccgtcatcatcgatgctgtcgaaccgaccggtcaccggcgtcgcgccatagcgcacggtcgcggtctgtccgataccataggctgccgccaaccagtcttcccggatggccgccagcccgccccgcatccaggccgaacggcggttgaggaaggcagggccgaacgcctcgaccagatcccgaaccatgagatggtgtgcgccgggctgttccgccagcacgatcggcggaaacaccccgtcggtcggccccggatgcacccggacattggcgccgatccccgcgatcacatagagaccgcgggcatcctcgccactctccagcagcgtgccgctcagcttaccgacgtccccctcgcccgccagcagcagatcgttgggccatttcaccgccggccgtacgctacttcccgcgggtaggattgccgcaaccgcgtcggccatcgccagccctgagacgagagaaagctgcgccgcaagtccgatcggaacctgcgggcgcagcagaaggctcatatagagattgccgaccggcgacagccattggcggccctggcgaccgcggcccgcagtctgccgggatgcgatgaccagggtgccgtcgggcgcaccggcctcggccaggcggcgcgcttcgaggttggtgctttccacctcctccagcgccaccaccgtgaaggccggcggcagctccggcgcgccgtccgcggccgcggtcacggcatcagcgccgctgcggcctgcccggcataatcgagcagcaggcccggccagatgaagtacagcatcgtgaaggcgaagctgacccccagcgtcacggtcagacccgggctgacaccacgatccagcgcctcggccggctcgtcgaaatacatcaccttgacgacgcgcagatagtaaaaggcgctgaccacgctcgacgccacaccgatcaccgccagaacgatgaacccggcatcgaccgcggcgcggaagacgaacagcttaccgatgaagcctgccagcggcggaatacctgcgagcgagaacatcatcgcccccatcacgaaggcgagcacgggccgcgaacgcgacaggccggcgagatccgagatctcttcgaccatccggccctggcgccgcatgaccagcacgatcgagaaggtgccgagcgtcatgaacagatagatcgccatataggccgccacgccgcggaagccgtccgccgtaccggcggtgaggccgaccagggcatagccgacatggccgatcgagctgtaggcgagcaggcgcttgacgttggtctggccgatcgcggcgaaggccgccagaaccatcgaggccaccgagatgaaccaggtgatctgctgccagctgtggacgaggccaccgaagggctcggccagcacgcggatcagcaggcccatcgctgcgatcttgggcgccatggcgaagaaggccgagacgctggtcggcgcaccttcgtagacgtcgggcgtccacatgtggaacggcaccgccgagatcttgaacgccaggccgaccaggatgaagaccagaccgaccagaacgccgagcgagggctgaccctgcaggctctgcgcgagcgcctcgaagctggtcgagccggcgaagccgtagaccaggctgcacccgtagagcagcatgcccgaggacagcgcccccaggacgaagtacttcagacccgcctcggtcgaccgcacgctgtcgcgcttgaaggcggcgagcacgtagagcgacaggctctgcagctccaggcccatatagagcgcaatcaggtcgttcgacgagatcatcatcatcatgccgaccgtggcgagcacgatcagcagcggatattcgaagcgcaccacgccttcgcgggcgaggtaatcgcgggccatgacgagggagaacatcgacgcgatcaacaccagcaccttcatgaaggcgccgaagctgtcggtgacgaacatgccgttgaaggtcacgacccgcccctcggggccggtcacgatcagcacggcggcgatggcgaagccgatgccggccagccaggacagcaggccggtggccttgtccttacccgcaaagacgccgacgacgacaagggcaagggccagcgctgcgagccagagctcgggcagcgccggggcgagatcgggaagaggataggacgtcatcttgtgcctcgatgcctctcgtcagcgctgcgcgagctggttcacggtgtcgagcaccatggcggccttctcgacctgaacctgggtcagcaggttggcgaccgaggcgcggatcggctcgaggaaggtctcgggatagatgcccatccagagggtgagcaccaccagcggcgcgaaggccaggacctcacgacggttcatgtcgaggatgcccttcagatcctcacggaccagctcgccgaacaccacccgacggtagagccacagcatgtagcaggcgcccaggatcacgccggtggcggcgatgaaggcgacccaggtgttggcctggaaggcgccgaccagcaccaggaactcacccacgaaccccgaggtgccgggcaggccgatcgaggccatggtgaagaacaggaagatcagcgcgtagccgggcatccggttcaccaggccgccatagcggtcgatatcgcgggtgtgcatgcggtcgtagacgacgcccacgcagaggaacagcgcgccggagacgagcccgtggctgagcatctgaatgatcgagccttcgatgccctgggtgttgaaggtgtagatgccgatggtcacgaagcccatatgggcgaccgagctgtaggcgatcagctttttcatgtcgccctgcaccagggccacgagtgaggtgtagaccaccgccaccatcgacaggccgaagatcagcggcgcgaagtactggctcgcatccggcagcatcggcaggctgaagcgcaggaagccgtagccaccgaccttcagcaggatgcccgccagcagaaccgagccggccgtcggcgcctcgacatgcgcgtcgggcagccaggtgtgcaccggccacatcggcatcttcaccgcgaacgaggcgaacatcgccagccacaggaagatctgcgcctcgcggccgaagggggtcgccatcagggtcgggatgtcggtggtgccggcctggaagtacatgtagagcagcgccaccagcatcagcaccgagccgagcatggtgtagaggaagaacttgaaggacgcgtagatccgtcgtttgccgccccagatgccgatgatcaggaacagcgggatcagcatcgcctcgaagaagaagtagaagaggacgaagtcgagcgccacgaaggagccgatgatcagcgtttccatggccaggaacgcgatcatgtattccttcacccgcttggtgatcgactcccagctcgccagcacgcagatcgggatcagcagggtggtgagcaggacgaaccagagcgagatgccgtcgatgccgagatggtagtcgatcccgtagcccgggaaccactccgccttctcgacgaactggaaggcggcggtcgagctgtcgaagcccgtccacagcagcagggagatcaggaaagtgatgacgctcgtccacagcgcgacgctgcgggcgttgcgggccacggtcgcctcgtcaccacggatcagcaggatgaaccctgcgccgatcagcggcaggaagacgaccgttgagagaagcggccaatccgtcatcaccagccggcctccagaccgaagaagaagtaggacacgatcagcgcgagaccgatgagcatggcaaaggcgtagtggtagacgtagccggactgcatgcggccggcacgccgtgccagatcgaccgacaccgcggcgatgccgtcgggaccgaggccgtcgatgatcttgcgatcaccggcctgccagagcacacgaccgatccagagcgacgggcgcacgaagatcgcatcgtagagctcgtcgaaataccacttgttgagcaggaacttgtgcagacccgagaaatcgcgggcgatcttgcccggcaggtcgggccggcggatgtagaggaaccaggccagcgcaataccgcccacgctcatcaccagcggcagcagcttcacccagccgggcacatgatgcgcctcttccaggatgttgtgctcacccagcatggtgatggcaccattccagaagtgcagctccggatccaccatcggcaggccgatatagccggcgacgatcgcgcccactgccagcgggaagagcggcgcggtcatgaccagcgggctttcatggacatgatccatggtgtgcttgtcggcacgcggcttgccatgaaaggtcatgaacagcaggcgccagctgtagaaggcggtcatgaacgccgcggcgataccgagccagaaggcataggcgccgacgccggtatgggccgcataggcggtctcgaggatcatgtccttcgagaagaagccggcgaagggcggcagaccggcaagcgccagagagccgatccacatgaaggtgtaggtgaccgggatgagcttccagataccgcccatcttgcgcatgtcctgttcatcggacatcgcatggatgaccgaaccggcccccaggaagagcagcgccttgaagaaggcatgggtcatcaggtggaagatcgccgccggataggccccgacacccgccgcgaagaacatgtagccgagctgcgagcaggtcgaataggcgatgacccgcttgatgtcggtctgggtgaggccgacggtcgccgcgaagaaagcggtcgaggcgccgatcaccgtgatcatgtcgctggtgaagctggtgagttcgaagaccggcgacaggcgcgcgaccatgaacacgcccgcggtcaccatagtggcggcatggatgagggccgagaccggggtcgggccttccatcgcatctggcagccaggtgtgcaggccgagctgcgccgacttgcccatcgcgccgatgaacagcagcaccgcgatgacttcgatcgtgggcaaggtcatgccgaggaagtcgatactggtgccggccaccgtgccgagatcggcgaagatcgcatcgaagccgaccgagccggtcacgaagaacagcgcgaagatgcccagcgagaagccgaaatcgccgacgcggttgaccacgaaggccttcatcgccgccttgttcgccgacggccgcttgtaccagaagccgatcagcagatacgaggccaggcctacgccttcccagccgaagaacatctggaccaggttgtcggcggtcaccagcgtcagcatcgcgaaggtgaacagcgacagataggccatgaagcgcggcttgtggggatcatggctcatatacccgatcgagtagatatgaaccatgaacgagacgccgttgaccacgatcagcatgacggcggtcagcgagtcgatccggagcgcccaggagaaggcgagttcgcccgaccggatccaggtgaagaggttgacggtggtcgcgttgccgcccacggcgacatcgaagaaggcgacgacggagagcagcgcggccaggccgacggcgccggtggtcacgagctgcgacccccgatcgccgatcacacggccgaagaagccggcgacgatcgccgccgcgagcggaagcaggatcagtgcgacgtacatcgcggcctcagcccttcatcaggttgatgtcctcgacctcgatcgagccgcggttccggaagtagaccacgagcacggcgaggccgatcgctgcttcggccgcagcgacggtaaggacgaacatcgcgaaaacctgccccaccagatcctggagctgggtcgagaaagcgacgaagttgatgttgaccgcaagcagcatcagttcgatcgacatcaggatcgtgatgacgttcttgcggttcaggaagatcccgaagatcccgagggtgaacaggatcgcggccaggaccagataatgctcgacgccgatgctcatcagatgcccttacccgttgggaccttcttgatctcgaccgactcctcgatcgtccgcgcactctgcttggcagggtcctgacggacgacgccgggacgggtgcgcagggtcaggacgatcgcaccgatcatcgcgaccagcagcacgaggccggcagcctggaagagatagacgtacttggtgtagacgagctgccccagcgcctcgacgttcgagacgccctcgggcacgcccaccggtgcggcaaagagcggctgggccgcgtcggcgaggccgtagctgccgccgatgagcaccagttccgccgccagcaccagcccgatcagcgcgccgaccggcagatatcgctgaaagccttcgcggagctggacgaagttgatgtccagcatcatcaccacgaagaggaagagcaccgccacggcgccgacatagacgacgaccaggatcatcgccaggaattcggcacccagcagcacgaacaggccggccgagttgaagaaggccagaatgaggaacaacaccgagtgaaccgggtttcgggcggtgatcaccatcacgcccgatgccaccgtcaccgcggcgaagaggtagaaggccagcgcctgaagaaccattctccgccctcgtccgatctcgtttcttgtcgcatggcacccgctgcggcggcgggtcccttcaaaccgtccgccggcccctcatcggggccggcgatctcttaccgtcaacggtagggggcaacgtcggccaggttggccgcgatctcccgttcccaccgatcgccgttcgcgaggagcctggccttgtcgtagaacagttcctcgcgcgtctcggtcgcgaactcgaagttcggaccttcgacgatcgcatccaccgggcacgcctcctggcagaagccacaatagatgcacttggtcatgtcgatgtcgtagcgggtcgtgcgccggctgccgtcggcgcggggttccgcctcgatcgtgatggccagagccgggcagatcgcctcgcacagcttgcacgcgatgcagcgctcttcgccgttgggataccggcgcaggacgtgctcaccgcggaagcgggggctgatcgggcccttctcataggggtagttcagcgtcaccttcggcttgaagaagtagcgcaacgtcagcgccatgcccttcacgatctcggtgagcaggaatgcgcgtgcggtctggccgatggatgccatctcaacctctcctcccccgtccgggacggtccggcatgggccggcccggatggcgggcttaccttactccgggacgcgcgcttggcaagcacgcgtccctgcattctgggtcccctgcccggcttttgcccgggcaggctgcctgacgggggcttactgcccgggcagccagccgaaaccgaccagcacaccggcagtgagcaccacccacagcagcgagaacggcaggaagaccttccagcccagacgcatcagctggtcatagcggtagcgcgggaacgtgccacggatccagatgaaggtgaacagcagcaggaagatcttgatcaggaaccacaccacgcccggaatccagttcagcggcgcgatgtcgaacgggggcagccagccgccgaggaacaggatggtggtcatcccgctcatcaggatcatgttggcatactcgcccaggaagaagagcgcgaagggcatcgaggaatactcgacgttatagcccgacacgagctccgcttccgcctccggaaggtcgaagggcagacggttggtttcggccagtgccgagatgaagaagaccacgaacatcgggaagagcgggatggcgaaccacaccgtttcctgcgcccgcacgatctccgacaggttcagcgagccgacgcacagcagcaccgtgatgatcacgaggccgatcgaaacctcgtaagacaccatctgggctgccgagcgcagcgcgccgaggaaggcatagcgcgaattcgacgcccagcccgcgacgatgatgccgtagacgccgagtgacgagatcgcgaacagatagagcacgccgacattgatgtcggagagcacccaaccgtcgtcgaaggggatcaccgcccaggcgacaaggctgaggatcagggtcagcatcggcgcgaacaggaacaggaaccggttcgagcgcgaggggatgatggtctccttggtcagcagcttcagcgcgtcggcgaaaggctgaagcatgccgaaggggccgaccacgttcggaccgcggcgcatctggatgtagccgatcacccggcgttccatcagcgtcagataggcgaccgcgatcagcagcggcagcacgatggccaggatctgggcgacgatgatcaccccgggccagacatatccggaaaagaactcagccattggtgccggtcgccttgtcctgctggagcgggttgcccgcatagatcgcggtgcaggtcgccatggtcttcgacgcgcgcgagatcgggtcggtcatgtagtagttggtgaccggggacgagagcggcgccttgtccggtgcgccggtctgaccgaaggcaccgcccagacccgccggctcgatccggtcgatcttcgccagacggggcgcgatcgccgccatccgggcgcgcacgcccgagaggtcgtcgtaaggcagcgccttgcccagcacgcccgagagcgcccggaggatcttccagtcctcgcgcgcctcgcccaccgggaacaccgcgagatgcgcgcgctgcgggcggccctcgaggttcacataggtagcgttcttctcggtataggcggcacccggcagcaccacatcggcgcgatgggcgccggcgtcgccgtgatggccctgatagatcacaaaggcatcgcccaacgcatcggtctggatctcgtctgcgcccagcaggaacaccgtatcgatctcgccccggccggcagccgccacgatctcgcgggtcgagaggccaccctcgcccggcaccagacccagctccatgccgccgacacgggcagcggcggtctgcaggacgttgaagccgttccagccgtcgcggaccatgccgcagcgctcggcaaccttgcgggcggcacccaggatgcgggcgccatcggcacgggtcagcgcgcccatgccgaccacgatcatcggccgctcggcattgcgcagcacctcggccagcggatcggcgccggaggcaatcgcctccagccgggtcgcgtcagcgcccagatcctcgaccggccaggtcaagtccagcttcggcccgatcgaccagccgcggaacccgcccttgcgccagcgcttgcggaagcgggcgttgaccagcggcgcctcgcggcgcggatcggtgccgaccagtagcaccgcgtccgcctgctcgatgccggcgatggtgctgttgaacagccaggtggagcgctgggtcggatccagcgccgcaccgtcctggcggcagtcgacatgaaccgtgccgatcacgtcgcgcatcagatcgcggaaggcggtcatcgactcgcaatcgaccaggtcgccgaccaggcccgcgaccttcttcggatcccggcccgccagacgggcccggatcgcctcgaaggcctcgtcccaaccggcggggcgcaggcggccgttttcgcggatataggggcggtccaggcgctggcgcttcagcccgtcataggcgaagcggctcttgtcgcccagccactcctcgttcacatcctcgtgcaggcgcggcaggatgcgcagcacctcgcggccgcggacatcgacgcggatattggcgccgaccgcgtcgagcacgtcgatcgattcggtcttcttcaactcccaggggcgggcattgaaggcatagggcttggaggtcagtgcgcccaccgggcacaggtcgatcatgttgcccgagagttccgaggtcagcgcatgttcgacataggtgccgatctccatgtgctcgccacggccggtcgcgcccatttcgggcacgccggcaatctcggtggcgaagcgcacgcagcgggtgcaatggatgcagcgggtcatccaggtctggatcagcggacccagatccttgtccttcaccgcgcgcttttcgtcgtcatagcggctctggccgcggccataggccatggcctggtcctgcagatcgcactcgccgccctgatcgcagatcgggcagtcgagcggatggttgatcagcaggaactccatcacgccctcgcgggccttcttcacccgctcggtgttggtgtggatcaccatgccgtcggcggccggcatggcgcaggacgcgatgggcttcggcgcccgctcctgctccaccagacacatacggcagttgccggcgatcgacagacgctcgtgatagcagaagcgggggatctcggcgccggccgcttcgcaggcctgaagcacggtcgccccggcgggcacctcgacttcgaggccgtcgatggtcagtttaggcatcggatcctcctcaggccgcgcgggccgcgtcccgggcggcgctgaggcgccgctcgagttccggacggaagtgacggatcaggccctgcaccggccacgccgcggcatcacccagcgcgcagatggtgtggccctcgatctggtaggtcacctgctccagccggtcgatctcggcgacggtcgcctgacccttgaccatgcggtccatggtccgccagagccagccggtgccttcgcggcacggcgtgcactgaccgcagctctcatgcatgtagaacttcgacagtcgggcgatggcgcgcaccacgtcggtcgacttgtccatcacgatcaccgcggcggtgccgaggccggacttgaccgcgcgcaggctgtcgaaatccatcagcacatcgtcgcagatcgacttgggcagcaacggcaccgaagagccgccggggataatggccagcaggttgtcccagccgccacgcacgccaccggcatgacgttcgatgagctccttcagcgggatgcccatctcttcttcgatattgcacggcttgttcacatggccggagatcgagaagatcttggtgccggtgttgttctcgcggccgaggccggcgaaccaggcggcgctgcggcgcaggatggtcggcgccaccgcgatgctctcgacgttgttcaccgtggtcgggcagccgtaaaggccagccatggccgggaacggcggcttcaggcgcggctggcccttcttgccttccaggctctcgatcagcgcggtttcttcgccgcagatataggcgccggcacccagatggatgtagacgtcgaagtcatagccggtgccacaggcgttcttgccgatcagcccggcctcgtaggcctcgtcgatcgcggtctgcagcgcctgagcctcgcggaggaattcgccgcggatgtagatataggcggcgaccgccttcatcgcaaaaccggcgatcaggcagccctcgaccagcttgtgcgggtcgtggcgcatgatctcgcgatccttgcaggtgccgggttcgccttcgtcggcgttcacgaccagataggacgggcgcgggtcgttcttcggcatgaaggaccacttcacaccggtcgggaagcccgcaccgccacggccgcgcaggccgctcgccttcatctcctggacgatccagtcggcgcccttggcgatgatgtccttggtcccatcccaatcgccgcggtggcgggcaccggccagacggaaatcgtcatagccgtggagattggtgaagatgcgatcctgatcacgcagcatcgttgcctcctgcggtcccgggtgcggcctgggtcgccgacggctgccagccctcgggctcagagccccggcggcggccggtctgcggaccgggcttcggcgtctcgccgcgcttcagcgcctcgagcacccgcacggtcagctccgcgtccagatcctcgtagtagtcgtcaccgatctgcatcatcggcgcattggcgcaggcaccgaggcactccacctcggccagcgtgaacagcccgtcttcggtggtctcgcccacctcgatgccgagatgcttcttgcacgcgcccagcacctcgtcggagccgcgcagccagcacggcgtcgtggtgcagacctggacgtgatgccggccgatcggcttcagattgtacatggtgtagaaggtcgcgacctcgtacacccggatcggcggcatgccgagaagatcggcaatgtaatccatggccacccgcggcagccagccatcgccctggcgctgggccagatcgagcagcggcatgaccgcgctctgctgtcggccttcagggtatttcgcgatgatcttcgcggcttgggcgagattctcttccgtgaaggcgaagctcgcaggctcgacgttggtgtcgctcactggtcccggtcccctcaacgatcgatctcgccgaacacgatgtccatattcgccagaatggcgacggcatcggccagcagatggcccttcgacatgaaatccatggccgcgatatgagcgaatccgggcgcgcggatcttgcagcgatagggcttgttggtgccgtccgacaccagatagacgccgaactcgcccttcggcgcctcggtgcccacatagacctcgccggccggcaccttgaagccttcggtgtagagcttgaagtgatggatcagcgcttccatcgaccgcttcatgtccgcgcgggccggcggcgccaccttgcggtcctcggtccgatacgggccgtcgggcatctgctcgatgcactggcgcacgatcttgagcgactcgcgcacttccttcatgcggacattgtagcggtcgtagacgtcgccgttgcgaccgaccggaatgtcgaagtccatgcggtcataaacgtcatagggctgcgccttgcgcagatcccagggcacgcccgagccgcgcagcatcggcccggtcaggccccagtccagcgcatcctcggccgagagcacacccacatccaccgtgcgctgcttccagatgcggctgtggctcatcaggttttcgaggtcgtcgaagcgcttcgggaactcttcggtgaacttccagatctcgtccagaagcccggccggcagctccatcgacacgccgccggggcggaagtagttcgcgtgcaggcgcgcgccgcagaccttgtcgtagaagcccatgatgatctcgcgatcctcgaagccccacagcagcggcgtggtggcgccaagatccatcgcgaaggtcgtcatgttcagcaggtggttggcgatgcgggtcagctccgcgaacatgacgcggatatactggccgcgcagcggcacctcgatccctgccagcttctcgaccgcgagcacataggcgtgctcctgattcatgatcgagacatagtccaggcggtcgaaatacggcagcgcctgaagataggtcttgtactcgatgagcttctcggtgccgcggtgcagcaggccgacatgcggatcggcgcgggtcaccacctcgccgtccatctcgagcacgagccggagcacaccatgggccgccggatgctgcggcccgaagttgagcatcatcggcttgatggaagtttcggtcgccgacatcacttcgtcccctgctgcgccttctcgtccccgggcaggacgtatttcgcaccgtcccacgggctcaggaagtcgaaccggcggaattcctgggtcagctgcaccggctcgtagaccacgcgcttctcggcctggtcatagcggacctcgacatagccggtgagcgggaagtccttgcgcagcggatgcccctcgaagccgtaatcggtgaggatgcgacggagatccgggtgatctgcgaagaacacgccgtagagatcccaggtctcacgctcgaaccacagtgccgagttgaacaccggcacggccgacgggaccggggtgtcttccgaggcagatacggtcacgcggatgcgctgattgtgcttgaggctgagcaggtgatagacgacgtcgaagcgttcctcacgctccggccagtcgacaccgcagacgtcgatcagctgcttgaacaggcagttgctgtcgtcgcgcaggaatgtgagcgtccggatgagcgaggtccggtagacccggaccgtcagttcacccaatgcgaccttccagccgtccactccgtcgccgagtgctgatgcgacatacgcgcccagctcccggagtgcgtcttcgttgacgttactcacggcatccgccttctcgtgcctcgacacaaaaccttgagcaccgtccggttttccggtccggtgcccgccgccgctgttttccggccgcgaacgctgagatcagcgctcgagcgtaccggtgcgacgtatcttcttctgaagctgcagcacgccgtagaccagcgcctcagccgtgggcgggcagcccggcacgtagatgtcgaccggaacgatccggtcgcagccgcggaccaccgaataggagtagtgatagtagccgccgccattggcgcagctgcccatcgagatgacgtatttcggctccggcatctggtcatagaccttgcggagcgcgggcgccatcttgttggtcagcgtgccggcgacgatcatcacgtcagactggcgcgggctcggccggaacaggaagccgaagcggtccagatcgtagcgggcggcggcggcatgcatcatttccaccgcgcagcaggccagaccgaacgtcatcggccagagcgagccggtgcgcgcccaggtgacgagttcgttcaggcgcgcggtgatgaagccgttttccttcagctcatcggtcgcagccgcgaccacgcgctcggcatcggcgccggccagggggccatgccccatggccccggccgaggcggtgcgaggatcggtcactcccattccagcgcccccttcttccactcgtagatgaagccgatggtcagcacgcccaggaacagcatcatggaccagaagccgaacatgccgatgtcgccgagcgacaccgcccacgggaacaggaaggcgacttcaaggtcgaagatgatgaacaggatcgcgaccagatagaaccgcacgtcgaactgaccgcggctgtcgtcgaacgcgtcgaagccgcattcgtaagccgagagcttctcggcctccggccgctggggcgcgatgaagtaggaagcgatcacgatcaccgcggagagagcggtcgcgatgccgaggaagatcaggatcggcagatactcggccagcaaggtctgcatgggctaggcttccctcctgaggcggacgccggccggtgcggtctgaccgtcacggtcggaacatcgccggcgacgctgcggggcagaccggcagaccgttccggcgggtgccatgctgcatgcgcgaagaacgccataccgccggccacgcccgatggtccgccacgggtacccccgcgcggcggcctcactataggcgaacgtgctcgccaacaaaatccccattttcagccacgaatatgccccggcatcgcagtgcggcaaggcttgacacgcacgttgtcacaaggacttccggccaaaaacgaacaggcccgcaccgacgaagatcgggcgggcccacagagtgcgcacgaacatgcgcgggtcttgatgaggcggcctgacccgcaggtccgaccgtccgaaagacgtttctgcatgcgtgagcacgcggatcatacaaccgtccggaaatcgtctgccggtttccgaaggatcgctggcgggagtgacgggacttgaacccgcggcctccggcgtgacaggccggcgctctaaccaactgagctacaccccctcaggcgatgcgcggtgtttatccggtccagcccccctctgtcaacgcctttccgcaaggggcccggatttcatgtcacggcatgctcacgccggtcgaggaccgcgcctgtcgcgccgggccacaccgcttctccggcttcggcgaaatggtattcatccagcggcgcaccgcgcatgtcccaccagtaccggcttgcgaagcccgaccactgggcggtgatgcggccctcgctggtcttgtaccagctgttgcagccggccgcccagacggtgcgatccaaggcatccctgagcttgcgattatagccggccatggcctcgggccggacatccatcaccggccggcgtctcccctcgcccaccagccgctgcaggcagcgcaccacgtacccggcctgcacctcatgcatgaagatgatcgagttgtgtccaaggctggtattggggccgaagagcatgaagaagttcgggaagccggcgaccgtcaccccccgatgcgcctcggcacctgcggaccatgcgtcgtggaggtcgatcccgccccgaccggcaatgcgcatcggtaccagaaactcggtcgtccggaagccggtggcccagatcagaacatcgagcgcatggcgcccgccctccacggtctccacggcttccgccgtgatccgggtgatgcggcgggcgacgacgtcgacatcgggacgtgccagagtgtcataccagtcgttggacagcacgatgcgcttgcagcctgcgggataatccggcgtcagacaccggcgcagcaccggatcggccaccttgcgggccagcgtcgccagggcctggcgttcaaaccggcggcgcgcgaagccgttgcgaccgaatacgagaaagttcttctcgagcgacaggaagatgccgaggcgatgaagacgcaaggccaccgggcttcggcgaaaccgtgcgatttcgtccgtcgtataagcgcgatccggcttgggggcgatccaggcggggctgcgctgaaacacggtcagatgcctggcggccggcgcgatctcaggcaccagctgcacggcactggagccgttgccgaccacgccgacgcgccgccccttgagatctatcgtgcccggccagcaggccgaatggaattgcagcccggcgaaactctcgcggcccggaatatcgggcacggccggccggtccagctggcccaccgccgaaatgagaacctctgcctccatgcggccgcccccgaccagatcgatggtccagagaccacgctgatcgtcgaaggctgcggcctcgaccgccgtcccgaaacggatcagcggccgaaggccgaagcgatcggcggtctcctccatataggccagaatctcgggctggcgcgcataggtgcggctccagtccggtttcggcgcaaaggagaaggaatagaggtgggagggcacgtcacagccggcccctggataggtgttctggcgccaggtgccccccagcgcctcccccttctcaaggatcgtgacggcctgaaaacccgcctgacgcaggcggatggccatacacaatccgccgaagcccgcgccgatgataacaacgcgcaggccgcgtgtccgcgacgtgaccgtccggtcgttcatatccgctctccccgtcagcggcagaagcggccggcccggcgatcatgatccgtcgccatgtgcgatcgggccgctcttcacccactatatgaaattcggaatacggattaaacgttttagttgatgaacccggtgtagatgtgccggaagcttgaacgtccggcggatactggtgggcgatgaggggctcgaacccccgaccttctcggtgtaagcgagacgctctgaccaactgagctaatcgcccggcgtgcagcgacgcagactgttcaccggtgaacgacggccgcccgccccttcaggtggagcggacggccgcgtctgatgatctgcggtgccacgaaccgcatcgcggcgccagagggtcgatccgatcctgcggaccttgtggcgccgccggcgtccggcgtcgtgagggacggcgtcgtacgcacagaaattcgatgaggtgccagccttgcattcggcctgggcctggcatggccctgaacggcgcatctgtgtgtttttgggcgggcgcagccgccgggtggtccatggaacagtccgggcaggatcagccgttcacggcgtccttcagccccttgccggcacggaacttcggctgcttcgacgccggaatggtgatcgcttcgccggtccgcgggttgcggccttcactggcggcccgggtcgcgacattgaacgtgccgaagccgaccaggcgcacctcgtcatccgcagccagcgccgcggtgatggcatcgaacacgccgtcgacggcccgggccgcgtcggtcttggacagcccggtgctgtcggccacgcgcgcaacgagatcgttcttgttcacttctgaggctccccttcttggagtggcggttcgaaaatcacacctcggtgatacgtcgaccaggggggagtgtaaatcccccggcagaagcgcgtcaatcggccagcccgtcgaaaaccgcacaaatccgccaaaaaacagccctcgcaccgttatcggcgcgagggctgctcattcttttcaaccgaaagtacgcgctctgtccggcaggcgctcagtgcgcccgcgcacccggcgcttcaccctgctccgaggcctcgtcgcggctggtgtcggccgctttgtcgtcggtccgctccggccactcgatcggcgtcaggggcttcagaagggcgtgggccaggacatcatcgacatgcgagacggggatgatggtcagccccttcttcacattggccgggatatctgccagatccttttcgttgtcccgcgggatcagcacggtcttgatgccgccatgcagagccgccagcagcttctccttcaggccaccgatcggcagcacgcggccgcgcagcgtaacctcgccggtcatggcgacactgcgattcaccgggatgccggtcagcaccgatacgatggaggtcaccatcgcgataccagccgacgggccgtccttcggcgtcgcgccttcaggcacgtggatatggatgtcggcctgttcgaacaccgtcggccggatcccataatccaccgcgcgcgagcggacataggaccgcgccgcctggatgctttcctgcatgacctcgccgagcttgccggtgatggtgaccttgcccttgccgggcatcttcaccgcctcgatggtcagcaggtcgccgccgacctcggtccaggcgaggccggtgacggcacccaccatgtcctcgagttccgcctcgccgaacttgaaccgccgcacgcccgcatatttgtcgaggttggccgaggtgatcgacacctgcttacgggtgcccatcaccagctccttgaccgccttgcgcgccagaccggcaatctcgcgttccaggctgcgcacgccggcttcacgggtgtaatagcggatcagatcgcggatcgcgccgtcggagatcgagaactcgccctccttcagcccctgcgccttgatctgcttggagatcaggtgacgcttcgtgatctcgaccttttcgtcctcggtatagcccgagatgcggatgatctccatgcggtcgagcagcggctgcggcatgcgcaggctgttggccgtgcagatgaacatcacatccgacaggtcgtaatccacctccagatagtggtcggcaaaggtgccgttctgctcggggtccagcacctcgagcagggccgaggacgggtcgccgcggaagtcggcgccgagcttgtcgatctcgtcgagcatgaacagcgggttggtcttgcccgccttcttcatcgactggatgatcttgcccggcagcgagccgatataggtccgccgatggccgcggatctcggcctcgtcccgcacgccacccagactgacgcgcacgaattcgcggccggtcgcccgggcgatcgacttgcccagcgaggtcttgccgacacccggagggccgacgaagcacaggatcgggcccttgagcttggcgacgcgcatctgcacggctaggtgctcgatgatccgttccttgaccttctcaaggccgtaatgatcctggttcaggacctcttcggcccatttcaggtccttcttgaccttggagcgggtcttccacggcaggccggtcagccagtcgagatagttgcgcaccaccgtcgcctcggccgacatcgggctcatggtcttgagcttcttcagctcggccatggccttgtcatgagcctccttgggcatgcgcgccttgcggatgcgctcctcgatttcggcgctctcgtcgcggccgtcctcgccttcgcccagctccttctggatcgccttcagctgctcgttgagatagtactcgcgctgagtcttctccatctggcgcttgacgcgcgaccggatgcgcttctcgacctgcaggacctcgatctcgccctcgatatgggcgtagatccgctccagccgctcgacgacggtcggcgtctcgagcagttcctgcttctccgccaccttgagcgacagatgcgaggcgatggtgtcggcaagcttcgccggctcctcgatctgattcagggtgaccagaacctcgggcgggatcttcttgttgagcttcacatactgctcgaactcggccacgaccgagcgcgacagcgcctcgacctcgcggccggcatcctcgccctcggcgattgcctgggcttccgcctggaaatagtcgccgtccgagatgaggcggtcgacccgcgcgcggctggcgccttcgatcagcaccttgacggtgccgtcaggcagcttcagcagctgcagcacggtgccgatggtgccgaccatgtagatgtcgtcggcgcccggatcctcctgggcggcatccttctgcgccagcagcaggatctgcttgtcgctgcgcatcacctcctcgagcgcgcgcaccgacttctcgcggccgacgaagagcggcacgatcatatgcggaaagacgacgatgtcgcgcagcggcaggaccgggtaggtgtgcgtgcgatgagtttcggtcatggccagtctcgcatttatcggaatcggcacggcgtcggacacgcggccccggaaggccgacatggcgcctcgacgtcacatcggcccgattcctgttgaggccgcgcacacgcgcccaccggatgccgaccacaccgcctcgcgcagaggccggcgatggccggggcatcacagccggcacgggtcagaccgtgccgcggccgaactgtcgcagggatcaggaagcgttgccgcccacgtcgccccgccggtccgcatagatatggagaggcttggcccggccttcaacgacctcccgattgacgacgatctcttcgaccccgtcgaggtcgggcagatcgaacatcgtgtcgagcaggatctcttccatgatggcgcgcaggccgcgcgcgccggtcttgcgctcgatcgcgcgctcggcgatggcacccagcgcgtcgtcggagaaggtcaggtgcacgttctccagctcgaagagacgctgatactgcttcagcagtgcgttcttgggcttggtgaggatctggaccagtgcgtcgcggtccaggtcgtgcagcgtggcgatcaccggcagacggccgacgaattcggggatcaggccgaacttcagcagatcctcgggctcgacctggcgaagcacgtcgcccgagcggcgggtttccaccggctcgacattcgcaccaaagccgatcgaggtcttgcggccgcgatcattgatgatccggtcgaggccgacgaacgccccgcccacgatgaacaggatgttggtcgtatcgacctgcaggaattcctgctgcggatgcttgcgcccgccctgcggcggcacggaggcgacggtgccttccatgatcttcagcagcgcctgctggacgccctcgcccgacacatcgcgggtgatcgacgggttgtcggatttgcggctgatcttgtcgacctcgtcgatatagacgatgccgcgctgcgcccgctcgacattgtaatcggcggcctgaagcagcttcaggatgatgttctcgacgtcctcgccgacatagccggcttcggtcagcgtggtcgcgtccgacatggtgaacggcacgtcgaggatgcgggccagggtctgggccagcagcgtcttgccgcaaccggtcgggccgatcagcaggatgttggacttggcgagttcgacctcggcacccttgccgccctggttcagacgcttgtagtgattgtacaccgcgaccgagaggatccgcttcgcctgctcctggccgatcacataatcgtccaggacgttgaagatgtccttcggggtcggtccgcgatcacgcgtcttgaccagcgaggtcttgctctcctcgcggatgatgtccatgcagagctctacacactcgtcgcagatgaacaccgttggcccggcgatcagcttccgcacctcgtgctggctcttgccgcagaacgagcaataaagtgtgttcttgccgtcgccgccgctggacttggtcatcgtgtctccactcgttggctctgcccggcgcccatgttagccgccggtcgcgcccgggcacaaaccctaaaaagcggcagaccgacgatgaaccgtcctggcttcgggaacgcgccccgggtcgtctgccggtgcgggggtccggaccgggagaccgcagcatcttcagcatgccgcagtcaatggaaatgtaatgcgcagttcgcgcttgccaaagggggaaaaatcatcaggcgacgcttcccgcccccaccccggacatgaagaacccgccatcgcgtgcgcgcggtggcgggttgcatgtggcggaacgccccaacttcatgtggcggaacgcctcaacgtcatgtggcgaaacgtcccatcggcagccgtgccggccggatgctgcgcggacggacgatcacgcgcggcatcgaccgggggcagtcggtcaggaggcagtatcctcggccttcggccgctgggccacgaccgtgtcgatcagaccgaaggccttggcctcttcgggcgacatgaagttgtcgcgctccatggcccgttcgacttcctccagcgggcggccggtgtgctgaacgtagatctcgttcagccgggcacgcagcttcaggatttcacgggcatggatctcgatgtcggtcgcctggccacggaacccgcccgagggctgatggaccatgatccgggcgttgggcagcgcgaagcgcttacccggcgcgccgccggccagcagcagcgagcccatcgatgccgcctggccgatgcacagggtctgcacgtcgcagcggatgtactgcatcgtgtcgtagatcgcgagacccgaggtcaccacgccgcccggcgagttgatgtagaaggaaatatccttcttcgggttctcgctctccaggaagagcagctgggcggtgatgaggctcgaaacattgtcctcgaccggcccggtcagaaagatgatgcgctctttcagaagacgcgaatagatgtcataggcgcgctcgccccggttggtctgctcgaccaccatcggcaccagcgaattcatgtaggtatcgagcatgtcgctcatgcgctttccgctcccctcaactgacatcaccgatcttcacaaagcccctgccgggcgcttgagacgtcacgaccgccctcgggctacgggggcggtcgtggacggtctctcggcagggcggcggatcaggcctcggacttgtccgacgcctctccggcctcaccgtcctcgtcgggatccttcatcagatcctcggcgctgacgaccttctcttcgaccttcgcctgggcgaggatgtggtcgacgaccttgtcctcgaagatcggcgcccggagcgcacgcagcgcatccggattcttctggtaatactcgatcacccgcgcttcctgaccggggaagcggcgcgcctgctcgatcagggcacggttgacctcttcgtccgccacctgaacatcgttcacgcgaccgacttctgcaaggaccagacccagacgaacccgacggagcgcaatcgcgcgatactcctcgcggacctcgtcctcggtcttttccatgctttcgaaggtctggccggtgcgggccatctcgtcggtcagctgcttccagatgccttcgaattcggcctcgagcatgccggcgggcacctcgaactcataacggccggcgagcgcatccagcagcgcacgcttcagcttctggcgcgagatctggtcgtaacggccgcggaagtcgtcgcggatggcagccttcagcgcatccaggttgtcgaggcccagcttctcggccagggcatcgtcgatgccggcggtcttcggcgccttgacttccttgacggtggtctcgaacacggcggccttgccggccaggtgctccgcaccatagtcctcggggaaggagacctcgaccttgcgctcctcgccggccttggcgccgagcagctgatcctcgaagcccgggatgaaggtgcccgagcccagagccagcgcatagccctcggcttcgccaccctggaaggcctcgccgtcgacgaagcccttgaagtcgatgaccacctggtcgccgttctcggcggcgcgatcctcgacggtctcgaactcgcgattggcggcggcgatgcgctccagcgcctcgtcgacttccttctcgtcgacctcggccgcctcgcggaccagttcgacatccgagaaatcgcccagctcgaattccggcatgatctcgacgaccatgctgtattcaagatcctggccctcgtcgaaggccgtgatctcgatcttcggctgggtggccggacgcagattgttctggtccagcacgttgcgcgaggtctcgttcaccgcctcttccagcacctcgcccatcaccgaggagccatagcgctgcttcacgaccttggccgggatcttaccgggacggaagccgggcatcttgatcgtggccgcgatctgggcgatgcgggcgtcgatcttctcgtcgatcgaagcggccggcacgacgaccttgtattcgcgcttgagcccttcggcgttggtctcggtgatctgcatcaaaacggtctcacagggtcggttgactgcggcagcacccggtgcgtcgcggggaaggaggcgcatcccgggccggccgggatcgcctccggacgaaacgccgggtgcgcgaagagacgtgatcgcgggcagcactgcaccacgacacgggcggcagccatgtggcacgaaatcacccggttacgcaagtccaatacgctgcgaaaaccggcgcccggcgggatcattcccgccgggcgccgcgcgtcggttcaggtgaaggcatggagcgtgtaagagatgcctgcgctgttccagccgcccttgacggtgatctccttgcccgagatctcgacctgatcataacctgcggacgagatcgtcgagacagacatcgtgcgcccgcgatcgctcccggtcacagcaacgacggccacgaatgcgggcgcaaaggtgagggacaccgtcttcgacgtctctccgtcaccatcataggcggtcacctggcggctcgcatttccgacggcctgattccagttcgctgccggctgttgcgcatccatatatgcggggagaaggttgtcccggacgacaagaccggcggcggctgccgtgctggtcgcgaaaccgatcagcggctcgttccgcgccatcggcgcattatcgaccgagttctccgagacgatgagaccggtgacagggccattgacccggaccacatagcgcgacggtggcgtgggatcggtctcggtatcgttgttgctcaggcagacatccttcatgacattaccccggaacaggatgttccggcaggttccgctcagggagagcacgtcccgcacgatacgcttgaagtggttgccctcgatcgagacgttgctcacgttcgagatcagcacgccgccgaggatctcgcgggtgtcgccggtcccggcctcgggcgtgccggccgcgttgtccgtcatgccgtagaagacgttgccgccgatccggatgttgtcaccgcccgatatcgcgaacaggaaattcggggcgatcgagtggatcagcaggttgtccgtgaagagcgactcgttcgccgcgccctcgaagatccggcaattggtatcgatatagttcccagagaactggatcccgtgaatacgcgatgcgttccagccgatattgcggacgagatagccgcccgaacccgcgtgaaagcggttgtcgcggatcatataggcccgcatgcccccagccagcttgttgtcgaagttcggcccggggttgaaacgtgagggatccagcgggtcggcatccggttcctgttcatccggccagtcgagctcgatcccatgggtgaacgaaaccagattgcactgggtgacgttcagcccccggcccttgatccggatcagcgtattggcccggccgagcacacaggacgtgatcttgagatcgacatcgccgttgttctcaccgtcgggcgtcaccagatagtcttcctcggcgaagatgaccaccgtgccgctttcgttctggtcgcgaccgatcatcacgaagttttcgagattgaccgaatgtgcgcggacattcatcacgatgtcggccgtgctggtcggcgccatctggatggacgcacgcgaggtcgtccccggccccgtcaaaccgaagatgcgctggccacgggtgatcacgtccacggtatcggttaccagatagcgcgacaccagcgccacgtctcggccgctgttcagggccgcctggacagccgcggtgtcattgacactgccgttacccacagccccgaaatcctcgggcgtcacgtattcagcgagcttgttcgtgagagtccgagagactccaccaagatagggggcgagataagtcacatcatctgaggacgtcggcattttccgtctccgttatctactggggaacaacgaacgcaaccgcattcatcaccagagataccgcaaaatatgcggagaaatgcctgtaatggtgctgcaacaatgcggcacatcttgatgccttgacgtcagacactggctatttatgcaccaccatccggcgagcggtatcgacgactggcttttcgatcagtagatgaaaaaagacagatccgacgagtgagagcacagccgcggccgtcaaaaacagggcgccgccagccgttccgccgggtgcggcctgcggccagatgacccgcaatacgccgatcgcaaaataatggcacagataaagggcataggaggcatcacccagaacgcgaagccatacgatcggccggacatgcccgcccttctccagcatcaccgccgccagcaggatgaccgctgcgggaaccccggcgctcagccaccgccagaggtcataggtcgtctgcggcgcaggtgtcatgaaaagagcagccgatcccaccgccagcagggtcagacccgccggacgcgacagccgcatccggccaaggaaggcgaccgcgaccaccattcccagcacgaagtcgaacaggatcggcgaggtccagacccgaaatgccgcgacatcgggacgacagatgagccccgtcgccaccagaccggccacaatggtgaccatcgccccgacgcggcgggcgggcaacacggccagcaccagagccaacagcagatagaattcaagttcgaggttcagcgaccagccgagctggaacagcggcagggccgtgcccgtctccggatgcgtccagggcaggaaagcgaaggatgccgccacatgagcggcgtccaggcccatcgtgtggaagatcgacggtaccagcatcgcgagcgccagcaccgccgcggtcacgatccagtaaggcggggcgacccgggtcagccgccgcaggaagaagtcacccggccgtacgccgtcccgcgccgtcatgcaggtcatgatgaagccgctgatcacgaagaacaggtcaacgcccttctgcccgtccagaaagacgggcaggcccctgccctgcaggtgtacggcatagctgtgactggcatggagcagcatgaccatcatggctgccgcgatgcgcagatactggacatgaaagatggtcggcaggctggtcatatccggatgcccgcggcgcgcccgaagactgaaatcagggaaaggatggtgcgggcggtgggactcgaacccacacaccttccggcacgagaacctaaatctcgcgcgtctgccaattccgccacgcccgcgaaccggcggtggatatagcacgccggcccgcagagttgccagtggtcaagacgtccggccggtgtggaaccgtctctcagtcagcgcagcagcccccgcacggcagagccggcccggacgtcatgcgtgccgccggtataggcctcgtggttgtcctcgatctcgccacgcttatagagatagttgaccatcatgccggccgactgacggacccccttggtgctgagatcggcccgccagttgatccgctccacccgcgcgccattggacaggtggaaatgcgccacgccgtcccgtgcccggccgcgggtcttctcctgggtgagatagcgagccgccagtcgcatcagcggtgccttcaaagcctcggcaagctgaggctcggccggccagtcgtgctccagcgcgaccgccaacggatgaccctccgcttctctgggcagggcggccttcagcctcgaccgttccgcctcggagatgagcccctcgccgccggccgccaggcactcgtccagccaggccctgaagccggggatcggcgacagggtcgcgaaagtcttgaggttgggcagatcatgggacaggtcctcgaccacccgcttgatcaggaaattgccgaagctgaaacccgccaggcccttctgggcattcgaaatcgaataaaagattgccgtgtcggcggcttccgggtcggctgtcggcgccgcctcgtccaatagggtgtgaacatcgccggccaaacccttgaccagggccacttccacgaagatcagcggctcgcgcggcatcttcggatggaagaaggcatagcagcgccggtcgctttccagcctgttgcgcagatccgaccacgaacggatctcgtgcaccgcctcgtattcgatcagcttttcgagcagggcggcaggcgcatcccaggtgatccgggtcaggtccaggaggccgatgtcgaacaggcccgacagtacctcgcgcagttcgtgctccatgccccgcgcggccgggtcggtgcgggccagcggcagcaggtcggcgcgcaggtcgaccaggaacttcacgccctgcggcaggctgctgaactggcgcagcaaccgcgcccgcgggctgaccagcgtcgcccgcagccgttccagcgcggccacccgcgctgtctggtctacccccgcttcacgcaccgccagcatggccgcgtccagctctcccggcggcacgtcgaattcgttggcgagcaggcccaggaaggcagtcttgcctttcggggcaagccccagatagacctgccccagttcggccgtgcgcgcccgcgccgacacctcgccgcccacggcatcaagcgactgacggatcagcgcccggatccggtccagatcctcagccggcaggtcggcgcggatcggcgcgccgatgcgcgcccgcgcctgctgcgacacctcgcgccacagccggttcagccggtccagggtccggtcgaaaaagcccggaccctcggcaccggcatcggtcgcagggggcggcgtgacggcagcttgggcgggaacgggaagtgtggtctgcagggttgtctgcactggcgtcacggtgtcggtcacggcggtcctccttcggctcttgcggccctccagaggatcaggggatgcggacctccgcgttcaagtcttgacatgcccgcgagtggtgaagctttcgtggcatctcagccgtcgagcccgaagcccagcggatcgagggtcgggtcggtgcccggcgccaccgcatccagcaccgcaggcagggcatcgggcaggtcctctgcgatcagcccgcgcggcaggcggcgggccgcggcgccatgcagccagactgccgcggccgcggcctcgaaggccggcagcccctgggccagcagaccacccgtgatgccggccagcacatcccccgccccggcggtggcaaggcgcgccggcgcgttgccgttgatcgcgatgcggcccgccgcaccgccaggtgccgcgatcacgctgtcggcccccttcagcaccaccaccgccccggtacggtcggcggcgatccgggcacgatccagccggctggcatcggacaggtcgggaaagatccgggcaaactcaccgtcatgcggcgtcagcaccacccgcgccccgtcgccggtcacttcgcggatctggtcgaacagcaggtcgggcgtcgccgcaaaggccgtcagcgcatcggcatccagtaccgcggccggcagccgggccagtgccctgcgcacccagtcgcgagtcagcgcatccaccccctgccccggccccagcacggccgccgccaccttgcgatcgcggagcagctgctcgaaggcttcaggggtcggcgccacccgggtcatcaccgcagggtcggcgccggcgtagatggagagcgcatccgacaggcaggcgatcgtcaccagcccggccccggcccgcagccccgcccgggccgcaagccgcgctgcccccgccgtctcgggcgggccgccggccaccaccagatggccgcgccggtatttatggtccgaggcgacgggcgcgcccagggcgtggcgccagagcgacggccggttgagcatggtcaccggcgcaatctcgcgcagcacgccgtcctggatgccgatatcggcgatcaccagccggccacgcagggcgcggcccggcatcagccaatggccgggcttgggccggaagaacgacacggtcaacatggcgggcgccgccatgcccatcaccgcgccgtcatcccccgacacgccgctcggcacatcgaccgcgaccaccgccgccggcgaggcggcgagcgaggccagaagatcggccacctccccctcgatcggccgcgacaacccggccccgaacagcgcatcgatcaccaccggtggcgccgtctcgtcgggcgcggccgcaaaacgggcagctgcctcagaaatcggcagcacgctgcccatccactgatcagcggccagacgggcatcgccccgaagcgccccgcgtgccaccgtcgacgccacctccaccggccaaccggccgtggcgagatgccgggcggccacccagccatcgccgccgttattgccgggaccggccagcacgagaacacgcctcggttgcggtccaaggccagccatcacctcctgcgccacggctgccccggccgtttccatcagcgtgatgccggcggtgccaccgacgatagtggcctggtcggcgcggcccatctcggcacaggtcaacagctcgtggctcatggctcgggggtccttccggcgatcggcgacagccgcacggacaaggcccgtacggcacgccccgcatcttcgacgtgcgggccggctttgacaagaatcctgccccacacctaaagttcggaatgtcacactgcccgacatggaccccaatcacccccggaggccctggagacgatggcgaccacaccgccctggagcgtgaaaggcgtcgaccgagacgcccgcgacatcgccaaacgcgccgcccaggcgtccgggcagacgctcggcatctggctcgccgaggcgatccgtgccttcgccgaagcccaggccgttcatgccgcagagagcaccagttggggggatcccgccgccccggcgccggccgccgcagcggcagcaccggtggatgacggccgcatcgccgagatcgaagagcggctcgcccggctggaagcggccctgaacgagcatcgcgagcggtcggaacacgccctggccgatctcgcccgcggtttcgtcgctctggccgagaaacgcagcgcaccgcctgccggctgatcgccgccgtcatgcgcatcctctgctggaatctgaagcgccccgacggctgccgcctcagaggcatcgccgaacgactgcgggatctgggggtggagctgctgatggcgcaggaaacccggcctggggacggtccggcgctcggccggctgctgggcggaacgtcggccttcaccgccgccttcccgctccgccagagcgctgaaggccatctcctctggcggcggcatggtccggtggggccggttcagccgttgagtatcggtggctggccctggccgcgcgtggcgcagcttttccgccttgtgcccgatgggccggtcgccgccaatctgcagctgtcccatggccccctcgcccgtcggcgggagctgggtgtggtggcgggccaccgccctgccctgatcgcaggcgacctcaactggcccgaagccctgcgcctgcccgggtggcacgatgccacccccatcggtggcagcttccgcctgggtccgctcaggcttcgtctcgaccgggtgctggttgccgacaccctgccgcagccgtcggtccgcatcctgccgcatgacggcctctccgaccatgacgccctgctgatcgacctgcccgtctgagccgtgcgtcgttcggtggccggccgcctgccccgaaaagacgaaaggcgcgggccccaagggatccgcgcctttctcaagtctttgtccgggcctcgacccccacgccgttctgaacggcaagagggggagtggggcgagtgatgggatttgaacccacggcctccagagccacaatctggcgctctaaccaactgagctacacccgccaccggagtgccgcttctctaatacgccagcccgtggcgggtcaagcggtttgtgaagcggcgccctgagtttttagctcaggcgctgcgggcctgctggaagccaccggcggcaaagaagcgctccagccgggcaaccgcttcttcgagaacgctttcccgcttgcagaagcagaatcggacgaagttgcggatgtcgcccgcctgatagaaggcactgaacggcagacaggtcaccccggcctccaccgtcagacggcggctgaactccacgtcatccatgtcgccgaccagcggccggatatcggcgccgatgaaataggtgccttccgccgccagcacatcgaaccccacccggcgcagcccggccgagagcagatcgcgcttggcggcgagatcggccgccagaccgtcgaaatagctgcggtccatggtcaggccatgggcgaccgcccgctggagattgggggcggtggtgaaagtcaggaactgatgcgcccggccgagggcggcggcgatcggtgcgtcggcgaccagatagccgaccttccagccggtgagcgaaaaggtcttgccggcagagccgacccggacgctacgctcgcgcatgcccggcagggtcatcatcggccggtgggcccgaccgtcgaaaaccagatgctcgtgcacctcgtcacagaccacgaccgcgttgtgcgccttgaccagatcggccaggaaggtgaggtcgtcgtcgctgaacaccttgccggtcgggttcatcggcgaattcatcagcagcatgcgggtcttgggcccgaaggcggccgtcagcgcctcgcgcggcagttgccagtgcggcggctccacccgcaccagcttcggcaccgcgcccgccagctgcacgatcgggagatagctgtcgtagagcggctcgatcagcacgacctcgtcgccggggttgagcaggcccagcagggccgccgccagggcctcggtcgcccccgatgtcacgatcacctcgcgcatcgggtccacctcgatgccgtagaagcggtggtcatgctcggccaccgcccggcgcagctcaggaatccccgccatcggcggatactggttgccgccggccataagggcgtcggcggcgacgcgccgcacctcctcgggcccttcccagtcggggaagccctggccgagattgacggccccgtgctcttgcgcaagcgcgctcatcacggtgaagatggtggtgccatagccggagaggatctgattggcgaactgcacggcccgttcctgctgatgcgccgacccggatttctcaatctcgggttgggttgaatagagatgaggcccgaggatcgcagaagccgagccatccgacaaggcggccgcacagatgctggcccgactgcctgtgttttgggcagcatctgcccgtgttttagccaaagcccatggacctccgcgcgacgcctgcgcctccggccgggctggtccgtgatgtaccagtgacttgcggggtttggcacggcacgtgcaaacgttggtcggcgtgggtggtgcgcgccacctgccggtgtacggctcgggcgcgtccagcgcatgaccggcacccccgccccaggtcccgcaggtcctggccgccaggatcggcgaccggatacaggggcccggatcttccggttcatgcgcgcgactgacgagagtagccgccgagatgaagaagatcgaagccatcatcaagcccttcaagctcgacgaggtgaaggaggcgctgcacgagatcggccttcagggcatgaccgtgaccgaagccaagggtttcgggcgccagaagggtcacaccgagctgtatcgtggtgccgaatacgtcgtcgacttcctgcccaaggtgaagatcgagatcgtggtcggcgacgcccaggtcgagcgcgcgatcgaagccatccagcaggccgctcataccggccggatcggcgatggcaagatcttcgtgacgccggtggaagatgccatccgcatccgcaccggtgagcgcggcaacgacgccctctgaccggttctgcggggtaccgggcctgtgccggactgagcggcgcggccatggctgccctgcgacgagatcgccattgatccgcaccgccgccggtggtgcactcacgagactgaaaaagctcggccccgcccccgcagacgcctgacggcgggccgaccggtcggtatgacggatcatccggggacacggtggtccgcatgccgcagtccaggcaggcccgtcaacaggcaggccaatcaacaggcaggatagaaaatgtcggacgcgaagactgtccttcagcagatcaaagacaacgaaatcaagttcgtcgatttccgcttcaccgacccgcgcggcaagtggcagcacaccacctacttcgccgaggcggtggacgagggcaccttcactgacggcgtgatgttcgacggttcgtcgatcgccggctggaaggcgatcaacgagtcggacatgatcctgatgcccgactgcagcagcaccttcgttgatccgttcgccgcccagccgaccctggtcgtggtctgcgacgtgctcgagccgtcgaccggccagggttatgagcgcgatccgcgttcgaccgcgctgcgcgccgaggcgtacctcaagtacaccggcgtcggcgacaccgccttcttcggtcccgagctggaattcttcctgttcgacgacgtccgctttaatgtcggcatgttcggcgcctcctattcggtcgacgaactggagctgccctcgaacagcggccgcgcctatgacgagggcaacaccggccatcgtccgaaggtcaagggcggctacttccccgtcgcgccggtcgacagcatgtcggacatccgcggcgagatgctggagcagctgaaggcggtcggcatgaccccggtcctgcaccaccacgaagtggctccggcgcagaacgagctgggcaccggcttcggcaccctgaccgccaccgccgacggcgtgcagaagtataagtacgtcgtccacaacgtcgcccatgccttcggcaagtcggccaccttcatgccgaagccggtctcgggtgacaacggttcgggcatgcacacccaccagtcgatctggaaggatggcaagcccctcttcgccggctcgggctatgccgacctgtcggagatgtgcctctactacatcggcggcattatcaagcacgcgaaggcgctgaacgccttcacgaacccgtcgaccaacagctacaagcgcctgatcccgggcttcgaggcgccggtgctgctcgcctattcggcgcgcaaccgttcggcttcgatccgcatcccctatgtcgcgagcccgaagggcaagcgcatcgaggtccgcttcccggatccgaccgcgaacccctacctctcgttctcggcgatgctgatggccggcctcgacggtatcgagaacaagatccatcccggcgacgcgatggacaagaacctctacgacctcccgccggaggagctgaaggacgtcccgaccgtctgcggctcgctgcgtgaggccctggcgtctctcgacgccgaccgcgagttcctcaagaagggcgaggtcttcaccgacgcccagatcgatgcctatatcgatctgaagatggaggaagtctacgagtgggaacacaccccgcatccggtcgagttccggaactactatagcgtgtgatctccaagcgtttgatcgcgccgggctgggtcgcggatcgaggagcgggggccttcgtttcgtgaaccaccggtgacggtcgaccgacggggccgtcgtttccgccttcgggtggggacggcggccccggcgtttttaagtgcggccatggatgtcgggtgtatctgccacgccttcagcggggcgcgccgcccgtcctggcaagccagatgccaccggccaggatgaccgccccacccgccagcgccgcgggcccgggcacttcggcaaacagcagccagcccagggctgcgctgaacacgatccagacatagcgcaccgggccgagcgtcgcggcatccgccaggcgataggcctggatgttgcaggtctggcccaggatcgccgccggacccaggcataaaaaggcggtcagcatccagcccgacatcggctgccagaccagcagcgccggcagggccagcagcaggctaccgaacaggttcacgtagaacagcaccaccagccgggtttccgagcgcgccagcgtcttgatcatgatggcctcgatcgcgatcagcgcggcaccgccgagcgccaccagggccggcgccgacatggccggcgtgaagcgcaccccctctccgccggcaaagaccacgatcgcggcgccgcccagacacagcgccgccgctgcccagcgtgccggccgcacccgctctcccagcagcgtcacccccagcaccaccgtgaacagcccttccagcagaccgatcgcggcggcattggcaaccggcattgcggttgcggcatgaatggccgccatgccgcccaacccgccgcacccggcgcgaatggcatgcaggcccggctggcgtgtcgccatcgaccgccagcggccaccggcggtgacggccaccacaaccgtcgccagcccgcccagatagcgcagccacatgatctgcaacgccgggatcagcccgccggcaatcttgcccgacatgaagatcagggcgaagagtcccaccgccgtcacggcccagagaatgccctgcgcctcgacgccgatcacgggcgccgcaggtgcggtccgcctgagggttgcgccgtcgtcaccatcgatcgacatgatgccgctccattccacatccgccgcaacaggcggctcgccacggagcatcggccaggggtaccatatcggtccaatgccgttttgacggcacttcattcgtttctgatatggatgacggaagagcggagggcctcatgaaactcggcatgcgccagctcgatgcctttcaggcggtgatgacgctgggcaccgtcacctcagccgcgaatgtgctcgccacctcgcagccggcggtcacccggtcgatccgccagctggaagatgcgaccggtcttcagctcttccgccgcgtccgcggccggctggaacccacggcggatgctcgcgagctgatggagacggtccggcagagctatgccgggatcgaccgcatcgcccaggtcgcgagccagctgcgacggcgccataccggccatcttcgcgtcggctgcctgcccgccttcgcccagggcttcatcgcccggaccatcgccgacttcctggccgaccatcccaaagccagcctgtcggtcacgccgctgatgtcgtccgatgtggtccgcgccacccgcagccgcgaggtcgatatcggcatcgccgcctatgatatcgacgtcaccgggctcgacacccgcccgttcaccgactgccccgagatcgccgtggttccggcgggccatcccctcgccgaccgtcaggtcgtcgtccccgcagatctggccgggcagcccctggtgatgctgggggcgagcgacccttaccgccagcgcctcgatcgtcttctggccggtgagggcgtgacaccggcacggctggtcgaaacgccgaccagttcagcgctctgcgccatggtcgtcgaaggagtcggcgtcggcgtggtcaacccgatcaccgcgctggatttcatcgggcagggtctggtcatgctgcgccttgcggcagacctgcccttcgtcaccacccggctgcaggtcacgaccggcagcgccgacgccctggccgcggccttcatttcggccctggagctgcgacgggaccgggatctcgcggcggtggcggcagcgctcaatccggcagaggccgcggccgcccctcggcatcgaccgccacgaaggtgaagaccgcttcggtcaccagctcctcgatcggatcatcaagcccggtgcggcggcgggtcacccaggtttccagatgcaggcggatcgagctgcgccccgtgccgacgatccggcaatagacgctgaccaggtcgccgacccgcaccggcttcagaaagctcatggcgtccacggcggcggtgacgacccggccgcgggcgcgttggcccgctgcgatgcccccggcgatgtccatctgcgccatcacccagccgccgaagatgtcgccggccgggttggcgtcggccggcatggcgacggtgcgcagctccgccgcgccttccgggcggcgcggcatggtaccgggctcgtggctgcgggtcatggcgcagggctcccctcatcgatgggtgcagggccggacaggctgcagcgcaacagggccgatcctccgggcttccgccggcccgcgacgtgacatcgcccgacccgcgacgtaacatcgactgtagcccttgccggtgatccgcgcgattcctataatccgcgccatgtcagatctcttcgaaagcgacgcagccggaaccggcggcactgggtattcggcggcggacatcgaggttctcgagggtctggagccggtgcgccgccgtcccggcatgtatatcggcggcaccgacgatcgtgcactgcaccatctcgcggccgaaatcctcgacaattcgatggacgaggccgtcgccggccacgccacccggatcgaggtcgggctcaccgccgacaacacgctgatgatccgcgacaacggtcgcggcatcccggtggacccgcatccgaaatacaaggacaagtccgcgctcgaggtggtgatgaccaccctgcacgccggcggcaagttcaacggcaaggtctatgcgacttcgggcggtctgcacggcgtcgggatttcggtggtcaacgcgctgtccgaccggatggtgatcgaggtcgcgcgcgaccggaagctctgggcgcaggactattcccgcgggcgtccgcaggggccgctggtcctgaaaggggccgcacccaatcgtcgcggcaccacggtctggttccatccggatgccgagatcttcggcgatctgcgcttcaagcccgccacgctttaccggctggtgcgttccaaagcctatctgcatcgcggtgtcgaaatccgctgggcctgcgatccggcgctccttgccgccgatggcgaggtgccggccgaagaaaccctgcactttccgggcggtcttgccgatttcatggcgacgctcgtcgacggcccgaccgtcacgcccgaggccttcaccggcctggtggagagtgagggtcaggcgaagatcgactgggccatcacctggccgctcgaaggccagggcttcacctcctggtattgcaacaccgtgccgaccccgctcggcggcacacacgaactcggtcttcgctcggcgctcaccaaggcgctgcgtagctttgccgagctgtcgcagaaacaggcccgcgccgccaagcgcgcccagcagatcaccgccgacgatatcctgggtggcgcagtggtcctgctctcggtcttcattcccgatccgcagttccagggccagaccaaggaccgcctgacctcgccccaggcctcgcgcctggtggagaatgcgatccgcgaccggttcgaacactggctgaccgccaatccggccgccgccagcgacctgctcgccttcgtactcgaccgggccgaggagcgcctgcgccgcaaggaagaaaagaccgtcggccgcaagaccgccacccgtcggctgcgcctgccgggcaagcttgccgactgcacccgcgacgaggccgacggtaccgagcttttcctggtcgagggcgactcggccggcggctcggccaaacaggcccgtaaccgcgatacccaggcagttctggccctgcgcgggaaaattctgaacgtcgcctcggcctcgctcgacaagctcaagggcaaccaggaaatcaacgacatcatcctggcgctgggcagcggcaccggccgggacttcaagctggcggacctgcgttacgagcgcatcgtcatcatgaccgatgccgatgtcgacggcgcgcatatcgcctcgctgctgatgaccttcttcttccgccagatgcccgggctgatcgattccggccggctctatctggcggtgccgccgctctaccgcgtggcacgcggtggtgataccgcctatgcccgcgacgacgccgacctgaagcatctgctcgcaacccgcttcaagggggccaagaccgagatcagccgcttcaagggcctcggcgaaatgccggcacggcagttgaaagagaccaccatggcgcccgagacccgcaccctgcttcgggtcggcatcgaccagggcagccggatgctggtcgcggaacgcgtcgagaccctgatgggcaagcgacccgagaaacgtttccagttcattcaggaaaacgcccgcttcgtcacggaagcgctcgacgtctgatcatcaaggggcgatgctggcgtttcacacgacgtccgcgtcaaaccaagagcatcctgcatggccccccaacgcctgcctcatcccaccccgatgcgccgccttggcccgatgcgccgctttcgcccgatgcgcgggctggtcgccgtcgtatcacttctcgcagtcgcgggctgtgatgccgagaacgtggtggtggttgaaagcgtacgccatgcaagctgggtgtccgacaccgacatccggatgatgctcgcctatgagccgctgatggtggtggtgcgcggcgacctgcccggcctttctcgcattgcgaccgaagccgcggtcatcgacgggatcgcgaaagcggtgtcccgcagccgcaactcgctcgaaatcctggcggatgccggcaccaggccgcatatcctcgtgcggttcgatccgcccgtcgccaataccgacgaagtctgtaccgccgatctcaggggcggcgatcatgatccgggcggagaaaatgatggcgatgccgatgacgcggtgacacccgtcatcagctggcggatcagcctgtgcaattctcgatccatggtggcaacggtgacggcgcgcggcccattcgaccttcaggcaacctccccgcttgaagacatcgccgcccagagcctggttctcctgcgcgacccgcgcgagaacatccaacgcagaggcagctgaccgggccgcggccggcttccctgccggtcatgggagcctggatcaagatggatcggatcgggaccgcacgccccgtaagtgcacgccgccttcccctggtcgcgggaacgatcgccctcatcgcggcgctcgccggctgtgccggcgccggtacgacggtcgaaaacgcccgccgcgtcggctgggcaaccagccaggacgtcaccatgttcctgtcgggcagcccgccggtggtggtcgctgccggaacccctgatcaggcccggccgctggccgatgccgtcgggcgcgcggtcggtcatcccctgccggtcgcgaccacgccgccggacgggccgcatatcctgctgcgggccgatacgcagccgatcgtcctcaatgcctgcgacccggtagccgtgggccggccggccggtaccgagcgtctgcagcttgccctctgcgccgatacgggcgaccctctcggcgctgcaacggtccgtgccaacgatccggctgcccttgatcaggcgctgggtcaggccgtcatccttctgaagcagcccggcgattccggcacgcgccgcggcggcaactgacgtcgttcaagggtatccctcccatgtccgcctcacgcctgcgcgcactgtctcttgtcgccctgctggctgccccggcgctcagcgcctgtgccggcatggctctgacgcggatcgagccgcctttcgtcggcagcttctacgaccgcgatgccgtggaccgtgccttccgggcgcaacccatgccggtggtggtgccgcgtccgttggcgggaatggatgcggacgcgagcggtgctgtggtcgtcgatgcactgacccgtggttatccgcgcccctccgccgggttcactctggccgatcccgccccggacagcgtgcccgccggctattatctggtcgtccagaccggcggcaacgtcacgccgcggcctgaagcctgcacggcgaaggcgctgcagatggccgatccggcaatggcccctgccccggatacggcccccaccgggccgcagcagctgggcctcgccatctgctatggcgacaccacggtcagcgccacccagggcaacctttcgatcccgacggccgatggggcgggctatgcgccgctgttccgtgccctgctgctggaagtcaccccaccgcgcaatccgaacatggacaatgactgcctcggcttctgcaacgacgcccgggcgccgatcggtccctggtggatggccggctgaacggcctgaaagacggcacaaaacaagggggaaaggcgatctcccccttgtcgctttcaacacttgcgccggatggttacagcaaccggttgcggtttgccgtctcctgaaagttccgggcggcgaccgacggatgctcacggctggctttcatgcggtgggccaatgagcgcagggcgtcggtgatgacgtcacattcacgcgacagcctggagacatgatgcgccatggcgaagatcctcaatgggtatcgacgcccgacatacgggtcagccgatggtccgggtcactgcctgccagatgacctgatgttgcatttcaagtcgccatcaaattttcaatcatgttgtccgatcataataggaataatcttgagaaaatcagatacacctctgatttagattaacaaaaatttaccctagaaatcgtgtaccggctttacgcttcgataacctctgacgggataaattgggacatcggctataacaagtgccatgcacgagacgtcggggaagtagaatggacatgacggccgctctgtcgcagacggatgaaacgtcggatcggctcgcgtttctgcgtctggatgacgcggcgcgtgccgatctcaggtccctgaagcccttcctggagaagcatcttccggaagtacttgccgccttctatgagcatctccgaaactatccggaactgggccggatgtttggcggctcgactggccaggaccgcgcccgcacggcgcagctcaaccactggctggtgatcgccgacggccggttcgacaaaacctatgtcgacagcgtccgtcggatcggccagacccacgctcgtctgggcctcgagccccgctggtatatcggcggctatgccttcatcctctcgggcatcatggagcgcctgacccgcgagatggaaagcggcctgttcggacgccgctcggaaaagctctcgcgctacggtaccgttctgatccgcgccgccatgctcgacatggattttgcgatctcggtctatctggagcgcgggcgcgccgaaaaggccgaggccctgcgccatctggtcgatgccttccgctccaccgtgggcacgatcgttgaaagcgtcggcgacgccgccggtgcgatgcgtgacagcgccagccggatggcaagcaatgccgaggccaccagcaccagcgccgaaacggtcgacatggcggccgccgatgccagccgtgcggtcggctccgccgccgcggccaccgaggaaatgagccgggccgccagcgagattgcccatcagctggagcggatgaagcagctgtcgtcggatgccgtcggccatgtcgatgccgggcggaccgcgatcaacgaactggtcggcgcggccgaaagcatcggcaagatcgtcaccctgatccgcacgatcgccgagcagaccaatctcctggccctcaacgcgaccatcgaggccgcccgtgccggagaggccggccgcggctttgccgtggtggcgaacgaggtcaagaccctggccggccagacgcagaaggcgacggaagagatcggcggccagatcgatcaggtccggtcgatcatctcccgcgtggccagcacgtcggatgccgtcgcctcggcgatcgcagcactcgacggcacaaccaccaccatcgctgccgccaccgaggaacagaccgccgccacccgcgaagtggcaagctcgaccgccgatgccgcgaccgccacccacaaggtgtcggacatcatcaccggtgtcggcaatgccgcacgcgagacgggcgtcgccgcccgccgggtggtggatgcggcctcggaactcgaccaggaatcgcaccacctgcgtaccgaagtcgaccgcttcatctccagcgtcggctgacgacgaaacacagactgtcacgagagtttcatcccctctccccccgccgccgtcctatcgtccgcgtcccctcccccgatcctgcacgcggaacggtatcatgacggcggccccctttttctcccccacctctccgctcaccctgtgcggccggcgcatgctgttggccgatggcgaaatcgcgccgggcaggctgaccctcgccgaggggcgcatcgtcgacacctcgcggcagatcggcggtgatgcgatcgatctcggcgatctgctggtggcgcccggtctgatcgacctgcacggggacgccttcgagcgtcaggtcatcgccccgccccggcgtgcattttccggtcgatctgggcctcgtcgataccgaccgccagatggcggcgctgggcatcaccacggccgcgcacggcatcacggcgtcatgggagccggggttgcgcagcctggacgcggcggaagccctgatcctggcgatccacgccctgaagccccggctgatggtcgatacccgcattcatctgcgccacgaagtcgccaatgccgcaggtgccgcacgggtcgaggcctggcttgcgggcgggctgatcgatcttctggcgctcaacgatcatctgcccgatttcgtcgccatgcgcacccggcctgcgaagctcgcggtcgtcgccggtcggtccggcctgtcgaccgacgagcttctggccaggatcgatgcgctggcggccgatcggacggaacaatgggccgcagcacgccggcttgcagccctcgcccgtgatgccggcatccccctgctgtcccatgacgacgagacgcccgaggcacgcagcgctgcccgctcgctcggtgcccgcatcgccgaattcccggtcgacatggcgacggccagagcggccgtctcggccggtgacgaggtgatggtcggtgcccctaacctgctgcgcggcaccagccacgccggacggctggatgcgcgcgacgccgtcgccgccggtgccgccaccctggtcgccagcgattacagccatgcggcactgctctcggcccccttcgtgaccgccgccacgaccgggctcggtcttgcgcgggcctggtcgctggtcgcggcagggccggcgcgtgccgcagggctcagcgaccgcggccgcctcgcgccggatctgcgcgccgatctggtcgtggtcgacgataccgatccgctggtgccgcgggtggcgctcaccatcgtcaatggccgggtgatgtatgccgatgcgacaggcgtgcgcctgctcactcgtcagatctgatcaggccgtcaggcggtcaagccagccggccatcgcagccaccgcttcggccggacgttccatcggcggcagatgtccgcaatcttcgatgacacgaagctcggccccagggattgcggccgccatctcctcggccagcggcagcggggtcagcgcgtcttcgcgcccgcagaccaccagcgttggacaggcaatccgggcgagatccgcccgcccgtccggtcgggccatgatcgcctcctgctggcgcagaaaggcgggatggccgaccctctccgccatggccatgatccgcccggtcaacgcgtcgtcggtcaaccggtcttcgtggatcagcaccggcagcaggcgcggcgtcacacccttgaaacggccgcggctcgccacgtcgatcagcgcccgacgccgcgccttctgctcttcggtatcggcccgggcggaggtatcgagcagggccaggccgatcacccggtcgggcgcctggcgcatgatctcctgcgccacatagccgcccatcgacagcccggcgagggcgaagcgcggggccatcacctcgtcgagcacccgggcggccatggcacccacgctgtcatcccgggtgaggtcggccaccgtcatgtcggcgcgctccgaaagcccatcgagaaccgatgcccagaggtcatggtcacagagcaggcccggcagcaggaccaggggcaggcggtcggacatccgtaacaacctttcggaatgtgtaacacgctcagcggatcagcggcagcaccgccttgaagcggtcatcgccggcgcggcccagccattcgaacaacaccatctcggtcgagacgatctcgacgccatgccgggccattcggtcgagggcgagcgccttgttggcgggcgcgcggcttgccaccgcatcggcgaccaccgcaagccggaagccggcgcgggcggcgtcaagcacggtctgcagcacacagacatgggcttcggtgccacagaccaccaggcgccgacgcccagacgcgatcacccggtcgcggaacgcattctcgttccaggacgagaaggtgatcttggacacgatctccgacgggtggagccggttgcggatcatgtcgaccgtcgggcccagcccctggggatactgttcggtcgccagcaccggaatgcccaacgcccgggcgccgtcgatcaggcggccggcatcggcaaccgcggcctcgccgccagaaatcgccggcatcagccgggcctgaaggtcgatcaccaccagcaggtcggcatctgcatccatcagcgcaccggccggacgggtgcggttttcggggcggcggggggagaaatcagtcaagtccttgcctcctgggggttacggccggtcgccgtgattgacttgcacgccgcggcggttatatatggcccacacatccggatatcgacaagcagatcgggcgtaccgtctcgcaatgacattcgaagatctgggcctgagtgccgaagtcctgcgggcggtcactgacgccggctacaatcagccgacccccatccaggagaaggccatcccctgggtgctccaggggcgggacgtgctcggctgcgcgcagaccggcaccggcaagacggcatccttcaccctgccgatgatcgacatcctggctcagggccgggtgcgtgcgcgcatgccgcgttcgctgatcatgacgccgacccgcgagctggcgcagcagatcgccgagaatttcaacacctacggcaagtacacgccgctgtcgatggccctgctcatcggcggcgtgtcgttctccgaccaggagaaggcgctcgacaagggcgtcgacgtgctgatcgcgacgcccggacgcctgctcgatcatttcgagcgcggccgcgtgctgctgaccgacgtccgcattctggtggtcgacgaagccgaccgtatgctcgacatgggtttcatcccggatcttgagcggatcgccagccttctgccgcagatccgccagaccctgctgttctcggcgaccatgccgcccgagattcggcgtctggccgacaagttcttgatgaaccccaaagaagtgtcggtggcgccgcagtccaccgccgcctccaccgtccgtcagctggtcgtccaggtgccgaacgagcgcgccaagcgccgcccgctcgagaccctgatgcgcaacgagccggtcggcaacggcatcattttctgcaatcgcaagcgcacggtcgcgactctctacgaggcgctgaagcgggccggccacgatgtcggcgcgctccatggcgacatgacccaggatgcgcgcaacgagacgctggccgccttccgcgacaaccggatcaagttcctgatcgcgaccgacgttgccggccgcgggctcgacatcgaacatgtcagccacgtgttcaattacgatgtgccgctggccgcggaagactatatccaccgcatcggccggaccggccgtgccggtcgcagcggcaccgcgatcatgctggtcacgcccgaggacaagaagctctacgaccgcgtggtcgccctgctgggaggcaagccgttggaagagctgagcgatctgtcggtcaaggcgccggccgaagccccggctgacgccgaaaccgaagccgcagccggcggccgcaccccccgtggtgcccgcacccgtccgcggcggcgccgcgaggccgaaggcgcagacctgccggccgaagacgtccaggccgaagaggctgcacctgcggtcgacgacgcccctgccccggctgcaaagcccgagcggcgcaagcgtcgcgcgccccgctccgtcgagagccggcctgtcgaggtcgtggaggctgaggctgccgttgatgaggtcgaggccgtcgaggaagtccctgcaccggctcctgagccccgccgtgcagccgagcgcaagcccgagcgggcccgttcgtccgagcgccgccagcgtgaagacgacacgccgctgggcttcggcaaggacattccggccttcatgctgaaatctgcccgcacgggctgaccggctgcaccaccggacgacatcgcccccggagagagtctccgggggttttttttgtggcacggcattccggcgcacggctcgacgaaaaaaccgccctggaagcacagcttccagggcggtccagtttcgaccggcgggctgtctcccggccccgccgatcgaggcccccgccatgaccggttcccggaaccggccgcagcgaggaagggcgtcaaaaatcagctggcgaggaagtcctcgatcagctgcaactggtcgggaacgttcagagccggagcatgcccgcagccgggaatgaccgcaagtctcgccttgggcccgcggcgggtcatttcttcggccgtatcctgagtcagcaggtcactggtctcaccgcgcatgaccaaggtcttggcacgaatggcatcccaggcatcccacatctcgaaatcgtctgtcgtctctgcaaaaacgcgcatgacggcagggtcataatgcacggtcaccttgccgtcatcgcggcggcgggtggaggtttcggccatctgccgccattgggcatcggtgatcgcgccatagggggcgtagatggtgcgcagataggcctccagctccagcaccgtgtcgaaaaccggtggctgggtgacgtaagaccggatccggccgaccgccaccggcgacagtgccgggccgatatcgttcaggaccagatgggtgatccggtcccgcagcgggcctgcggccagcaccatgccgatggcaccgcccatcgaggtgcccacccagcgcatccgctcgatgcccagccggtcgagcagctccaccgcgatatcggcgtaatgctccagccggtactcggcatcgggggtctttgaccacgacgacaggccgcggccgatggtgtcgggggccacgatgcggtagcgatcggcgaaatacgccgcgcaggggtcgaaatcacggccggtccgggcaaggccgtgccacatcaccaccgggtccgaccggtccttcgaccagtgcatcagatggatttcatgaccgcaggcggtcaggaattctgaggtgggattcgggggcgaggtgggatcgggggtgaaggtcatggatcagcgttccctgagtttgccgacgatgccggttgggaagaagtagaccgagagcacgaacaggatgcccagccacagcatccagcgatcggcggcgatcagctcgggcaggatcgggatgccggccagcgcctcggaggccgtgcccatcaggtcctgaagatagaactgcgccaggctgaggatcaccacgccgatcaccgcaccataaagcgtccccatgccgccgatcacgaccatcagcagcacgtcgagcatgatcgcgaaagagagcgtcgcatcggggccggtatagcgcagccagagcgcgttcagcacaccggccagcgccgccagcgccgccaccaggcacgaggcggcggtgcgatagatcaccaccctgttgcccagcgcctcggcccggaagtcgttctcgcggatggcctgaagcacccggccgaagggcgagttgaccacgcgcagcatgaacaggaacagcagcagagagacgaggaagaccaggtaataggcgatgatgcggccgttgatcttctggcccagcacctcgccgtcgaccagcttgaaggccgggctcagcagccgcgggatgctgaacgacatgccgtcctcgccgccggtcagccacgagagctgcgacgccaggatcaggaagaagctcgccaccgcaagcgtgatcatgctgaagaagatcgccctcaccctgagcgacagcaggccgatcaccgccgccaccacgatcgagagcagcacgcccgcaaccgtgccgaggcccaccgccccccagctcgggcccagcgcattcagtgagatcgcgaccccataggcgccgatgccgaagaacatggtgtgggcgaaggaaacgatgccggtatagccgagcaggatatcgtacgaggcgaccagcacgatcagcacgcagatgcgcgccgcaaccgcaagcgagcgggtgccggggaagacgaagggggcgaaggcgagacccagcagcacgaccagcagaacgatggtcaggatgcggctgcgcggatgatcgccggagatgatccagttgagcatgggcttgcctccggctcagttcttcgtcgcgggataaagcccgcggggtcgccagagcagcaccgccaccatcagcaggatgttggagccgagcgcaagcgtcggggccagatagcccatgaaattggcggtcagccccaccagcagggcgccgaggaagcagccgcccaccgagcccagcccgccgatgatcaccacgatgaacaccaggatcatgacatccgcgccgatatggacggtcaccagctcctgatagagcgcccacatcacgccacccgaggccgcaagtgccgtgccggccacgaagactccgacgaacagccggcggaccttgtagcccagcgcctcgaccatctcgcggttctcgacgcctgcgcggaccagcaggccgatgcgggtgcggttgagcgcgaaatgcatgccgatatgggcgacgaggcccagcacgcaggcgaccagccgatagcgctcgaccgcgatgtcaccaaagaagatcgagccgcgcagggtttcaggcttgggcagcgggatcggatccgggccccagatcaccgtgatcagctgttcggcgacgatcagcccgccgaccgtgatcaggatctggcgcagatgcgcgccatagacccggcgcacgatgatccgctcgaaggcgaggcccagaatgccggccaccacgcaggcgaccaggatcgagagcagcatcgcccccacatcccccagcagagagatgccgagcatgtcatggaaggggccgcccggcgccagcagcccggtcgccagataggcgccgacggccacaaaagccccatgggcgaaattcagcacatccatcaggccgaaaaccagggtgagccccgatgccatcaggaagatcatcatgcccatggcgaggccggcgaccgccagcaccatccaggtgccgggatcgatggcgatgagcggcaggaacaggatcaggccggcgagcgcgagcggggcatgccgctcgaccagtccggcggtcttgagggcgcgcgcggtcattgatgagcgtccaggctgaggccgagcaggcggcgctgaagatctccgtcatgggcgagttcgtgcatcgaacccgcatggacgacgcggccgtcatccatcaccgccaccgtgtcaccgagtgcggtcgccatgctgaaattctgttcgaccatcagaatggtcgtgtgggtcgatttgagctcgcggaaggcctggatcagatggccgatgatcgccggtgccagccccttggacggttcgtccacgatcagcagctcccgcggctccacgatcgcccgggcgatggccagcatctgcttctgcccgcccgacagattgccggccggccagttccagaacttctcaagggccggaaacagctcgtagatccaggcgaggcgcttctggtccatgggccccgaccgggcggcgagcaccatgttctcgcgtaccgtcaacccggcgaagatgcccatatcttcgggcacataggcgatgccggaagcggcgagatcggcggtatgagccctggtgatgtcgcgcccgtcgaaggtgatctgcccctgcgaggcctgccagaggcccatgatcgtgcgcagcgtggtggtcttgccggcaccgttgcggcccagcagcatggtcagtccgccgcgcggcaccaccagatccaccccctgaaggatgtgatactggccgatatgggtgtgcacgccggcaagggtgagcagggcgtcagacatgtgtggcggcccccatgcccagataggcttcctgcacgatcggcgaggcgaccacctctcgcgggtcgccatcagcgaccagatagccgttgtgcagcacgatgatccggtcggccagcgaatggaccacatccatcttgtgctccaccagcagcacggtcttggcgggatcggccttgatctcgtggatcaggtccaggatcaccggcacctcgtcgacgctcatgcccgcggtcggctcgtcgaacatgaagatcgagggctcgagcgcgatcaggatcgccacctccagcttgcgctggtcgccatgcggcagggttgcgaccacatcctcgccgcgcgcggccaggcgcacccgctccaggatctcgtcggcccgctcgatcagatgccgcccatgggcggccatcgagaagatgtcgaagccgcggccgcggcgggcctgcaccgccaggcgcacattctcgcgcaccgtgaggttgggaaacaggttggtcagctggaaggcgcggccgataccgcgccgggtgcgcccggccgcgccatgcgaggacaggtcgtggccgtcgagcagcacctcgcccgcggtcgccttcaactggccggaaatcaagttgaaataggtggtcttgccggcgccgttggggccgacgatcgcggtcagcgtgccgcggtcgaaccggcagctgacgccgttcacggcgacgtggccgccgaagcgcacggtgaggtcgcgggtttcgagcgccggcctggcgccgccctggcccgcggcggatgaagcggtcatgccgtgtccgtggatgcctgcgccgcagatggcggcgtctggtatgggaaacaactggtatgggcagccgtgggggttctgccgccgcagccgggcgaccggggttcatggaccacccgggctgcggcggaagacccgtgtgtgacggcggcgggggaagagaggcccgcacccgggggaggcatgcagaaccgccccgccccgtcacacacgatcacgggatcagcacccgctccggtcagcgcttgttgcgcaccggcacattcatttcgtcgataccgatgacacgcaccagctcggggatgccccaggcgacgttgtcgtcgaccttgatcttgaagtggtacatctcctgaagcgcctgatggtcttccttgcggaagatcatcttgcccttgggcgacatgaactccatgccttccatggccttgatcaggtcttccgtctcggtggagccggccttgcggatggcctcgaccgcagcgatgccggccgacatgccgccggcggtaaagaagtccggcggcgtgccgaagcgcttctgatgctcggtcaccagccagtcgttcaccgggttcttcggaatgtcgtaatagtaatacgtggcgccctccatgcccggcaacgccttataggcagccatggccggcaggatgttgccgccggtcgcgatcttgatgccgcgccgctcgggctccatcgccgccagcttggcaaagggcgtggaggcgccggcccagatcacgaacagcaccttgtcgccctgcacgccgtcgagcgcgtcgaagatgcgctgcgccggggcggtgaagtcggtggtgtcgcgcgggacatattcctcgtggacgatctcggcgccggtcgaggcaagcgcctcgcggaaggcggcgacgccgtcgcggccgaaggcgtaatcctgggccagcgtcgcgatcttcacgcccggcttgcccagcgccacggcgttcgagatggcatcctgcgacgagttgcgaccggtccggaagatgtagcggttccacttgtcgccggtgatcgaatccgccaccgccggctcgaccagcaggatcttctcgtattcctgcgccaccggcagcatcgccagcgcgtcgcccgaagaggtcgggccgatggcaaggtcgacctcgtcgtcgccataggcttccgccagcaccgcgcgggcgatttccggcttcagctgggtgtccttctcgatgacctcgatcttgcggccgtcgagttccatcgtgccctgggtcgcatattccaggcccatcatcagaccggtatgggtctgcttggcataggcctccagcggcccggtcttgcccgagatcagcgcgatcttgatcggatcggccgccatcgcgggcgccgtgccgatcgccgccgccgtcgctgccgcgacggccaggcgcttccagttgagcgacattggggtcagcctccctaccctgttcttggtgccctgacggctgcgctacgctcccggcgcaaccgtttcaggatagaaacagcaaggggcatgccactcatgcgacatgttcggaaagcaggcacttaccgcaacgcaacagaagatgccgcaccgcatcctgtccggctttccggacgccggagcgtccggtctgccggacacctcgccctctgtccggaattccggacgggtcagccgcgaggtcccggcagcccggcctcgatgccgtgggttgcgagtttttcgtagaattgtgcccgggaaatccccagcagtttcgccgcctgggtcttcaccccgcccgccgcggccagagcccggcggatggcatcgcgttcagccgccgccagcgcctcacgcagcggttccacggtctcggcggcactggccggcccgtccgtcgccaccggatcggcccccatcaccggatcggcccccaccaccggatcggctaccgtcgtgccgggctgcccggcggcgatcagcccgtccagatggccggcatcgatttcagcctcgtcggtcagcagcgccgcccgttccagcagattggcaagctcgcgcacattgcccggccagtcatggcgctgcagccgggcgaccgcccgatcggtcagccgacggggccggccgccctgttcgatcgccagccgttccagcagggcatcggccagcggctcgatatcgtccagccgctcgcgcagcggcggcaggcgcagcggcaatacgttcaggcggtaataaagatcggcgcggaaccggccgtcctcgaccatccggcccagatcgcggctggtggccgcaatcacccgcacatccaccgggatcacgcgattggagcccaagggctcgacctcgcgttcctgcaacaccctgagcagcttggattgcaggctgagcggcatgtcgccgatctcgtccaggaacagcgtgccgccatgggccagccggatcttgccgtcgcgcggcttgttaccggcaccggtataggcgccgggcgccacgccgaacagctccgcctccagcaggttttcggggatggcggcggtgttcacccgcaccatcggcccggcctgccgctcgctcgccgcatgcagcgcatgagccagcatctccttgccggtgccggtctcgcccagcagcagcacggtgatgtcacgctcggccgcccggcgggcctggcgcttcagcagccgcaccgcctcggaattgccgatgaactgcgagaagccgtatttggcccggcgggcatcggccagctggcggcgggcggtttccagatcgcgctgcatcccctgaaacttgtcgaccagcggcttcagcgactgcacccggtcgtagaggatcatgcccaccgcgcccgagacccggccatcctcgtccttcagcgggatgcggctgaccaccagctggcggccttcgacttcgaaaatatcgatcagatccgcgcggccgctggccaccacttcgcgcaaccggctgttgggaatgatgtcctcgaccggtcgcccttccacggggtccatgccgttccagcccaggatcgcgcggtatttgtcgttcatccagagcacggtgccggcggcatcgatcaggacggcgccttcatagagctggtcgaacagctccactgccgcgcgcgcgacccggtccctgaggcccgcctcgcgcgcggccgcggcccggcgccggcgcgccgccacgctgtcgatcagccgctccatccagcctgcatctcccccctgccggcacctggccattatggacggccatcgcccgccggaaccctggtgccaagcctaggcgcgcgttacgggcgatgcaagccgaaggcctccgctgtgcggcgactactcgcctgcacgacgcacggcacgggcaagggctgcgggaaccatgctgatatggccttcgccaggcaccaccagcagctccagatgaccggcatcgccctgcagctcgaccaggcgtacatacatgtcccggacgccgtcgatcattcgcgccatgttgcggaaagcgacacgttccggcgtatcgtccgcctccggatcctgctcggcaccaccgacggcaagcgtcagattcaatgcaggccgatcggcccgtgccgcgaaattcgcctcctcggtcagtagttcccgatcgttccaccagatcgacgggctggaggccatccagcgccggaaggtatgcggccgggtgaacgcggcgtgcagcacgaaacgtccgccgagcgaatggccgaacaggctcgcccggtcgtcgttcaccgggaaacgacggaccacctcgggacggatctcgttcagaatgacgtccagaaacgcctcgtcgccaccggtcggcactttcggtgcgcgcgtgcccatgatcgaccgtccccggggtgtcaccgccgaggtgaaatccagatagcgccgggtaagatcgaagccgatcacaccgggatagccgatcgccaccaccgcaatcggccgttcccaccctaacagcctggccgtggtaccggccacaccgaagaaggcattgccgtcgagcacatagagcaccgggaacccgcccggcggcggggtgaccggcggcaccgacacatccacccgataggtcaggccgttgcgcgccgccgtcaggtcgaaagcgtgcaggcccggcgccaccggcacggcatccgcaaccccgggtgcccccgcagccctggcgggcagcggcgtccccgagagcgcgaaggccagaacgaaagcggcggcaaagggcatcagcgggcgcagcacgacgggcatctccagcaggtcgatccgggcgcccatgggaccgcaacttggattgcgacgcaatctcattgaacgacatgccggtcaatacggatcggcaccgccgatggtgatctccagaacagccggccgccctgccccgagcaaccctggcaggccgtcccggattgcggccacggtgtcggcacggagatgctccacccccatcgacgccgccagctgatcgaaggcgatggcgggatcgtccagaaccatgccgacggcatgccctgccgcagcactctccagccccatcgccgtcgccgtccgcatcagaatgtcgtagcgccggttgttcaggatcacgaagatgaccggcagccgcagccgggcggccgtccacagcgcctgcggcgcatacatggcaccgccatcacccgtcatgcacagtaccggccggccggttgcgagtgcgacgcccgcagccgccggcatgccccagcccagcccggcgctggcgacgaaatcatgccggtcgccgatgccgccctgccagagccggcgcagccccccgatcagggccgaggcctcgttgaccacggtcacgccccgcggggccgccttcagcaccgcatcggcggcgatcatcggatgcagcggcagccggtcgcgaagcctgtcgagccgcgccgtgaagccggcatcggcgaccgccttctccgcccgccgccgcatggtgacggcggcgacgcccggccgcgccacgaccgcagagagtgcggcaaggcctgccgccggatcgccgccgaccaccagatcggccgcgacgtcgagcccgggcgccgccggatcgcgggccagctggatgacccgcatcccctgcggcagggtgggtccgggccggtagtgatagggcctgatcgccccctctcccgccagcaccgccagccgtgcgtcgccgaggatcgagcggatctccgccagatcgggcggcagcacaccacgccagcccgggtgatcggtcgggaaaagatgggcgcgcggcaccggggtcgcaaagacccggcagcccgtggcatcggcaaaggcgatcgccgccctcatcccctgcggcccggccagcgtgtccgacaccagaagcaccagatcatcggcctccgcacctgcgatcatcgacgccgcggcatcgatgtcacccgcagccggggccggcgcgggaatgcgcggcggtggcgggtcggcggcggcaagcgtcagatcgaccggcagcgacagaaagaccggccccggcggccaggcccgggccagcgcaaaggcccggcgcagcacctggccggcatcctcgggccgggtcagttcatgggcatgcttcaccaccggccgggcaatgcccaccagatcatcggccagccagggggcgcggatcagatgccggctgtcctgctggccggcgatgaccaccagcggcgtgcgcatgcgcgccgccccgatcatcgcccccatggcatggccaagcccggaagcggtgtggagatgggcgacccccaccctgccggcggcatgggcatagccgtcggccatggcgacggcgactgcctcctgaagcgccggcacatagctgagcccgggtgcgcgggcgacggcatcgagcagaggcagttcggtggaacccggattgccgaagacgtgggtaacgccctcatcctccagcaccgccgcgatcatccgcgcgaccgacctctgcccgtcccccatgtcgtctcgcccctgccgcttcgtatccgcatgatgatcgcgcatggcgcacatcattctgccgacagtcgcggcatcgcttcaagacggcagacagcaggggcgattgacgatgtctcggggtccccccgtcaggcggcgccgaggatggcctcgtcggtcacgccgaacagttcgtagcggatgttcgcgggcgcgaccccggccgcgatcaggtgccgggcctgcgccttctggaacgcccggggcccgcacatatagacatcgacctcgcgatcgggcagcagcccggcgatgcgttccgcgtcgaaacggccgaccgaatgatgggtcacgccgacgcggtccgatgcgcccgggcgctcataggcgatgtgcagatccaggccgggcgtcgcctcggccagcgcgcgcagatgggccccgaaggcatgggtttcgccgtcaatcgccgcatgggcccagatcaccggatggtctggccgcgtcgccgccagggtttccaccatggcgagcagcggcgtctggccgacaccggcacccagcagcaggatcggccgcggcgtctccgcatccaggaagaagtcgcccgccggcggcgccacctccagcaccgcgccggggcggatcgtgtcgtgcagcaggcccgagccacggccttcgggttcacgcttcaccgcgatccgccagcggccgttggcggcacgtccggccaggctgtaatggcgcagcagctgggtgccgtcaggccgggtcaggcgcagggtcagatactggccgggggcgaaatccggcagtgcccccccatcctcgggcgccagcaggaagctcttgatcacgcggctttcctcggcgaccgcctcgaccacgaagtggcggaaaccgcgccagccgcccggccgtgccgcgacctcgccggcaagcgccgcctcgcgatcgatgaacacctttgcgagcagaccataggcctcgccccaggccgccaggatcggcggtgtcgccgcatcgcccagcacgtccgaaatcgcggccagcagattggcccccaccacgtcgtactgctcgggccgaacctggacggcgacatgcttgtgggcgatgcgttccaccgcacccgccagcgcagccaggttgtcgatatgctcggcataggccagcacggccgccgccagcgcccgcggctgcgacccgtcgcgctgatgcgccggatcgaacatcgccgcgatctcgggggcggccagcaggcgctcgtagaaccgggtggtgatggcctcgccatgggtgcgcagcacgggcaccgttgccttgacgagggtaatggtcgcgtcgctcaacatgcggaactctccggaaccttcaactctggcttgggtccggtgcatgggccggatcccgcagggccgccctcccggacaaaaagctgtatatcagacgtttcttataatcgccaaggataacattcatttcatgcgaatgttattgcatggatgtcgcgccctgcaggcgcccttaccgcgtcgcgacatccgtgcttcccgtccgctgccggcctgtgccatagtccggccgatatgccgcaagctggaggttccggaaggcatgaacggcgcgcgtgtgctgatctacagccacgacagcttcgggctcggccatctgcgcagatgccgcgagattgcacacggcctggtcgggacattccccgacatgtcggtgctgatcctctcgggttcgccgatcatcggcagcttcgatttcagaacccgcaccgacttcgtccgggtgccgggtgtcatcaagctgcgcaatggcgattacacctcgctgaagctcaagatggacgtcgaccacatcctgaagctcaggggggcgatcatcgagcgcacggccgaggtgttcgagcccgacgtgttcatcgtggacaaggaaccgctgggcctgcgcggcgaggtcgcccgcacgctgaagcggctgaagcgccgcggcacccggctggtgctggggctgcgcgatgtgatggacgagcccgcccagctggcgcccgaatggaagcgcaagcgggtgctgccggcgttgcgcgacctttacgacgacatctgggtctacggcctgccggaaatccatgatccgctggaaggcatcgacctgccggcggatgtccgcgccaagatgacctttaccggctatctgcgccgcgaagcggtacgtggtgctgcatcggaacgcatccagtcgctgatcgccggcgacccgtacatcctggtcaccaccggcggcggcggtgatggcgaagagctgatcgactgggtgctgaaggcctatgaacagcacgggtccagcctgccgcaccgcgccgtgctggtgctggggccgttcatgaaccgcgaggcgcgcgaccggctgcgcgcccgggcccagaagctggacaagatcgaagcgctgaccttcgatgcgaatatcgagaccctgatggccggtgcgctgggtgtggtcgccatgggcggctacaacaccttctgcgagatcctgtcgctcgacaagcccgcggtcatcgtgccgcgcaccgagccccggctggaacagttcatccgcgccgaccgggccgagaagctggggctgacccggatgctgctcgatccgggccccgatcgcagcgccgccgccatggccgaggcgctgcagggcctcgagcgccagccccacccgtcttcggtgatgccggccggcatgctcgacgggctagatgcggtcgccgatctggtgggtgccgagttggaccggcgcggccggccccaggcccggatccgccaggtatcgggcggcggtgccggcctgcttcaggccccgcaggccgaggccgcgcccgacgaggaaacctggtccgacgaggccgatttcggggcacgacgccgtgcggcaccctgacggctggcgacccggccccggcgtgacctctgccagccatggccaacaaccgaccatcgccgtggtcctgaagggctatccccgcctgtccgagaccttcatagcccaggaaatccgggcgctggaagtggccgggctgccgcttcggctggtatcgctgcgccatcccaccgatacccgcgtccatccggtccatcgcgaaatcaccgccggggtccgctatctgccggaatatctccatcaggagccgttccgcgtgctgcgcggcctgcggcgtgccgcccgcctgccgggcttcgcccgggcccgggacgtctggctgcgcgatcttgcccgcgaccggacccgcaaccgcatccgccgcttcggccaggcggccgtgctcgctgccgagctggaagacgatgtggcgatgatctacgcccatttccttcacaccccggcctcggtcgcccgctatgccgcgatcatgcgcggcctgccctggtcggtgtcggcccatgccaaggacatctggaccagcccggattgggaaaaggccgaaaagctggcggattgcgcctgggccgtcacctgcaccgccaccaatcgcgaccatctggcgtcgctcgcccccgacggccgggtgcagctgctttatcacggcctcgacctctcgcgctttcccgatcctgggccacagccggcgggaccggacggcaccgacccggcccgcccggtcatcctggtgggcgtcggccggctggtcgagaaaaagggctgggacaccgtgctcgacgccctggccctgctgccggcggatctcgcctggcgcttcgtccatatcggcggcgggccgctcaaggaccggctgaaggatcaggccgcccgtctcggtctcgccgaccggatcgactggctgggtgcccgcgcccaggccgaggtgatcgaggcctatggccgggccgatctcttcgtgctcgccagccgcatcgcgggcgacggcgaccgcgacggcctgcccaatgttctgatggaagcccagtcccagcgcctggcggtggtggcgacgcgggtttcggccattcccgaattcatcgacgacggcgaaaacggccggctggtggcgcccgatgatgccgccggcctgtcggcggcgctcgcgtccctgatcggcgatccggcccgccgggcggcgatgggcgcggccgggcggcgcaggcttgaaggcgccttctcgctgaccggctcggtcgggccgctgatcgaccggctgcgggcggcggtggcggcgcgcggaggccgctgatgcggatcgccctctactgccccctgaaacaccccgatcatccggtgccgagcggcgaccggcggatggcccgccagatcctggccgcccttcgccatgccggccatgacaccgtgctcgcctgccgcttcggcagccgcgacggccgcggcgatcctgatcggcaggcgcggatcgcgcgcatcggcaccgccctcggccggatgctggcccgtcgctacatgcgccccgccgccgccgccgcgcgccccgaggcctggatcacctatcacctttatcacaaggcgccggatcacctggggccggtggtcgcggccgccctcgacatcccctatctggtgatcgaggcgtcggatgcgcccaaacgcgcgaccgggccctggcaggccggttttcacgccgcccgccatgcgctcgccgccgccgatctggtgatgccgatgaccaggctcgacgccgtctgcctggggcgcctgctgccggcggaccggcttcgcctgctgccgccctttctggacgatatcggcctgttccaggccgcccgtgccgatcgtgcccgggcccgtgcccggcttgccgtcgccgccgggctggatccggcgcggccctggctgctggcggtcggcatgatgcggaccggcgacaagctcgacagctaccgcgtgatcggccgcatgctcgccgatccggcgctcgccgcgacaccgcttcatctgctggtcgcaggcgacggccccgcccgggccgaggtgacggcggcactcgaacccacagccgccggccgggtgcatttcctgggggcacttgcccccgcccccctggccgcggcgatggcggcatccgatatcctggtctggccggcggtgcgcgaagcctatggcatggcgctgctcgaagcccaggcggcggggctgccggtggttgccggccgcaccggcggcgtacccgatgtggtggatgacggggtgaccggccttctggccccgccggaagacaccgccgccctcgccgtcctcacccgacggctgatcgatgaccgggagacccgcgcccggctggccgccgcggcgggccggcgtgcggccagccgcgatctggccgccgcagcagccgcactcgacgacgcgctggccgccgccgctctcaatcatgccgcacggcggccgcggccgatggaggagacgagatgaccggacctgcccgcccgaccaccggcggtatcatcctggccctgatccgccatggccgcaccgactggaacgaccagggccgcatgcagggccggcacgacctgccgctcaacgaccggggccgcgccgaggtgaccggctggcaggtgcccgccgccatcgccaccgcctatgactggtacacctcgcccctcctccgggcgcgcgagacggcggcccggctgggggcgcccggcgcccgggtggcgcccgaactggtcgaaatggcctggggcatctgggagggccggcggctggaagatctgcgccgagagcagcccgaccgcatggccctgatggaagcccagggcctggatttccgcccgcccgagggcgaaagcccgcgcgatgtccagcgccggctgaagccctggctggcggccatcggcacccatggccgcaatgtcgtggccgtcacccacaagggcgtgatccgcgcgatctatgccgcggccaccggctggccgatgctgggcaagccgccggaaaagctcgcctgggatgccacccatctgttccgggtcgacgagaccggcgccgtcgccgtgcgtcacctgaacctgaagctcgtctgaggacgccagaccacatgaccgacgccaccaccagccgcaccgatcgtccgcgcatcctgctctatgtccagcatctgctcggcatcggccatcagaagcgggcggcgaccctgacccgggcgctggaagcggccggcttcgccgtcacctatgtcagcggcggctttccggtgcgcgggctggataccggcccggccgatgtcgtccagttgccgccggcccgggcggtcgacaagttcttcaaggtgctggtcggccccgacggccaggtgatcgacgatgcctggcgcgcccggcgccgcgatcatctggtggcgatcgtcgaacgtctgcaaccggtggcggtgatcaccgaactcttccccttcggccgacgccagctcgcctcggaaatcgtgccgatggtggaagccgcgcgtgcgcttccccgcccggcgctgatcgtctcctcggtgcgcgacatcctggtcgagccgccgaaggaagagcgccgccgcgagatgctgtcccgggcgcggcactattacgatctggtcatggtccatggcgatccggcgctggtgccgttcgagcgcaccttcccgctgatggccgaggtctcggatctcgtccgctataccggttatgtcgtcgaccgggcccgcgagacggcgcccccgcccggtggcagcgcgcaggacggccgggacgaggtgctggtctccgccggcggcggcgccgtcagcgaggcgctgttccgcgccgccatcgccgcccgcgcccttacctcgcccgccctcgcccgccggcgctggcggcttctggtcggctggaacctggccgatccggtgctggacgatctcagccgggtggcggcagaggccgacgccaccggtttcgtggtggagcgtgcccgtcccgatttcgtcgccatgctgggccgcgccgccctttcgatctcacaggccggctacaacacccttctggaggtgatcgagaaccgggtgccggccgtggtggtcccctatgcgggcggacttgaaaccgaacaggggctgcgcgccggcctggtcgccgagcgcggcctggtcgaagtggtcgatgaagagaccctgaccgccgaaggcctggccgccgctgccgatcgcgccctcgcagccgaacgggactggccgcggctcgacatggacggggccgccgcctcggcacggctgctgcacgaccggctggcggccaggggatagcatcggatggctgccgatccctgggtcgatctcaccgccgaactggatgcctgggcagcggccggccgggcggcgagcttctggtggcgcgacgacgacgccaccgcgccgtcgcccgcgctcgaccggctgcttggccgcgccgaggcctgcggcgtgccgctggccctggcggtgatcccggccacggccgggcctgccctcggcgatcgcctggcggcggcgcccgccgggatccgggtgctggtccatggctggtcgcacggtaaccatgcccggcccgacaagaagaaatccgaactcgcctgcggccggccgatggcagagatgaccgccgaccttacccgtggccgcgcccgcctggacgagttgttcggtccccgcctgctgccggtcctgaccccgccctggaaccggctcccggcccccctgatccgggagctgccggcgatcggcatcaacggtctcagccggttcaaaccgcgcaagacccgcactccggcgccgggggtggtggaggtcaacacccatatcgacccgatcgactggcatggcggccgtggcttcacgggcgaggtcgcagccctgggcgccattgccgcacatctggccgcccgtcgcaccggtcgggccgatccgacggagccgaccggcctgctgacccatcatcttgtgcacgaccaggcactggatgggtttctcgaccgcctgatggcccattttgcggcccatccggccgtgatctggccggatctgcagaccgttttcgccgcctgatcccggctggtgcgacgcaacatgtcgatggtggtccacctcggcgcagaacggcttgcaaggcgcggggggcaacgggcatcctatcgacggcgcgacatggggatcgcgcaacgccgaggatgatccggaccggtgaccttttccacgacgtcgcttccgaccacgccggagactgccatggacctgaccggcaggcccgcgccggcatgcgcggtggccgctgccctgccgcggttgcgtcaccggccgggccccctgatcgccgatcttgcccgcgcggccgccggcggtgcggtgatcgccctgcccctgctggtggtcgatggcatgaacggcgtgctgcagctggccctgatcgcgctggtgctgctgttcgccgccttcgcggttcagcgcgggctcaagctcaccgaaagctggacggcggagggccatcacatcgtccgtcgcggcgccatcggccagagccggctggatctctcccgcctcagaaccttccggctggaacatttcgccccccgcaagggtgcgggctggttccgcctgcgcctggtcgacgacggcggggtgcggctcgcggccgaagacacgcttgaagacttccaccgcctcgtcgccctggccctggctgcggccgaagcccgcgccctgccgctcgacgacgtcaccacccataatctggcggcgctcggcctcgcccgggggatcgcatgagcgggcggcgccatgcctggccgcagccgcggccgctgctgtcggtgcgcgatctggtcgtgcgctttcatctgcccgaaggcccgctgaccgctgtcgacggcgtgtccttcaccatcaatccgggccggatcaccgcgctggtcggcgaaagcggctcgggcaagagcgtgctgacccaggcggtgatgggcctgctgccctccatcgcccggatcgagggcggcgccgcagtcttcaccgacccgctcgacggacaggccaccgatcttgcgacgcttgcccccaccggccggacgatgcgccggatccggggcgggcgtatcggcatgatctttcaggagccgatgagcgcattgtcgccgctgcacacgctcggcgatcagatcaccgaggcggtgcggctgcatctcaacgaagatgccgcagcggcgcgcgagatcgccgccgacatgctgcacaaggtgggcttcccgaaccccaaagccgccctcgaccgctacccgttcgaactgtcgggcggcctgcgtcagcgcggcgtgatcgccatggcgcttgccgcccggccggccctggtcatcgccgacgagccgaccacggcgctcgacgtcacgcttcaggcccagatcctgaaactgctccgcgacctgcaggacgagctgggtatgggcgtgctgctgatcacccatgatctgggggtggtctcaagcctggccgacgacatggtggtgctctatcgcggcaaggtgatggaggcgggccctgcggccgagctgatccgcaagccggaacatccctatctgaaggccctgctcggcgccgtgccgcggatcggcatggaccgcacggaacggctggtgccgctgcgcgaaatcgccctcgatccccgcctcgcggcggatgtggtggggcgtcagggcaccggcccgaaagcggccgccgacacgccgctgctcgcggtcgaggggttgaccaagcgcttcaccagccgcggcaccgggctcttcgcccgcggcggcggcagcagcgtgaccgcggtcgaccatgtctcctttaccgtcggccggggcgaaagcgtcggcctggtcggcgaaagcggctgcggcaagaccaccacctcgcgcatgctgctgggcgcgatccgtgccgatgaaggccggatcctgttccagggtgatcatgatgccgcgcccaccgacctcgccgccctcgacgacggcggctggatcccgttccgcaagcgcctgcaatacgtcttccaggatccgttccattcgctgaacccgcggatgaccgtgttcgacatcatcgccgaaccgctggagatccacggggtcggcaccgcgaaagagcgcgccgagcgggtaaaggcgctgatgaagatggtgggcctggatatccgccatctccgccgctatccgcacagcttctcgggcggccagcgtcagcgcatcggcatcgcccgctcgctggcactcggcccggaactgctcatcctggacgagccggtctcggccctcgacgtgtcggtccaggcccaggtgctgaacctgctcaaggatctgcaggatgcgctgggcctcggctatctgttcatctcccacaatctggcggtggtcgactatatgtgcgaccgcatcctggtgatgtgtgcaggccggatcgtcgaaagcgcgccccgcgaacgcctgttcgaagatgcccgccatccctataccaaggcgctgatcgccgcggtgcccgaagccgatcccgaccggccgctcgacttcgcggccctgatggatggccgcgcctcggatccggcggcctggcccgagccctggcggctggcgccgggcatgccgtcggtgatggacgaggtgacgcccggccatttcgtccgcgtggccacaagcgcggaggccgcggcatgatccgcctcacgcgtcttgccggcgtcctggccgctgcggccctgctcgccttcggcgcacccgcacgcgctgcggacggcgacgatgccgggcccgcgatgggcagcatcatcgagatgatgatctcgcccagcgcgcccatgccggcacagctgatcgagccgccggtgcttgaacagcaggtggcggagggcaagctgccgccgatggccgagcgactgcccaaggtgccggcggtcgacgatgtcgtcggccccgatctccgtcccggccgctacggcggcagctggacgatgctggtcggccggcccaaggatgtgcgcatggcgctggtctacggctatgcccggctggtgcgctacacccgcgatttctcgttcgaggccgatatcctgcgggagatagatgtccaggacgggcggatcttcaccctgcatctgcgccccggccatcgctggtccgacggcgagcccttcacggccgaagatttccgctattactgggaggatgtggtcaacaacaagaagctctatccggcgggcccgccgcgcgagcttctggtcgatggagagccgccgcgctttaccgtgatcgaccagaccaccatccgctatgaatggtcgaagcccaatccgcgcctgctgccggccatcgccgggccgctgccgctgacgctctaccggccggcgcactatctgcgccagttccacgaacgctatgccgatcccgacaagcttgcggcgatgatcgaaaagcgcaagcagtcgagctgggcggcgctgcacaaccgcatggacacggcgaccgatttcagcaatccggacttcccgaccctgcagccctggcggctgctgaccgcgccgccggcggtgcggttcctggtcgagcgcaacccctattaccaccgcatcgacctgaacggccgccagctgccctatctggaccagatggcgatcgacatcgtcgacggaaagctgatcgcggcacgggccggcaccggtgacgccctgctccaggcgcgcgggctggatttcaccgactacaccttcctgaaggcgggcgaaaagcgcgcggactataaggtatcgctgtggcggacggggcgcggggcccatctggcgctctaccccaatctcaatgcccgggatccgggctggcgggccctgttccgcgatgcgcgcttccgccgggccctgtccatgggcgtcgaccggcacgagatcgatgcggtgctctattacggcctgaccatcggcggcggcaacagcgtgctcgacgaaagcccgctgtcgcgcccgggctatcggaaggtctgggccaaccacgatgtcgaccgggccaacaagctgctcgacgatatgggtctcgacaagcgcaacgagcgtggcatccggttgatgcccgatggccggccgctggagctggtgatcgagaccgcgggtgagagcaccgagcagatggacgtgctggaactgctccacgatcagtggttgcagctcggcatcaagacctatgcgcggccgatgcagcgcgacctgttccgcaaccggatcttcgccggcgataccctgatgagcgtctggttcggcatggaagccggtctcgctaccgccgagaccgacccgtgggagctggcgccggtcagccagcaatcactgcaatggccgaaatggggccagtactttgagaccggcggccggtcgggcgaagcgcccgacatggacaagcccgatcagctgctggcgctctacaaggactggacggtggcgccgtcctcggccgaccgtgcgcggatctggcgggagatgctcgcgatcaacgccgatcaggtctacaccatttctctggtcgcgggcgtgttgcagccggtggtcgccaatcggcgcctgcgcaacctgcccgatcgggggctctacaactgggatccgggatcgcatttcggcctctaccggccggagcgtttctggctcgacaactgacgggcgcccgacgaccgatcgggctcaagatccgccgcgacagctgaggggcaccacagaaccccacggcggatccaggagggggagcaaggcaagcgatgttcgcctacatcgcgcggcggttgctgatgatgataccgacgctgatcctgatcagcatcctggtcttcgtcatcatccagttgccgcccggcgactatctgacgacgcagcttgccgagctggcagcccagggtgaggccgccagccaggccaagatcgagtttctgcgtgcggaatacgggctcgacctgccgctctgggaacagtacatccgctgggcctcgggcctgctggtcggtgatctcggctactccttcgaatatcagctgccggtggccgaggtggtcggtgatcgcctgtggctgaccatgctggtatcgttcgccaccatcatcttctcctatgccgtcgccttcccgatcggcatctatggcgccatccgccagtacagcgcgctcgaccacggcctgaccctcgtcggctttctgggcctcgccacccccaatttcctgctggccctggtgctgctctatctgtcgaacatctggttcggcacctcgatcggcgggctgatggacccggaatatctcgaccagccgctcagctgggccaagttcctgtcggtcatggagcatctctgggtgccggttgtggtgatcggcacctccaacaccgccggcatgatccgccggctgcgggccaatctgctggacgagctgcgcaagcaatacgtcaccaccgcgcgtgcgaagggcctgcatccggcgaagatcctggtcaaatatccgctgcgcatggcgctgaacccgttcatcgcggatctcggcaatgtgctgccgcaggtggtctcgggtgccgcgatcgtgtcggtggtgctgtcgctgccgaccacagggccgatgctgctgcgcgcgctgcagacccaggacatgtatctggccggatcgttcctgatgttcatggcgctgctgacggtgatcggcgtgctggtgtcggatctgctgctcgccctgctcgatccgcgcatccgcctcgacggaggacgttcgcgatgagcggccctgatcgctacatctcccacgcccccttcgaccccgttcatgacgaggtcctgaccccggcgcaggagaaatactatctcgcctcgcaatggcggctgatgttctggcggctgcgccggcacaaactcgccatggcctcgctctggttcctgggcttcatctatctggtgatgatcttcgctgaacccttgagcccctataatcccaacacccgccatatcgacaacatccatgccccgccgcagacggtgcatctgttccacaatggcgagttcgtcggccccttcgtctatggcacccgctatgcgctgaacatggacaccctcacccgcacctattccgaagaccgggtgcggccgctgccgatcggcttcttctgttcgggagagccctaccggctctgggggctgatcccgatggatatccggctggtctgcccccccaagagcggcacgctgttcctgctgggcaccgaccggctggggcgtgacatgctctcgcgggtgatcgaaggcgcgcggatctcgctgaccgtcggtctgatcggcatcaccatcagcttcgccctgggcatcctgttcggcgggctctcgggctattacggcggctgggtcgatgccggcatccagcggctgatcgaggtgatccgctccttcccggaactgcccttgtggatggcgctgtcggccgccatgccggtcacctggcatccgctctggatcttcatcggcatcaccgtgatcctgggcctgctcgactggacgggtcttgcccgggcggtgcgctcgaaacttctggcgctgcgcgaggaagactatgccaccgccgcggtggtcatgggcgcccggcccaagcgggtcatcctccgccatcttctgcccaatttcatgagccatctgatcgtctcggccacgctcaccatcccggccatgatcctgggcgagaccgcactctccttcctgggtctcggcgtgcgcgcgccgctgatctcctggggcgtgctgctcaacgatgctcaggacatcaacgtggtgacccagtatccctggctgctgctgccggtggtaccggtggtgctgacggtgctcgccttcaacttcctgggcgacgggctgcgcgacgcggccgatccgtaccagacctgaacagcctggagccccaaaaaagaacgccggccacaggatggccggcgttcttcatgtcgaaggcgggttcagcctggatcagcaggccgccatacggtcggcttcgtcgccggtcgccagcgaccgcatccgctcggggtcgagcaggcggacggcatggacgccgtccagcgagatgatgccgtcgcgcttgaaggcggcgagggtccggctgacggtctcgatcgtcaggcccagatagtcgccgatatcggtccgggtcatcggcagcggcagcgggtcgttcgcctcaccgcgtgcctccagccggtcatagaggcccagcaggaacgaggccagacgctctcgggcgctcttgcggcccagcagcagcatctgctcgcgcgagcgggcgatttcgtcctgcgcaaggctcagcagacggcggcccagaaccgggatccgctcctgcaggttttcgaaatcacggcgccgaaagcggcagaccgacacccgggtcaggctctcggcagccaggccgcccaggcggtcgtcgcccaggccaagaaaatctccgggcagcaggaagcccagaacctgggtccgcccgtccggcaggctcttatagagcttcgccgtacccgcggtgacgttgtacacatagggcgactgctcgccttcctcggcaagcagcgcatgggccggaacctcgatccgcgacacgatcgacgccaccgccgacatcgcatcatggccgagatcgccgcagaaagtcagggcacgcacgtcgcaggcatcacaatcgacacgcgcgcagctcgtgggcggctgtccggaactgggcagaaggcggctgttgttcatggctctcggaccttatcgtctgggggcgcatccgttatatgccgggcgcctttgcgggaccgttaatggaccgcgtgtttgttgcagatcaaatctatcatggctgcggacggtttcagagtgacgtttcgtcacgctccggtcccagggcattgcatgcaacgccgggctgacaccccaatcggatcatgatctggcaccggatgatgtgctaaacagggtcgccgcacccgccgcatccatcctttccggagcgccaccccgtgacccttggagatgccgtcgacgccctggttctgggcattgtcgaaggtctgaccgaattcgtgccggtctccagcaccggccatcagatcgtcgtcgccgatctgctgaatttccgcggcgacttcgccatcgccttcaacgtgatcatccagctgggtgccatcctggcagtcgtctgggaatatcgcggaaagatcgtccatgtcgtcgcgggcctgcccagcgatcgcgaggcgcagcgtttcacccgtaacctgctgatcgccttcttcccggcggtcattctggggctgctcttcgccgacatcatccaggaatatctgttcaacccgatcacggttgcaacggcgctggtgatcggcggcctgatcatcctctgggcggagaagcgggatcaccgcgtccgggcaaactccaccgaagaaatgcgctggtcggatgcgctgaagatcgggctatgtcagtgccttgcgctgatccccggtacctcgcgctccggctccaccatcatgggcgggctgattttcggcatgtcgcgcaaggcggccaccgaattctcgttcttcctcgccatcccgaccatgatcggcgccaccgtctacatgttcctcaagcacggctccaccctgcttgcgggtgatctgggcgtgctggcgatcggcttcgtcacctccttcatcttcgcgatgatcgcggtgcggggcctgctgaaattcatcggtcagcacagctatgccgtgttcgcctggtatcgcatcgccttcggcctgttcatcctggcgacctgggtgttcggctggatcgactggaccagcgtcaccgacctctgacacctcccgaaccgcccctggcggcctctccgttttcgaacggctttagcggaacctgcgcttgggatcgtgcaggttccgcttttcttttgcgagcatcacccaaggtgcattcggcatggaccaccgccggaccgcgccgtcacgccacgatgttctttcaggccggcgcgcatgacgcgtcttcggcagaaccccttcaggcgcccgcgctaacgtcgcgtcagcaggcaggccccgcatgccgatggtgaacaaccgccgggatgacgaggccgggttgaacatgctgacgtgaaaggatgcgacatgctgaggatcgatcgtgtatccccggcgctggtccggatgaccatcgacaggccgcccgccaatgcgctcaccctggatctgatccaggccctggccgacaccctcgtgcgcttcggggaagcggccgaggcaccggccgtgatactgaccggggccggtcagcgcttcttcagtgccggcggcgacatacgcgaaatcgagacgcaggcagacatcgcgctgcccagaatgcgcgtcttccaccatctgctgaccgtgctcgagaactatcgctgcccgctgctctgcgccgtaaacggctatgcggtgggcggcgcgctggaactggtgctgtacgccgactacgtcgtggcgagcgaagacgcccggttcggcttccccgaaatcaatcatggcctgcttccggcggcgaagggcatgcgtcaggcgatgaaccgcctggggcgccgggttgccgagcggctcctctattccggcgaactggtttcggcacccgaggcgcaggcgatgggcctggtcgacgaggtcgttccgtcgcaggatgtgcaggaccgggcccgcgtcgtggccgaggcccttcgtctcaaggacatgcatctgttcgccgcgatcaagcggaccttcaatgacgcgcccctcatgaccgacgcgcagctcgaagcgcgcaccctcagcgacatgcaggattatctgagccgcgcagagaccgccgcggcgcgcgaacggttcctccagcgcaaggcgaggcagacccatgattgacggcgatcatctccggcttgaattcatgacctcgcccgaggtcgcccgtgccatcgaaaacggcatgcggaccatcgtcatcccttgcggtgcggtggagcagcacgggccgcatctgaccctcagcgtcgatgccgaccatgcggaacacctggccgtcctggtggccaaagctatcggagatgcactggttgcaccgaccataagggtcggctgctcctcccatcatctcgcctttcccggcacgatctcgctgcaggacagcactttcgaaatgatctgccgggattattgcaccagcctggcgcggcacggcttcgaccgcattctcattttctcggcacatgtcggcaacttcccgccattggccggcatgctgccgcgcttgagatcggccgtgcccgcctcctgccgcgtctcggcattcaccgattccagggcctggcttgaacggtggcgtgatgccgtcgaagaagctgggggtgagccgatcagggtgggcggtcatgcggatatcgccgaaacctcgctgatgctcgatatccaccccgagcgggtgcgtaccgctaagtacgaagccggaaaaccgggtcttctgtcgcagagcgacctggaactgatgtggcgcgacgggcttgcggccgtcagcgccaacggcatcctgggcgaccccaacggatcctcggtagcgatcggcaggcactgcatcgagcggatcgccgccctcctcgtcgcgggttttgccgaagacgatccggcgtaaccgggcggatcctccgcccgccaaacaatattccgaacacccggcaaacctcgcggatcttcggcagcttctgctgcgggcttcgtgacaagcttccagtcattagaggggtattccaaacaaacccgagaaggcatcccaaaatggcagtcaagttcggcttctggtccgagcaggaaactctggtcggccagagttatgcgcgccggcttcatgagcttgtcgaggaagcggtcttcgccgagaagatgggtttcgacatcgtcagcctgtccgaacagcatgtcgcactgggcgggatttccagctccgcgcccgaggtcgtctatggctacctcgcggcggtcacgtcccggatccggctgcggccggcggtctcgctgatgccgaagaagatcaatcatgcgctccggacggcagagcgtgccgctgtcaccgacatcctgtccaacgggcgcatggagctctattgcggccgagccaacaccacgatcgcgatgcgggccttcaacgttgagcctgccgaaaccctgtcgcagatggaggaaggcatcgcgctcatccgcgaagccttcagcaaggacatcttcaccttcaacggcgagcactaccaggttccaccccgcatgctggtcccgaagccgcttcagaagccctatccgctgatgggcatcgccgcgaccagcgagcgcagccacgtctgggcggcccaccaggggctcgccgtcctcagccacacgctctatcagggctgggaggcgcaggcgaagatggtcgaagcctatcggtcggcctggcgccgggatccgaacggccccctcgaccgtccgcgcctcggcatgccagtgttcctcgggatcgctgaaaccgatcaggcggcgaaagacatctatgccgagccgctgatgcactacgcccgcatctcgaccgatgcctatccccggctcgcgaagatcgcggacgattacgcctatatgggcgaagggctggaagccctgcagcgcgcggccaccgactgggattacctcctcaacgactcggccagcctggtctgcggcagcccggatacggtcatccgtcagctggaacggttcatcgacgccggcgccgaagaaattctgttccacatcgactcggtttcgcatgcggagatcatgaaagcgatcgagctggtcggccgctatgtcattccgcacttcaatgaccggaacaatgtcgtgcgcccgacggacgagatcctcgaacagatccgcatgatgcgcaagaccggcccttcggcctgacagcctgccgaccgatctggagagtctcatgaccgacaagacctatgcaggcctgctcgtcgagaagcgtgcgagcggcgtggccgttatcaccctgaaccggcccaacattctgaatgccatcgactggccgatgcacgccgcgctggaagagctgttcgtcgacctcgacaatgacccggccgtcaaggccgtcgtgctcaccggcgcgggccgcggcttctgttcaggcggcgatcagaacgcgctcgacgacgacgtgggaacgatttccgccacccgctccgggcgtcatctcatccgcaacatgctcgaactggaggcgccgctgatcgccgccgtgaacggggttgccgtcggtcttggtgccacgctcgcactgttctgcgatgtcgtcttcgcagaacccggcgcgcgcttcgccgacacccatgtgacggccggggtggttgccggagatggcggcgcggtgatctggccgctccttctggggccggtccgggcgaaacactatctgatgaccggcgacttcatttcggcggaggacgcggcagcggccggcatgatcaacaaggtggtaccggaaggcaccgtcgtcgagcatgcgatccgctatgcagagatgctggcatccggcccacgcgacgccatcgtctggaccaaatacgccgtcaacaagctgatcaaggatcaggttcatctgaacctcgacacggcggcggcgctggaaatgctcaccttcaacagccctgagcgcaaggaggccgtggccaccttccgggagaagcgcaagcgctttgcagaaggtggctactgacatgggcggatcgcactcgttttccccggcctcgccgactgccattgccccctctgccatcctcccgtcaccaatgccgcccgacgacgcaacattgccgtcgctgcttcgtgaccgccgggacagcatgggccaggagatcgccttctttcagaagcgtgccggctcgtggcacgcctcgacctgggatgactatgcacggcaggtcgcctgcctgtcgcgcgccctcctcgatcatggcctgcagaaaggggatcacgtcgccattatcggcgacgtctcgcaggaatgggtcatcgccttcatggcgacggcctgttccggcggcgtggcggtcgggatctatttcacctcgtcgacagaggaggtggaatatttcctggaagactccggcagcacattcgtctttgttgctggtgaaaaggaactcggcatccttctgcgcagccggcaggcggcagcgctcaaaaagatcgtggtgttcgatcccacggttccgtccctcggcaacatcgtgacgctgtcgcagttctccgcgccggcttcggcctgtgccgcgctgctcgacgatcaggccggcctggcacgtcccggcgacaatgcctgcatcgtctacacctcggggacgaccggcaatcccaagggcgcgatccttacccaccggtcgctgatccagggggcggcgaccacccgaagctattgcccggccctttaccgcgacccccagcgggtggtcgtccatctcccgctctctcatgtcgtggggctcggacaggggatcgtctttcccctcatcagcaaggtaacgccctatttcggcgagaccggtgccgacttcgcgacgaccattctggacgtgaaaccgacctattggatggcgccgccacgcttctatcaacgctatgccgccgaactggtcagcaggatcaatgcatcctcgtcggcacggaagacgtcctatcactttgcgatgtcaatcgcacagaaggcccttgcggatcgccaggcggatggccccgatgatccgcttcttcaggcgcttttcgccacctgtcgcgatcagatctttctgccacttctggcggagatcgggctcgaccagctgacgtctccctataccgcgtccgcaccgatgccgccggacgtcatgaagctctggcagacatggggtgtgaatctcaaggaagcctatgggcagaccgaactggtcggggcaaacgtcgcccagatgcgcgactggtcgacgcccggcacgatcggcgtaccgatcgcggatccccgctggaagacgcgggtcgccggcgacggcgaaatgctggtcgcggggcccggcctgttcatcggctatctgaacaagcccgaggagacgcttgaggcgctccgcgacggatggcttcacacgggtgatgtcgttcaacttcgcccggatggcttgctggcgatcatcgatcgaaaaaaggagatcatcaacacctccggcggcaagtcgatcagcccggcgcagatcgagaatgaattgcggcaaagtccgtacatctcggaagcggcggtatgcggtgacgggcgcaaatacctcgtggccttgatcgaggtcgaccacatcgcgaccgccgactgggcccaaagccgcaacgaaatcatcaacacatatgcggatttctgttcgtcggaagccgtcatccgcctgatcgagggcgaagtcgccaaggcaaaccagaggctggcgcctgtcgaacagatcaagtcattccggatcctccccgaggaactgacggccgagaatggcgtgatgacggccaccagaaagaagaaacggaaggtcctgaacgaacgctacaaggaccttatcgattcgctctatgaccattccgaggactcactgatccgcggcgccctctcgaacatatgacgtgatcgaaggattgtcatgacgatgctctctcgcacctcacgccatccgtttctgtcctcgacggcagagatcatcgacgaggcgcgcaatggtcggatgttcatccttgtcgacgacgaggatcgggagaacgagggcgatctcgtcatcccggcccagatggccacgcctgacgccatcaacttcatggcgacacatggcaagggcctcatctgcctggcgctcagcaagcaacgggtcgatcagctcggcctcaaactgatgagcgccgagaacggcacgcggcacgcgacggccttcacggtctcgatcgaggcgcgcgagggtgtttccaccggcatttccgcagccgaccgggcgcggaccgtggcggtggcgatcgacgcggcccgcggccccgaacatctcgtctccccgggccacatatttcctctggtgtcccgaccgggcggcgtgctggtccgcgccgggcataccgaggcggcggtcgacgtcgcgcggttggccggcctcaaccattccggtgtgatctgcgagatcatgaaggaagacggcacgatggctcgtctcgacgatctcatcgcctttgcccgccgtcacgggctcaagatcggcacgatccgcgacctgatcgcctatcgccgccgccatgatcatgatgtcgaacgtgtcgtcacggcgaaattcgacagccgatggggtggcacgtggagcgccatcaccttccgcagcacggcgaccgggacggaagcgatcgcgctggtgaagggcgcgatcgacgcgcggccgaccctggtgcgcatgcacccgctggacatcctgtcggacgtgctgggccagaccggtgatcgcagcgatatcgtcgcccggtccatggccgacatcgccgcggaaggtcgcggcgtcatcgtgctgttcagccgcgatctgccgatgtcgcagcttcttcgggtgaagtcgggtgagccgatcgtggataagaccgagctgcgcaattatggcatcggcgcccaggttctggccgagctgggcattcacgacatgatccttctctccaattcggagcacaccccggtcgccctcaggggttatggcctgaacatcgtggagcgccggacactgccggtcgccaccgctgccccgtgaagccggttcacccgacatccggcccccatgctgaacggccgtgtccgcagtcacgatcgggtcgacagcatgtcattccatcgccttgtgggaggctcagcatgtccgcgcacgatcatgccgttctgaaacatgtggagacggcggccttcagaacgctcctcagatccgttgccgggtcggtctccatcgtggcctcgggccaggggcccgacagacgtggtctgaccgttaccgccgccacctcgctatgcgtcgagccgccgatggttctcgcctgcatcaaccgcaatgccgaggcgcatgacgtcatcctccgcaccggcgccttttcctggaacgtgctcgccgccgatcaggtccggctggcggaacgcttcgccgcgatggacggcagcaagggcgcatcgcgtttcacccccgtcgactggcacgatctggccaccggcgcgccggttcttctgcattcggtctgcagtttcgattgcaggatagaagacactctccaggtctccacacataccatcatcatgggtgcggttgtcgcgcagagccacaaccatgacaaacgccccctgatctatgccgcgggcagattcggaaccctggaatatttcgacctcgcggtcccggggaaataatccctctcccgaccctgcaccataaccgtcccgcagacaggctttccggacatctcggatccggagagagggtggcgtgcgcggtgctgatccccgccgcaccgtctcgcccaccccctccatcgccccctcctcccccactatcgcccctccccccttccgatgctgcttgtccgacactccccgccgatatggacaagccccatgccctgctcgcccacgtcacctcctccgggagcggaacgtgagcactgcgtgctgcccgataccgggttccgaccgaaaccgacccggcacaaccgcgtatgcccggtccttttggagactgcaggatgatcgaagacgcaaccacaaaggtgtcggcgccgccgctgacagccacgccgacccgccatcggcggtatgccctgacgatgctgttcctcatctacatgctgaattttgtcgatcgtcagatcgtcaatattctggcggaaccgatcaaacgggaactgggccttgcggactggcagctggggtcgttgaccgggctgtcttttgcccttttctatgcggctttggcccttccgatcgcgcgatgggcagagcgtgcgaaccgagccaggatcgtggcgctctcagcgatcatctggagccttttcacagccctctgcggcatcgcccagaacttcgcccagctgttcctcgcccgggtcggcgtcggcgtcggcgaggccggctgcacccccgcctcccagtctctgatcaccgactacacgagcagagagaagcgggcctcggcgctggccttcttttccatgggcattccggcgggttcgctggtcggcatgatggtcggcggcctgatcgcggaccagctcggctggcgcgcctccttcgccctggtcggcgtgcccggcatcattctggggcttctcgcgttttttaccctgcctgagccacgcaaatccgcctttgccgcgaaagaggtgcagacgacgccccccctcagggacgcgctgcgcgaactcggcaggaaccgcacctatatctgcctgacgatcgccatggtcgcgatgagtttcgggacctacagcaatctcggatttctgggctcccattacctgcgcaaccatgccgagggattggtcaccctggccgctgcggtcaacgacctcaccggtcttcagctgggcgccaccggctttctcggcacggcgctggggctcatcatcggcatcttcggcgcggcaggcacctggctgggtggctgggtcaccgaccgcgccgtacgccgcaacctgaatgcctatgccaccattcccgccgtggcggcgctctgcatgccctttgcgctgctcgcaacctatctcacgtcgaatacattggcggcgctctgccttctgagcctgcccatgatgctgcaatccatctattacggccccatcttcgcgacggtccaaagcctggtccgcccgcgcagccgggcaacggccaccgccatcttcctgttcttcgccaatctgatcgggcttggtctcgggccgctgtcggtgggcctgctcagcgattttctcgccccctcgctcggctccggtgatgccatccgctgggccctgatcagcactgcggtggtcttcatcgttgccgccacggcctttctggcggcgcgaaagagcatccatcaggacatcgtcagttgacgggatgatcgtcccgcaggcctcatacccgaagcagatcccgatcaggcggcctcgcctgatcgggccccttccgtgccggatacccgcgccgaccccgcgtcagtcccccacgacctccgtccggtcccgcagatatcgacgcggaggttgtcccatgtgctttctgaacatggcggtgaaagcacttggggaatcatatcccagctcctgcgagatcgcctggacggtcgcccccatcgacagccgctgaacggccatcacgatatggagctgctggcgccaccggccgaagggcatcccggtatgtttcaggaccagccgggcaaagctgcgctcgctcatcgcgaccgctgccgcccattccttcagggtcctgcgatcgtccggcgtctccagcaattgtgctgcaatacgctgtattcgtggatggctggacaccgggaaatgcagcggttccgccttcatctgcgcaagctcgtccagaatgacctgcgccagacggctcgtggggccttccagaggatagagcggcggctggttggccagatgaaagatcatctcgcgcagcatcgggttgatcgaaaacgtcgcgcaggcattcggaagcggtgaaacgcctgtggtgatgaacaggcaatatgcccggccgttgtccgacatggagacgctgtgggggatctctcccggaatccagaccgcaccattggacggaacgatacgaagcccgtcgagcgtccggcacatgaccgaaccttctgccgccaccaccagctgccccttccggtgctgatggatcggcaattcgtcgtcgtccacttcgcggcggatcaggaacgaggtgaccggccgggcaagctcgtcaggatcaagcgcggcaaagctgacacgcaggccagtgacatcccatggccgcgccaccgcctcggcgatcgtcgaggcgtccggccgtatggcacccttccgcacaatcttcggcaatattgcgccccctcacgcattccaccgcgaaacatacgcccaatttgacagtttcgcgacataaaatggcaatcccatagatcctgccaagggttggtgtcggatacactctccgatgtgcacagccggaaggcagatggaaggcgtatcgacccgaagaggtctgtccggcggtgttttccgccgtcgcgccggttctgagccaggccatccgctgtgcaaaggggagtcgccatgatgaacgggagtcaccatcatgaacacgctgacgctcgacaggacggacatcaagatcctcaacgagttgcagaaggacgctaatctgacgaatgtcgagcttgccgggcgcatcaacctgtctccgtcgccctgcctcacgcgcgtgaagaagctggagcagatgggcatcatcgagaggcgggtcacccttctgaacccgaaggcgatggggcttgaaatcaacgcctatatccaggtcacgctcgacaaacagccgcagtcggcgctggagaattttcgggagtcggtcgagcggattccggaagtgatggaatgcaactggatgaccggcgactgcgacttcctcctgcgcgtgatcctgaggaacgtcgaagaccttgaacatctgatcacgagcaagctgtcgaaaatcgagggtgtcgccaccatcaggtccaacctggttctcaaacagatcacctacaaaacggcgctgcccatcggcacatcccacacgatcatcgtccggctctgacaccgaccctgtgcgacctcgccacccggaagcgaagcggggcttgccgatcacggccggcccctcaatatcaaggcgtggcgattttcgtaggcgcgccctgcgcactcaaccatcgaaaccgggccgaaaacgtcgtaaaagggcgtgccgtcatatgcacgccccttctcaacaagccgaggccgcaggaaacccgtgaacgatcaatggcgtaagatagccgttgccccgatgatggactggaccgaccggcatgaccgctattttctgcggcagatcagccggcgggcggtgctgttcaccgagatgatcaccaccggggccctcatctacggggatgccgcccggcatctggcttacgatccgtcggaacatccggtcgtggtgcagctcggcggctcggaccccaaagatctggcgacggcggcccgtatcgccgccgatgccggctatgacgagatcaatctgaactgcggctgccccagtgatcgggtccagtccggccgcttcggtgcctgcctgatggccgagccggagctggtggcggaatgcatggccgcgatgaaggccgcggtcgacgtgccggtgacggtgaaatgccgcatcggcatcgacgaccaggacgagaccgaaaccctgttccgctttgtcgaaacggtggcatcggccggtgtcggcgtcttctacgtccatgcgcgaaaggcctggctcaaggggttgagccccaaggaaaaccgggaaattccgccgctgaactacccgctggtgcatgcgctgaagcgcgcccgcccggatcttgaaatcctgatcaatggcgggctgagcacgctcgatcaggccggggtggagatcgggggcgggctcgatggggtgatgttcggccgcgccgcctatcacgacccctatatcctggccgaggtcgatacccggttttacggcgagaccacccggatcccggatcggttcgagatcgccgagcgcatgctgccctatatcgaggccgagtgcagccgcggcaccaatctgatcgcgatcacgcgccacatgctgggcctgtttcagggcctgcccggtgcccgcgcctatcgccggtatctgagcgagaaccatgcccgcaagggggccggacccgaggttctcgtcgccgctctcgacgagatgcgccgtcgcggccgccatgccgcctgatgcttgcaggccacccatgcaacctttgcgttcttttccgcatggcgcactgcagcatcgactgccatgatgcctctgacgtgatctgtcgaggccgggtggaatgagtacagtatcgacatccgaaacagcgcccacccccttcatgcaggggctgcgcgacgccgtcccggtggcgatcacctttctgttcatcttcaccgcctatggcgccgttgcccggcaggccggtctggatgccgcggaaaccgtggcggtcaccctggcgatctttgcggcgcctgcacaattcgtgatcctggagccgctgaagcagcacgcctggatcacggttaccggcatcgccctggtggtgaacttccgcttcctgctgatgggcgcggcactggttccgcattacgggtccctgccccatcgccgggtgctgccgccgctgctcttcctctcggccagcaccttcgcgctgggctatacctgggccaatcagcatgccacccggtcggcgacagaaaagctgcgctattatgtgggggtggtcacgctgtcggtgccgctcgccgcgggcggttccgtcgcaggcttcctggccgatgacgttctgcccaccgaactttcggccctgctgctgctggtgatgccggtctacttcaccaccctgctcgccaaggcggcccggcgccgggcgccgttcgtcgccggcctcatcggcttcgtgctggtcgaccccgcggatcagctggtccccggtttcggcctgatgatcgtggcggtcaccaccgggctggtcatcgttctggtcgaagaaatcggcgcccgccgcgggagggctgcatgaccgctctgctcgactcgttgatgaccgactggcgggtctggctcgcgatcctgctcgccggcgtgatcagccatgccctccggctgctgcccttcgtggtgttgaaagcgcccgacaacgccgccgccagccccctcttccgctttttcgactatgccgccttcgccgtgctgggcgggatcatcggcagcgccctgctggcgccccaggcggggcgaccgctgatgggctatgcccatcccggcacgctggtctcggtggtggtggtggtcgaatgcttcctgatcgcccttcgcctggaccgcccgctgctgatcgtgccgatcggacttgccagccacgccctgctcacggccctgctggtcggctgacgcttgtctcacccccgcgacctgacctatgcttcgggcatggggtccggtcggccccgcccgtccgcggaaagggctgcgcccgcgaccgacgagagatatggccgatcattccgtcgccctttccctcgtccgccggcggacacggacggtaccggaaagggtttccgtgatgaccgaccggcgttctgcgcccgcagcgcggcccgaaccattccttctcgatctcgatcagcagcgtcgccaggcacgcaacctgctccgtgccgcccgggcgggcgatcccgatgcgctggcccggctgcaccgccactggcgccgtgccgaccggccagccgtgctggctgatgcgcttcacgtcatcgcccgcgagctgggcctcgcctcctggccgaagctcaaggcccatatcgcagcgctcgacgcggccggcgcggccatcgccgacgcgcaacccgtggcggatgaagccccgggcacccttcatctgcgctgcggcagcgacattcgcgacggcctgcgcctcgccggctttaccggtgatttcctggaggtctcggacccgatctgccacggccccgtacccgagggcgacgacatcatcgaggtccgcgcccgcttcatcgccggcagctatcagagcctccccgggctgaccgtggctgccgtcaccgacaagctcacccgcgaggcggaagggctcgccgcagccgcaggcggcaccaggcccgtggtgctctggatggagcatgacccttatgaccagctgatcctggcccgatgccttgccgccttcgcggcagccggccgcggcgaggggttgcagctgatcctgcgcgacggcttccccggccgggcgcgcttcatcggcctcggccagttgccgccgccggcgctgcgcctgctttgggccgagcgtcggccggtcacccgcgacatgctcgggcttggccaggcggtctgggcagccctgcgccggcccgatccgcgcgatctggcggcgattgccgccggcggcacccctgtcttgccccagatggccccggcactacaccggtatctggccgaactgcctgggctcggcgacggcctgtcgctgaccgaacgcctgacgctggagatgatcgccgaggccccggacgcgccaccgaccgccggccggttgttcggccggctgatgcgcgagaccgaccctctgccctggctgggcgacgccatgtatctcgcgatcctgcaccagcttgcacaggcccgcgatccggcgatccgccttgtcgatgccgcagacggcgacccgtatcgggcggtggtcgcactcaccggggccgggcgcgcggtgcttgccggccggcgcgatgcccttggcctcgccccgccgccgcgccagctgggcggcgtacagatcgatcccaccgcccaccactggcgctgggaccgcgaggcggagtgcgtcgtagaagccggccccgccatccgctgacggtcggacgcccgacagaaaaacggccccgcgcatcacgcgcggggccgccagacattcctgatcgttgcgaatgaacgcgcagatcaataataggcgtacttgccgttgctccacttatagaccacgtagccgggagcagccacgtcgcccttggcgtcgaagctgatattgcccagcacggtgtcaaacttcatggagtggaggttcttgttcaccggctcgaagtcgaccgacttggcggcattggcagcctgggcccaggcctgaaccgcgccataggtgtagagggtatagccctcgggatcgaaacccgattcctggaacttcgccaccacaggggccgccgcctcgttcagcttcggatccgggctgaaggtcatcagcgcgccctcgccggccgggccggtgatcgaccaccattcctcggtgaccatggcatcgcccgacatcagcaccgcgttcaggccggcttccttggcctggcgctggatcagcgccgattcggtgtgatagccgccgacatagatcaggtcgatgccctcgttcttcatcttggtgacgagggccgaatagtccttttcgccggcggtataggcctcgtacatggcctcctgcacgcccagcttgttcaggttcttcttggtctcatccgccagaccctgaccataggtggtcttgtcgtgcaggatcgcgaccttcttgcccttgaaatgctcgttgatgaaggcggcagccacctcgccctgctggtcgtcgcgaccgcaggtgcggaacacgcccgagaggccgcgttcggtcagctgcgggttggtggagcccggcgagatctggacgatgccctcgtcattgtagatgtccgacgccggaatcgacgacgacgagcaccagtggccggcgacgaagaccacgccgtccgacaccagcttattggccagcgacacggcctgcttcggatcgcaggcgtcgtcgcccaccaccagacgcagctgttcgccgttcacgccgccggcggcgttgatgtccttcaccgccatttcggcgccgttgcgcatctgggtgccgatgacggcgtactggccggtcatcgggcccgcaaccgagatcacgatctcggcctgcgccgcaccggccagcgccagcgtcgccacggcgccgagcagcgcccccttgagaccgcgattgatcgaagtcctggtcatggtctggtcgtctccctgttgacccgtgccgacgggcgatcacgcccgctcccccggcacggaaacccatctcaatcgtcctgggcgccagcgcccgggcctcaaccgccctgagccaggggccgggccggtttcagccggcagccccgcccttctcgcgccagccgaaaatcccggcgcgctcataggcccatggatactgcttcaccatcatcatcgcgttatacgcacgatagacgatcatcgcgatcgcgacgagcaccaccgcatccaccacataaccggtgaaggatatcagctcaccgtcatagagcgcgtatttcaggaaccgcgacgccgcggccagcagcatgccatagggcacggcatgccagaccggccgccaggtcatggccagcgcgcggccggtcatgtaggcgcagaagcccatcagcgccagcgtcacgccgatgaagaccggcaggctgcttccgatcacggcgtccatgaaccgttccccccatcgataccgcgcatcaatgcccgccctccagataggcccgccgcacttccggatcggccagcagcgcctggccggtgcccgaggtgacgatctggccggtggccatcacatagccgcgatgggccagtttcagcgcatggaaggcgttctgttccaccaggaagatggtgatcttctcagaggtgttgatctcgcggatgatcgaaaagatctgcttcaccaccagcggtgccagccccagcgacggctcgtcgagcagcagcagccgtgggcggctcatcagcgcccggccgatcgccagcatctgctgttcaccgcccgacagcgtgccgccgcgctgattgcgccgctccttcagccgcgggaacaggtcgaagacccgctccagatcctgcgcgaaatatttgggatcggtggtcaccgcccccagctgcaggttctcgatcaccgacatgcgcgggaagacccgccggccctcgggcgactgggcaatccccatgcgcacgatctggtgggtgtcgagaccggtgatgtcctggccgtcgaagacgatccggccggaccgcgcccgcggattgccgcagatgctcatcagcagggtcgacttgccggcgccattggcgccgatcagcgacacgatctcgccctcggccaccgacatcgacacacccttcagcgcctggatgttgccgtagaaggtttccagccccgaaatctccagcatcactgcgcctccgggctgatgccgagatcggctgcgacctcgggcggcagttcgtcatcctcttcctcgcccaaataggcgcggatgacggcggggtcgttgcgcaccgcttccggcaggccgtcggaaatcttgcggccgtaatccagcaccacgacgtggtcggaaatggtcatcaccacgctcatgtcgtgttcaatcagcagcagcccgaccccgtcacgatcacggatcgagagcagcagatcgttcagttccagcgattcccgcgggttgagacccgccgccggctcgtccagacacagcaccgccgggcgggtgcacatggcacgggcaatctccagtcggcgctgatgaccatagggcagctcgctcgccagccggtcggcatggtccatcagctccacccgccgcagccagtccacagccagttcaagggcctcggtctcgaccttacgataggatggcaggccgaacagcccggcaatggagaaggcggaagcgcgcatcagaaggttgtgctgggcgaccagcaggttttccagcaccgacaggctcgggaacagccggatgttctggaaggtgcgcgccacaccggcgcgggcgatgcggaagccgtccatccgctccagcttgcgggcgcctgccgcggtgtggagggtcagcgcccccgccgtcggccggtagaaaccggtcaggcagttgaacaccgtggtcttgccggcgccgttcgggccgatgatcgcggtgatctcgcccttggcggcggtgaagctcagatcgttcacggcggtcagcccgccgaaacgcatggtcaggtgctcgacctcgagcagcggcgccggggcggtggtcgcgcggggcgccgcggttgcggtcgtcgtcatccgatggatcctccccgcctcatccgtcgcgcccattgaggcccagcctggacctcaatcgcgagagctgcatggtcggctcgcggaaggcgagcaggccgcgcggccgccagatcatgatcagcaccatggcgaggccgaagaacagcatgcggaactgctgcagatcacgggcgagttccggcagcaggatcagcaggatggcggccagaaccacgccgacctggctgcccatgccgcccagcaccacgatcgccaggatcacggcgctttcggtgaagacgaagctctcggggctgatgaagccttggcgggtggcgaagaaggcgccggcgaagccgccgaaagtggcccccagcgcgaaggccgagagcttcacattggtgggattgatgcccagcgaccggcaggcgatctcgtcctcgcgcagggcctcccaggcgcggccgatcggcagcttgcgcatacgcagcaccaccagattggtgatcagcgccagcgccaggatcaggtagtagaggaacaccacccggtgttccgaggaataggagagcccgaacagctcgtggaaggcggtctcgccctcgccggcattgcgggtgaactcgaacccgaaaaagctcggccgcggaatgctcgcgatgccgttggggccgccggtgaaccagctccagttcagcagcaccacgcggatgatttcgccgaaccccagcgtcacgatcgccagatagtcgccgcgcagacgcagcaccggatagccgagcgcgatgccgaacgaggcagcgaacagcccggccagcggcaggcaggcccagaaggaccaaccgaaataggcgttcagcagcgcataggaataggcgccgacggcatagaaggcgacatagccgaggtcgagcagaccggccaggccgaccacgatgttgaggccccagcccagcatcacatagatcagcaccagggtggcgaggtcgaccgaggtgcggtccatgaacggcatcagcggcaggatgatcgccacgacgataccgccccagccgatgcccttcagatatttcgccacaccctggccggcatgggtgccggcgcgggcgccgccatgggccgggccgcggacccgggcccaggtggtgatggccagccggccgaagaacaccgcgacgaccgcgatgatcagccagtcccaacgcggttccaccaccacgaccgggccttcggcgacggtcttgaggcccagcatcggcagggccaggatgaaggcgacgaaggcggcgagacccgcatccttgatcgccgcgccgacgggattgggccggccggcggcaggggttccggtggtggtcgccatcagaccttctccacctcaggctggccgagcaggccggtgggccggaagatcagcaccgcaaccaggatcgagaaggccgccacgtccttgtattcggccgagaaatagccggaccagaaggcctcgatcagccccagcagcagcccgcccagcatggcgccgggcagcgagccgatgccgcccagcacggcggcggtgaaagccttcaacccggccaggaagccgatgaagaagtcgatcacaccgtaatagagcgtgaccatcagcccggccaccgcggccagcgccgcacccatcacgaaggtcagcgccaccgtccggttgacgtcgatgccgagcagcgaggccatcttcatatcctgctcgcaggcgcgctgggcgcggccgagcggcgtctgcttgatcaccagggtgaaggcggtcatcgccgccaccgtggtcagcacgatcaggatctggatgtatgagatggtgacggcgttgtcgccgaagccatggatgctgatcccgcccgagatcaccggctgcagcgccttggtgcgcgcgccttgtacgatctggacataattctgcaggaagatcgacatgccgatggccgagatcagcggcgccaggcggaaggatccgcgcagcggccgataggccacgcgctcgatcgtccagccataggcggcggtgaaggccatcgcgatcaacagcaccatcagcagggccagcggcacataggtaatgccggccatgccgagcaccgagaaggcgatcagcgagatgaaggcaccgatcatgtacacctcgccatgggcgaagttgatcatgccgatgatgccgtacaccatcgtgtagccgatggcgatcaggccatagatgccgccgagcgtgagcccgttgaccaactgctgaagaaagtagtccatgaccccccgatacggtcttggtcacggccgtcatgacgcgcagcccctgacatcatcatcccgtctgcccggctgatcgcctccgtcggacacacacgccccgcaaccggcatcccctctcccccgagagaatggccctgtgcttccggcaggtctctgacctgacccaccgtcccggtcgtctacgtggtccggacggatgacgccttccccctggtcatccgtgatcgcccgtcatgccctgcaatcgtcttgcagcccccggtgtcgaggcttctctgcgaccccccggtcgcggcctcgatcccctgtcatcgatctgtcgaaaagagtagccactggccacagggtgcggcaagccccgaatgccgctttcccgaagatttgcgcccacggcactatcgcatcgcgttccttccgggaaactcgggaggcacatgcaacttcgaacatattcgcaggtcccgtccaccatcagtggacggcggatccggccggtcggcggccccggaccgtcacgcgatgatcgaacggccgccggggcgcggaaccgtcgcgggcgccgcatcccgtgcaggtcgcgcccccgcattccggcggttgcggacataggcgagcttgtcgcgcgccagccgcgccagcgccgcctcgggcgtgccgtggggcgccatgaacgccacctcctcacccgtggccgcatccacggccgccaccctcaggaagcctgcggtcgcggtaatctccagcagaatatcggcatcggcggccatgggcggatccttcggcggatgatccggataatctggccccgcccggcctgcgacacaagtcgcaccgatacaagaacggcgccggaggaagctctccggcgccgtcggttcgaatgcctgcggaaaaggcggatcaggcgaccgcgaccccctggcggcgatcgaggccgagttcgctccagaccgagagcagcgcttcgaccagctggtccatcatcgcgtcgtcatggaaggggctgggcgtgaagcgcagccgttcggtaccgcgcggcacggtcgggtagttgatcggctggacatagatgccgtgctcgtccagcagcaggtcgctggccttcttgcacgccaccggatcccccaccatcaccggtacgatatggctgaccgacggcatcaccggcaggcccgcttcggcgagcagccgcttcagccgggccgcacgctcctgatggcggctgcgttcgaccgtgctttccttcagatgccgcacgctcgccagcgcaccgcccgcgatcgccggaggcagcgaggtcgagaagatgaagcccggcgcattgctgcggatgaaatcgaccgtcgcggccgaggcggcgacatagccgccgaccacgccgaaggccttggcgagggtgccctggatcaggtcgatccgtcccatcagctcccgcgcttcggcgacaccgccgccacgcgggccgtagaggcccacggcgtgaacctcgtcgatataggagaaggcgccatggcgttcgcagacatccaggatctccgcgatcggcgcgatgtcgccatccatcgaatagaccgattcgaaggccacgatcttgggcgccgccgggtcgacagaggcgagcttcgcctcaagatcggccgggtcattgtgccggaagatgtgccgcgccgcgccggaatgccggatgccggcgatcatcgaggcgtggttgagcgcgtcggagaacagatggcatccgggcagaccacgcgcgagagtcgaaagcgccgcctcgttggcgttgtagcccgaggtgaacagcagggccgcttccttgccgtgcagatcggcaagctcggcttccagcagcacatgcaggtggttggtgcccgaaatgttgcgtgtgccgccggcaccggcgcccatgttccgcaccgcatcctgcatggccgcaagcaccttggggtgctggcccatgcccagataatcgttgctgcaccagacgacgatgtcgcgggtcccctggggaccgtgatgggtggcgcgcgggaaagcgccggcatggcgttcgagatcggcgaagacgcggtagcggccttcgcgcttcagatcagagagcgcggcctcgaaaaacgcctgatagtccatcactaacctcacaacacgtcgtgacgcggtccgcccggcggttcgtccgtcgggctcgagacccacgtgccgggaaggcttctcccgcaggaccggttccggtcgggagaccggtcggaacgaggcgcttcctcttggctcggacacgtcacgcacccgaaccggcgtatcggccagagaccggcagtgcggcctgaaaccggcgtcgcccgaggcgtgacatgttcatgccacaaagataggccgacagcctacgcgacacaacgacgcgccgcggatgggcgcccggaaattcaggcgtcgaccggctctgccgcacccgatccgccctcgtcgcccgcgactgcgaggcggtagcgctcggtggtgcgatcaacccggcgggccagctcgcgcatgatctccaccgccatctgcggcacctgcgcgatcaactggaagaacagttccttggaaatccggagcgcgatgaccggggttgccgccaccaccgtcgcggtccggggcacgtcgcacagaatggcgatttcgccgaccacgtcgttgcggcccagatcggccactttcaacgggccgcgcggggttgccacctgcacctcggccgagccctcgacgatgatgaacaccgcatcaccgacatcgccctcggcaaacacccggtcgcccggatcgaaggtcagccgctcgctggtgaaggcgacgagcttgagcttggccggctcgatgttggcgaacatcggcacattgcgcagcacttcgacatcgcgaatcaggctcaccgtcgcctcctgccccttggcagccgggtcatcgccggcgcccattccccttgcatgcatcccacgggacgcattccccgatcgcgcaccgtcagccctcggacgtcaggcggcggaaggcgctgccttcctgatcgatctcgtccggcgtgccggtttgtgcaacccgcccgccctgcatcacgaccacacggtcgaaactccgcgccagcgccgggcgctgcagcgaccacacgatgcaatgcccggccatcgcctcgcgcaggcgctccaccagatccacctgctccagcgtgtcgacggcggaggtcgcttccgacaggaccagcagatccggccgcttgagcagcgcccgcgcgatcgccgccttctggcgctgtgcattcgacagcctggaaccgccggagcccacctggaaggccagccccgcggccatcaccacgtcgcgcagctccgcctcgtcgatcacctgggcgagcttctgccccactttgccgcgcgcctgggcctggccgtggacgatgcgtccgaacaggatgttgtcctggatggaactgcgggcatgatagcgcgtccggtcgaagaactcgatccgtgccttgaggtcgccgggtccgtgttccatcaggcgcttgcgcgcgatcaggatccgctcccgcacccgatcgtcgagcacgtccagccggtgacgggcggggatcagctgcagggccagaccgaccaggcggcgacgttcctgggcgtcgagtgcgcccacgccctcgcgctcgatacggttcagcagcgtctgataccccggcaggtcttccgacgagatgaagctgtactgctcgaagaattcatggtcgggcggcagatcggcgaagagttcgatcatcgtggcggcgatgcgccggccggcctcgaccagatctgcatccagcgcaccatcggtcagcacctcttcgacgaagggatgctcgaccagcgcctccagctcttcaccatcgccgcgcggggcgccgaacagcaggttttcggcgacactggcgttgtcgttccagcgctccacctcgaagggttcgaccagcttgcccaagccttccgtgcccagggcgtcgtggaacttctcgcggccttccagcacccgggccgcgcgctcgggctccgcctcggggtcgatccggccgcgcaggcccagtgcgaagacatcgtcgtccagccgcacgatcttcagggcttcgatcatccggcgctcgaccgcctcgatcccctcgccgccgaccgcttcgtaatcgatccagtcggcgttgatatcccattcgcaattgcccgagcgccgtgcctcgttcaggtcccgctcccacagccgcttcgcctccccgtccagctcgcgcgcgatgaccgggcgatgcttcagaccgtagagcaggttgtcggccagggcgccgttgaagaacacggtcgaggcgccgacgaaggcgatgcgccgcccgaccaccgcatcgggcaggctggccagatcctggccgccgatcgtcacccgtcccgattgcgggtcggccagacgcgccaggatcaaggccagttcgtgcttgccgctgccggcgccgccgaccacggcggtatgggcgtcgagcggcagatgcaggctcaccccttccagcagctggatttcgccctcgtcggccaggctgacgcccgagaggacgatctcacccgtgaagggctcgatcttcggcggatccgacagcagacggtcgggatcgatcatgccggcgggctcgaactgggccacgacctgctcatacttgatccgcgcgtcttccttcatctgatagtaggcaagcagttctttccaaggcgaatacagctccttataggcgctgatcaccgccaccagggcaccgaccgacagctgtcccttgatcaccagatagccgccgatggtgaagaaaaagaacggccccagctgggatatgaaattgttcaggaacttgatgaagaattttcggatatagatctcgtagcgaacccagaacacggcattcatacggttcgcaaagtccgccagctcatatgctgccgtatcgttcgatcggatctcctgaatgccagtgatcgtctcgccgatccggtcagagaccttgcgcatcagccgcacccgggtcttgcccaggttgttgaccttccgctgcagcttcgggatcagatagatctggatcggatagagtgagatcgccgccaggcccatcaacggatcctggacgaacaaaaagaccagaatggtcagcagtgtgccgccctgataggcgggggtcgcgatcgcctcggcgatgtagccgccaagcggctccacctcgctggtgatcatcggaatggtctcgccggcactggtccggcggaaatgcggcagcgggaagcgcagcacccgcatgaacaggtcatagcgcagccgccggagcatgcgctcgcccaagaggcccttgtagacgttgatgacgtatttgaaggcctggttgacgatgaccagcaacaggaagatggcgcagagcgcgaacagatattccagctgatcgaattcaaacccgaaataggtcttcgggaaatcgctaccctggatcgccttgttcaggatgaccttgggcaggtccagaaaaatatagaggaaggggaaggatgcgacggtaaggatcagaaggatgatctgatgtcgcagactatggcgaacgatatagcggaacagcgaatgttccatcgatacgcaccccttcttgttcttcttgtccgcccccacgaaggccggaatcgccccatcccggcagccgcccctccggccgccgatcagcctaagcgcagcgcaggccggccgcaagtccgacggtcggaagacggccgggagcagtgcccggatatgtcgtccgttccccccttacccccggttcctgcccccctgttcaggccgccctgttcaggcgccccccgttccgatggttgtgggggccgagaccgcaatgccatcgtcgcgtcaaggacgggttaaccatagtccgtaaagacggcccggcatcgccggggccggtgcatcacgacgcgatacgatcaggggctagaggccatgcagatttctctccggttccggggcacggcctcggtcgccgcgctcgcggttgcgctttcatccaccgtggcatccaccggggccttcgcccaggcgatcatcgacaacggcacggtgcagctcggtatcaatcccgaaggcaatctggtcgtcccgggctctgcatccacgccgatcggcctgacctatcttcccgaaaagaacaccggcggcagcttcggcgaggcgctggggcccggctgcgcctgcgaaggctggggcatcgccgatatcggcaccaccctgttcggcaaggccggtgaaagcttcggcaccgccaatatcgaccctgccagcgtcgatctgaccgtcagcggcaccggcacccatgcgagctccacaggcagcgccgcacgatcggtggtgaatgtggtagagcccggcgccgacggccgggtgctgcaggtgacccacgatttcaagccgatcgacggcgtgaagaacctgtaccaggtcgacgtcacggtgaagaacatctcggcctcggcagcgggcgaggttgcgaagctgatctatcgccgggccatggactgggatattccgcccacccagttctccgaggtcgtgaccattcagggctggccggcgaccaagctgatcgccgtcagcaacaacggctttgccgacggcaatcccaacacgccgcagggcgcgattccggcgacgggcacggtcgccaacggcaacttcaccaatggcggtccctcggaccacggcgcagtgttcgacttcgatttcggcaagctgccggtgggtgaagaggtcacgttcaccatctattacggggcggccggcaacgaggcccaggcgctggcagcgctcaaggcggtcggtgccgagatctattcgctcggcaagccctcggacggcccccacagcgacgccgacgccggcacacccaacaccttcatcttcgccttcgcgggcgtcggcgggacgccgatcggtggcggcggtggcggcagcggcgggttgaccattccctatgccaacgccttccggcagatggccttcgccatggcgcgcgaacatatgcgcctggtctcacagcgcctgaccggcctttcgcatggcggtgaagggaccgaagtgttctggggcgggcgctcgggcatgatcaccgccctcaccgccccgctcgcccagctggtctcggccgaagaggatggcggcatccagctggcccagctggcccagaatgcggccgcagcgcccgccggcaacacggcccaggcgcgcgatatgggtggtgtcgaaggtctgcgcgcctatgtcaccgcctcgtactccgtgggcgagatcgacggcacctgggccagcggtgtcacggtcgactacgacgccatcaacctggtcggcggtgtcgattacgaggtgctgcgcgacgagggcggtttcgacagcctgctgttcggcgccggtttcggctatggcgattatgacggcgagatcgacaacacccgcacccgcatcgacacccgcggctacaccgccatgctctacggctcggcgaccttcgcgaaatcggcctatgccgatctgaccctcgcccatagctggctggattacgactatcgccgcgacaccggcaccggcgacgtcaccgccacgccggatggaagggaatggggcggcacgctgcgggtcggctatgacttccggccccgcatcagccgcttttcccccacgcgctgggtgttcggacccttcgttcagggtcagtatctgaaggccgatatcgacggtttcaccgaacggggcagcggcggcgtcaccttcgaagaccagagcgcaaagtcggtgacgtcgcagctcggcatgcatgcctcggtgatgcggtcgatggattggggcgcgctgatcttctcgggccgcatggcctgggaacatgaatatgaagacggcgccgatgccgtcaccctgtcgagcggcacggcacccatcgacaaggtcgaccccgactacgcccggctggaattcggcgtcacggcgctgatcggcaacgacgtggcgctgaccgcagattatgcgacgctcgccggcgacaagtaccggaccgagcataccggtcggctgcgcctgcgcatcggcttctgagatcgcagcattgggggcgcgggggcgtcgcgacggcgggcctcagcggcggccgggcaggcgcagcccggccccgccgcgctcgcgcatcacatcctcgcggaaggcatgcagttcggccgggcggccgccggtctcgttggtcatccggccggtcggttccaccagccccgcctgcaacaccagccgccggaagttctgcttgtgcagcccgcgcccggccagggcttccaccgccgtctgcagcccggtcagggtgaaggcgggcggcatcagctcgaaaaccagcgggcggtaggcaagcttgccgcggatccgaccgatggcggtcgccaggatgcggcgatggtcgaaggccatcgcccgccccatgccccatcccttggccggcacgccgccgtcactgcccccgccgggggccgccgcgacgccgaagctgcggtcccgcaccgcttcggccaccaggcccgcctcgtagagcagctcatagcgctccagcaccatttcgtcatgccagtcggccgcctcgccggccccggcgccgaaggccagatcgacccgggcccggcgccgcacccgttcggccgaggccgcagcggcgatccaggcttccagcttcggccggatgacatcccgcaccacgggcggtatgccggcccggcgatcctcccacggaaacaggtcgtaccaggatcgccagcccgcctcggtatcggccggcggcaccgcctcgcggaccagggccagatagccgatcgacacgatccgcggccccccctgccattcccgcgggtcacggccacgatcggcaaaggtataaagctgttccacatagccgagcggcagccgggtctgcgccgtcacccaggcgcgcagaccgctttccagcgtccggtgcgcctcgggccggaacgggccggccggcagggcgtcgccatcgcccccatgcaccaccagaatgcgcgggtcatcatcggtgaccgccacgatggcagcggcaagcccgaccaccacaccgccctcgcccgggccacgcacgctggactggacgtgatgttcgaccggcggcggaaggtcggaacccgtcatggggggatgcctcgcgccagtcagccgtgcggaacccagggggccagcagatccatgcgatcatattcggcaaagccgttctgccggatgaccacggtgacccgttcgatatagtcgccgcccagttcggaatagcgggtcaggtggcgcagcagcaggccgccatccagctgttcgcccatccggcgcatcatctgacgctcggcccggaacccggcataggcgggatggctgttcagggtgcggacatagtcgatgaccgattccacgatcgtctcgtagggcttcactacgaacagcgcatcatcccaggtcatcacgccgaacagcgcattgccttcccgcgccgaccgggacgtaccccaaccggattcaagggccgcctgccccagcgccaaagaggtgggaatggcgtcgacgcgggccagcaggtcgtcgagatcggtggccttgccgcgatagaagcgggcgatctgggcgatccaggcctggtcgcgcgggctcggggtgatgcctgcccgcacatcccgcagaatggcctgaagccgcgcccgttcgcccagcacggcattgttgaccgcgacgatcgccggcagcaccgtgcccaggaaacgcgccttgcgctcatcccccatcgcggcatcgatgtcgcccggcagccggatcggcggaagcatgcttgcccgagaccgggcggccggcagcggcgtcacaaccggcctgggcgtgctcagcaccgcaacatccagcccgccttcctccacggcccacggcatggtgaccatcggcgtccggggcggcaggtggcggatcagatcagcagcaacagctgtatgaaccccggccagacctcccggcacggccatgcccagcacgcaggccagcaggcgagcacggtatcgggtcgcgatcgggcggctgtagaaatatcgcatcatgcccagatggatagccgagccgaccagtcgggtccagaggaaagcgctgccgtcctgcccgcgccctcgggcaggggatcatcacctcgatgcggcggcagggttcagcttaccggcccccagggaccggttcccacccggcatgcggtgacataggcggtatcggtgtccatcccctccagaaccgtggcgcgcagatcacggcaggagcgcaagcccctggtaccgcgttcccggccgggcgtgaccagcatcagcgctccgtcggccagggtccatctcgccgtctgggccggttccgcctcgttcaacaccatgctcaggcagcgcaaatcatgttccgacaggtgcccgtccacctcgctgccgaaaatccccggcgccgccggctccaccacctcggaagcggcacagctgccggacatctcgtcacctgctccggaggcccgggcttccacggttgcgcagggcacggcgaacgccatcagcaacaggacaaaggaccatctggggaaagggtgcataggtcaaaccagtctcagttggcacgcctcccggaatggcgggagcatcttcaggctgcaccatgacgagcggcaggtcgagcccaggcatcgtcggccgctcacccgatacgcagactcaccgggcgagcggcagctccaccgccatccgcagaccgccttccttgcgattttctgcccggatcaacccaccggccgcctcgatgttccgccggacgatccagagcccgatgccgaaattacccgcaccgggcatgcgctggctctcgtcgcggatcgagacgtagcgctcaaaaatccgctccagatcgcccggcggcacgcccgggccctgatcatcgacaagcacccgcacgcggccatcggtgacggtcgccgtcaccataacttcagtgccgggcttcgtgaagctcagcgcattgtcgagcaggttctgcatgaccgtctcgatcatgtcggcccccacccttaccgagatgttgcgatcgatccggcccaccacccggcgatcgccggtggtgcgggcattctcctggtactcgtcgacaatgtcttccagcagggcagaaaggttgagcggtgtccgcggcgggttaagcaggtcggccacagtctcctcgatgcgccgcgcggcattgaccagcacgtcgagccgctgcaccgaccgctcgatcagatccagcgagcggcggccgcgcagatcatcctcggggatcgagcgcttcagcggctcgatactctgggagatgacggcgatcggggtcttgaaggcatgggcgttctcttcggccgtgcggcgcatggtctccgccgtgccgcgcagatcgcggaccatgtcgtcgaaagaccgggccacgtcgttcagctccggcacccgattcatttccgagaaggagcgctgggtgccgggatccttgcggatccggcgggcgacgccggcaaagccgcggatattgcgccagacactggtgaacagccagagcacgaccagggccagggtcagatagaccgcaccggcgaagcggacttccggcatctgccaatagggccgggccaggctctgccccacgatcccatccgtcgcatgggcggtgatcaccacccagcagcccatggcggcatcgatcggggtcagagaggtcagaacctccacctgccccttgggattggtgtattccaccgccagcggccggccgccgccgcaggtatcggccagccggtccagaaccccggtctcgatcagctcggcgcgttcttcctgcagatagtccactggcacggcggggaccgaagcaatgtagaagaatgaattgcggttcgcctcgttcgacggccgcagcatcagcttgatcgagacatcgggctgcgccatgcgttcgatggtctggcgcacgcgcggtacggcggccgcatcgaattccgacagcagagggaccagcgcctgggcaacaagattgccctggcgctggacactgtcgagaagcagggtccgctgctgacgatccgcctcttcgaactggtcgtagaggatcatcgggacgctgaagaacacgaccagaagaataccgagcttgacggcgaaactgtcgaccgttcgtctcagcgcacgcagcagcgtcatccagccgccgcccctcagtcttccgtcgcggcggcgtcggtcgaccgcggctgctctgcatccagccagcgatagccgaagcccggatagttctcgatctggccgaaatcagggtccagatcgcggaacttctgccggatgcgcttgatgaaggtccggacgttggagcgatagccctccgacccgtcaccggccatgaatccggcgccgtggacaaggtcgtagaggtcgcgatagcgcacgtcgagcccggcgcgctccaccatgtgcagcaccatgcggaattccgtcacggtgagcggcacttcctggccgcgccaataggcacggtgggtttcgaccttaagctcgatctcgccattgcgcagcacgtccgacgcggcagccgcatcggccgcggcgcctgccgcttcgccggcctgcccctgggctgcggcttcggcccgacgcttctgcccgcccaggatcagttcgatgcgccgacgcaggatcgagaaactgcgcgacttttcgacgaaatccaccgctccgctggtcagcgcggcctcttcgtagatctgatccgacagcacggtcaggaagatcaccggaatttcgcacccgtccgagcgcaggcggcgcagcacctcgatgccgttcatctcgggcatcttccagtcgagcaggatcagtcccggtgcttcgccctcggcaagatacgacaggaagccggggccgcttggaaaatcggccacggcgaagcccgcatcgaccaggttctgggcgatggattcccggaacaggtcgtcatcgtcaacgatcgcgacgtgcagatcatccacgccggtcgtcccggccatgccgtgttcagcttcgtccgccattccggttccttgctctgatgtcggcgagacaggccttgcgcgccttctcggtatcctctgcgccccgaatcgcgagcgtcaccacccgcaactcctgtgacgtgatatccagatagaaaaacagatccgctgcacaagatccggtgcggtactgccagacggttgcggggggttcctcggccaccgaaacgggcccgcccagcagggcacgcacgcgttccggcgacaggccccgcagatcatcgggcccgacatcggggacgaccggcgtcagaagggcctgctggctttcgccggcatcgttccggctgccggagaccggctgcgcctgggccgatgacgtgttgtccggcttcgggggcggcggggccggcttttcctgcggtgtcagcagggagccgttatgcatgcccgcagccgccgcgagctgcggatcgtacacgggacccggctgcgccgtcatagccgttgacgcgaccggcgcgggtcttggcgccgcacatgcggacaacgtaagagcggccgccaacactgccgcgcctgctgcgcggcgccgtgtccggcgctcgacggaggatgccgtcacctcagcctctcgatccaggaacctggtctcgcccgaccggctccaattttctggttctcttttttatcgtcctggtcgtcggtcggacgccgatgttgcaacttacagcgccgacgtgccgtgtattctagccgaagtgcccgacgatggaacagtcaaggttgcgtgccccggcgcatttgctttgcagcccatgcaatgcaatcggcgcatccgccccaaaatgcgccatgtgcatatattgaaacccgccgtccgaatactcggcaccacgatacaacatgtcatggcagcggtccgtgacgtaaatcagcgcctgtttgccacaagtttgccgcgtgcggcgccacacgagatttcacatagtgtcggtcaagccgcgaccgcacccaaggtcgtcgcggtcggaaccggatccgcatccgggttccgctcaggagacttcacatggcgactcttcgctacacagtgttgccggccgtatctgctgccgctcttctcgccttcgttgcatcaccatcctggcaggatgccaccacgggcacgtcgtcgactttgatcagtcccgctgccgcggcggcgctggagccgccgcgcaaggccgatatcgtgaccgatgactccatggcgcagcacgaccccgccttgatgcgtctggtgggggaattgcgcgctcgccacgaactcgaccatccgcaatcggccggcccgtcgccggccggcgacaccacagccagttctaccgcggccgttgccgagacgcccgcccgcggaactgcgcccgcccgcgagacttcggccgccgcagttgcggtcaccgcagctgcggacaggcaggaaccggtgacgacacggcccacggcaaccgcaccggcagcggcaagcgagccggggctgggggaacgggttctctccgccatcggcaacctcttcgacggtgagggtgaggaccagcccgaaaccgccaactgacgagattggttcccagggggccgcaaattttcccgtgccccgggaacagcaaagacatccgtccggggtgaagcccgttccggtggcgggggccatgccggaagcgcggacggatgcggcccccgcactccacggaccaagccagtgctgaccgatccaaaactttcgggtggaagccgcatcatcgttcccggtgccgcggtttccacccgggcttttcgttatcggccggcgcgcatggtcccggagagccccacccccacgacaaccacacctgcgtgacagggaattctgcccatggccctgccgcccgccaggatccaccagctgctgccagggcgcagggccgctcgattgcgccttgtgccggcgcccgtgcagggtggcggcccgtcgcgggcactggtctcgatcagctggagcacgacacgcgggcgctggacgctttcggccgggatcgccctgcgcaacggcccgggggccgcggcccatcgtgcgcgcgccttccccgccccgctgatctgggcttttctgcgcgtcaggcttcgtccgcgtcgctggtgatccccggcacggcagcaccctgcaccgcccggccagatgacggccggtggccgccgacatgcgactggtccggatccagccgcgatgacggcaggcgatgcaccgcccggtcccccgtcgcccagacgtcgaacccgccggcaaacagccgcgtcacggccgggtccagcgcattcagcccacccgcataggcaccgaaagccggcaggaccagccggtcgcggccacagggggcgcgtccgccggcgaagcagcgccgcgacagccgccggccgcggacgcgcaggatcgccttcggatgaaaatggccgctgatctccagccgctcatccgctgcggccgcagccgcttcatgacgcagcgccacccccgcctccagcagctcgtccatcaccgttccgcccaggctcgccgccgccccatggtcgtgattgccggtgatccagatccagtcatgggcggccaccagccgcgccaggcgctgccgatccaggggatccagacgggccggcccgtcccggtcgtggaagctgtcgcccaggcagaggatccgccgggggccccaggtcgcgaccagatcttccagccggatcagggtctcaaggctgtcatagggcggcagcaactgccccttgcgggcgaaggccgatcccttctcgaaatgcagatccgccaccagcaccgtgtcccgccgcggccagatcagcgcgcccgacggatcggccagaaaggactcgccgccgagatcgatcggctgggcagtggcgcggggggcggagatcagggttacggggggcagggtcacgggcggtcatccacgggtggcgtcttcgatcagggcggcggcttcgcccagcaggtcgtcatcggcctggccgggcacgctttcgcgccccacctccagcagcagcggcaccgccagcggtgaaaccctggccaggggccggtgcaggatgcggccctgcaccgcgaccagcatgtcgttcagccggccgagatcggtcaacccgcccgccgcatcggcccaggtcgccttcagcagcacatgatcgggctgatggcggcgcagcacgtcatagatcagatcggagctgaacgtcacctgccggccggtcttctcgcgtcccggatggcgctgctcgatcagcccggcgatcaccgcgacattgcggaaggtccgccgcagcatgctcgattccgccatccaggcttccagatcctcgcccatcatgtcctggccgaacagggcatcgatccgttccggcgcatccaggctccagatcgcaatggcatagtcgttggcgacgaagcccatcggccggaagcccatccgctccatccggcgggtcagcagcatgcccagcgtctgatgggcgttgcgtccggcaaagccataggcgatcaggaaccagcggccggctcggggaaaggtctcgaccagcagcccgtcggcgcccggcagctccgaccgcagctcctgcatcgccagccattcggcgaccgccggcggcagcaggtcgcgatgggccggatcggccagcatcccccgcacccggcgggcaagcgaggccgagatcgggaagcggccgccgccataggacgggatcctggggtcgccgccgcggccgcggctgaccagcacatcggtctcgcgcagcgcctcgtaaaccagcaattcgccggcgaagacgaagctgtcgcccgggaccagcccctggacgaaccattcctcgatccgccccagcatccggccgcccatgccgcggccgccgggtttcgtcagccgcacgttcagcatcggcatctcgacgatggtgccgacattcatccggtattgtctggccgccaccggccccgccacccgccagcgcccggtctcgtcctgctcgatccgccggaagcggtcataggccctgagcgcatagccaccggtggcgacgaaatcgaccaccgcatcgaaactcgggcgatcgagtgcggcatagggcgcgctgccggtcacctcggcatacagcgcatcggcatcgaaaggcgccatgcaggccgtgcccagaacatgctgggccagaacgtcgagcgcacccggccgcggcggctcgccatccagctcgccctcggccaccgcttccagcgccgcccggcattccagcacctcgaaccggttggccggcaccagaatggccttcgatgccaggtcgagcctgtgattggcccggccgatgcgctgcaccagccgcgacacgccctttggcgcgccgatctgcatcaccagatcgaccgccgcccagtcgatgcccagatccagcgaggaggtcgccaccaccgcccttagccgcccctcggccatcgccgcctcgaccttgcgccgctgctcggccgcaaggctgccatggtgcagcgcgatcgccagcccgtcctcgttcagatgccagagttcctgaaagaccagttcggcctgggcgcgggtgttcacgaaaaccagcgtggtgccgtggtcgcggatcgcctgatagaccccggccatggcatggcgggccagatgtcccgcccagggcacccgctcgccttccgggatcagcagcgagacctctgcctgcgccgcctcgcgcccgcgcacgatcaccgcccgcggatcgacccagcgccgcaccgcttcttcatccgccaccgtcgccgacagccccaccacgcgcagccccggcgacagcgacttcaatcgggcgagccccagcgccagcagatcgccgcgtttggtgccggcgatggcgtggacctcgtcgacgatcaccgtcgccagccggccgaagatcctgggcgcatcggcgtaggacagcatcagcgccagcgattccggtgtggtcagcagcagctcgggcgggctgcggcgctggcgttcgcgggtgcgctgatcggtatcgccggtgcgcacccccacctgcagccccagccccatttcggcgatcggctgctccagattgcgggcgatatcggccgcaagcgccttcagcggcgaaatgtagatggtatccagccggcccgccacctctcccgccgccgcccgggcaaggccgggcaggaatccgcccaaggtcttgcctgcccccgtgggcgcgatcagcagcaccggcagcccggcatccgcggcggccagcatgcgcagctggtgggggtgcggggtccagccgcgcgcggcaaaccagcccgccaccgccgcaggcagcggcgcgggtggcggcaggtcggcatccggcaccagcaccggcagacggggttcatgcacgctcatggccggatagtatggtgcagcccgccccgaaggcgagcccggcatgatgccgcgggggtggacttgggcgctccgccacccaatcttggcaggagcacaaaccgggtacatccatctccgtcccgatctcctccccccagccgggatcccccatgcccgaggatatccgcctgccgcctgccgatcccgccccacccgctccgcgcggggcgggcatcgactggctggtcccctgcccggaaggtctctactgcccacccggcgatttctgggtcgacccgacccgggcgaagccgcgcgcgatcgtcacccacggccatgccgatcatgcccgccccggccatggggcggtgctggccacgcccgaaacgctggcgatcatggcggcacgcttcggcccggatcaggtgcgcggtcaaccgctcggctatggtgagcggctgacagtgggggatgtctcggtgatgctggcacctgccggccatgtcctggggtcggcccagatcgtgatcacccatcggggccggaccgcggtgatctcgggcgattacaagcgccgcgccgatcccacctgcccggctttcgagcccgtgccctgcgatctgttcatcaccgaggcgaccttcgccctgccggtcttccgccatccgccggccgcgggcgagatcgcgaaactgctgcacgggctggacgtcttccccgaccgggcgcatctggtcggcgtctacgccctgggcaaatgccagcgggtgatccggatgatccgcgatgccggctatgaccggccgatctatattcatggcgcgctggcgccgctctcggcgctctatgaagaccttggtgtgccgctcggcccgctgctgccggtggcgggacgcgcgcgcgccgatctggcaggggaactggttctggcaccgcccggcgccgtggccgatcgctgggcccggcagctgcccgatccgctggtcgcggtcgcctcgggctggatgggggtgcgccagcgggcgaagcagcgcggcgcggaactgccgctggtcatctccgaccatgccgactgggacgaattgctgcagacgctgagcgatcttcgtcccgaagagacctggatcacccatggccgggaagacgccctcgcccatgccgcggccggaatggggctccacgcccggccgctgcgccttgcgggatatggcgacgaagacgacgacagcccggccgatcccgccggcccccaacccgccagcacggagggttgagccgatgcgccgcttcgccgatctgctcgaccgcctgatcctcacgccctcgcgcaccaccaagctgcgcctgatcggcgactattttgcccacacccccgatcccgatcgcggctgggccctggcggcgctggccggcacgctcgacctgcgcgccgcccgcccctcggcgatccgcgagttgatcggcagccgcaccgatccggtgctgttcgccctgtcctatgactatgtcggcgatctggccgaaaccgcggcgctgatgtggcccgaacccgcggccacgggcgccggccgcaacgacccgggtgtgcggctgtcggaggtcgccgaaaccctcgccgccgccccctcggccgccgcggccatgcggtcgcttgccggctggctcgacgggctcgacaccaccgggcgctgggcgctgctcaaactcgccaccggcgggctgcgggtgggggtttccgccggtctcgccaaagcggccttcgccgcctgggcgaagctcgcccccgaagcggtggaagaggtctggcacgggctggagccaccttacgaggcgctcttcgcctgggcgaccggcacggggccccggcccgacccgcgcggcctgccgcatttccggtccttcatgctggccacgcctgccgagctggccgatctggcgccgctcgacccatccgatttccgcgccgaatggaagtgggacggcatccgtgcccagatggtggcggccggtggcgagatccggctctatgcccgatcgggcgacgagatcggccgcggcttccccgatctgctcgacgcctggcctttcggcgaggcggccgtcgacggcgagctggtggtgatggggccgaacgaccagcccgcgccctttgccgagcttcagaaacgcatcaaccgccgcacggtcggcgcaggcctgctgaaatccctccccgcccatctcaggctctacgacctgctcgccaaaggcggcgtggacctgcgcccgcgccctttcaccgaacggcgcgccgccctcgaagccctggtcgccgcccatccctcgccccgtttcgacctctcgcccctggtcgccttctcaagctgggcggagctggaccggctgcgcgccgatccgcccgccgccacgatcgaaggggtgatgctgaaacgccgcgacaccccctatctcgccggccggcccaaggggccgtggttcaagtggaaacgcgcgcccctgaccctggatgtcgtgctgatgtatgcccagcgcggccatggccgccgctcgtcctatttcagcgactacaccttcggcgtctggcgcgacgacgacacgctggtgccggtcggcaaggcctattccggcttcaccgatcaggaactggtcgagctggaccgctggatccgccgcaacaccaccgagcgcttcggcccggtccgcgccgtcgcccccggcctggtgctggaggtcgccttcgattccgtccagcccagcccccggcacaaatccggcctcgccctgcgctttccccgcatcgcccgcatccgctgggacaagcccgcagccgaagccgaccggctggaaaccgcggcgggcctggtggccggatcccctgcggcctccgtcacctgacgcgtgcagacgttgttgcctgttccctttttattacctaacatgatcatctgaagcctgcatcctggggagtccggccatgaccgataccgtcccctgccgggaactccggctcggcatcgtgctttatggcggggtgtcgctggcgatctacatggccggcatcaccgaagagctgcacgccctgctccgcgcctcgcgggatcgggcgagcagcaccccaccaccggcaaaagccccggacccggccccgaccagcgccatctatcgcgacctgctggacgagctggcggagaagacggtcgacctccgcgtcgtcgtcgataccatcgcgggctcctccgccggcggcctcaacggcgcggtgctgggacgggcgatcgcgaccggcggcggcgtgcgtcacatgaacggcttctggatcgacaaggcggatatcgccaatctgaaggacgatcccgaggaaggcgccggctggctgtatcgcactctcggccggccgatcctgaaccgtttcatgggcaacctgccacctcagatctctcatggctggctgatcgatcacctcgccgcctttctgaggggcggcgacggcaccagaacgccgctcgacggccgcaaattcatccggctgatcggcgaggccctgaacgggatcggccgcagcaccgcccatctcctgcccgacggccagcggctggatctttttctcacccgcagcgacctgcatggctggccgcgcttcctgccgatcgacgccgggctgcatgacggccgccagcaggaacggcgcttcccgcatgtgatgcggttcgagacccgcggcggcctcaccggtgatttcgacgacatcttcgctttgacctatgcctgccggtcgaccgccagctttccgatcgccttcgcgcccctgcgcagcagcgacgtcgccgaagaactgtcggcccatgacgggctcgccgacttccacaatcgccatctgggcgaacacattctggccggcgacgatcgcatgacgggcgatgactggggcagtcgcgcccagatggccgatggcgggctgcatgacaacaagcctttcggcccggtcatcgacgcgatcggcgacaagcccgcccgccgtcaggtgatccgcctgatcgcctatgtcgaaccgacgcccgagcaggaggtgccaatccccgacgaggcccgcttcgccggcggcgccctgatcggccggctctatgatcatttccgctatgaaccgatcctcgacgatctggaggcggtggcggagcgcaaccgggtcgcgcaggaactcaagctgctggaggccgagacccttcaggcggcgcaggccttccgcgcggcctctcccgacgctcccgcccacagcttcgcgccggcctgtgtcctgccctatgacagggcctgccgccagtccgccgccgccctgctggcgggcctgatcaacggcgccctgggcctgccctacccctcgcgccaggccaatctgatccgccggctcgcccggctctatgtgaccgggaaccccggcgccccggctgccgcggccttcccccgccaggatcgccgccggcgcttcctggtcagacaggccaaccggctctatgcgtcggcgtcggaccgggcgacggtcgacgccttcaaatcggtgctcaccgacctcgcggagatccgccctgtgatcgacatgacgggcaccggcatcgccttcgatcccaccgctctcgacgacatgctgatcgatcgtaccacagggcccggccgcgcctccttcgcggttctgaacgcggcaggtcagacggcgctggatcgggctcttgcagccgcaacctctgccgcagatcgtctggccggtgcgcttgatgtcaccgtcgccgacatcccgccgggcccggttgccaccgcccttcaggcggccgacagcctgttcgatctggtcgatctcgtcaccgcccccgaaatgatccgccaccggatcgaggagccgcaggaggcgagaatcgtccggatttcccccatcgattgccgctcgacccgcgacgtggtcggccaggccctgggcgatgaattcggggccttcgccggctttctctcccgcgatgcgcgtgttcacgacatcctgctcggccggctgaacggcgccgagcggctgctcgacatgatcctcgatgccgcggggctggaaggcgatgccgcccacagggtgaaagcggcctatcgcacccgattgttcaacgccatcgcagacgatctgatcacgatcgtggacaagaccggcggcctcggcgaccccgcgacacggctgcttcgaagacttggtctcctcgcctgatcacggccgaccgatccgaaatgccctgatccccgtatcacccgtgaaatggtcagggagacgggttccatgggcagcggcaatgtcatgggcggcgcgcgggaggcacggaccggcggcacgcagcacgggtccacgccaaacaggcccacgccaaacgggccggcgcgtctggcgacggctttgggcattgccgggctgatcccgtttgccgccggtgccgcccttgccctgctgacggatgacgccgcggcggcgcgcgcggccctgctcgcctatggcgcggtcattctctccttcctgggcgccgtgcattgggggctggcgctggcatcgggcccgaccgacaccaggcgggcaatgcgccgcttcgcgatctcggttctgccctccctgctcggttgggcggccctgctgatgccgcaggcctcgggctttgcccttgcaaccgccgccttcgccctgttgcttgccgccgaaaccctgggccccctgcgggcgggcctgcccggctggtatctccggctgcgcatcggcctcacgctgggtgccctggtcgcgctcgcgatcggtgcgccgatcggcggcggggggcccgcgtgaccgcggccgccggcatcgccacgctgcccggctggcgccttgcgctgttcggcctgcccgggctgccgctcgcggcactcaccctgccgctctatatctacctgccgacctattatgccgacacgctgggccttgggctcggcgtcgtggggggcgtgctgctcgccgcgcggatctgggacatggtcaccgaccctgtggtcggcgtgctcgccgatgccgtccgcctgcccggcggccggcggcggggctggatggttgccggcctgcccttcaccatcgccggcatctggatgctgatgtctccgcccgacggcgccggggcggcgcatctgctggtctggtcgatcgtgctgcatctgggcggcaccatgatggtgctctcccagcaggcctggacggcagagctgtccgacggctatgacgagcgcagtcggatcgtcacggtgcgcgaggtgttcgtgatcctgggcacgctggcggcgatcgccctgccggtggtggcgggcggtggcggcacggcggtcaccgccgcgggcctcgccacgctcggcgccgccatcgccctgctgctgccggtcaccaccaccgccgccgtgatcgcggtgccggaacccgatcgcccggtcgcccgggcgcgcggacagctggcgcggctgggcgcccttgtggccaaccgacccttccggcggctgatcggcgcctatatcgccaacggcttcgcgaacggcctgccggcgacgctgttcctgctctacgtctcgcacgtcatcggtcggcccgatctggccggacccctgctcttcgtctatttcgccgccggcatcctggcggcgccgctctggctccggcttgccgcccgcaccagcaagcacagggcctggacgatcgcgatggccatcgccacggccgccttcctgccggcggccttcctcggtaccggcgacgtcgtgccgttcctgatcatctgcatcgccaccggtgcgacgctcggcgccgatctggccctgcccaacgccatgcaggccgatgtgatcgacatcgaccgcctggaaaccgggcaggaacgggcaggcctgttcttcgccctctggggcttcgccaccaaggcggcgctggcactgggcatcggcaccgcctttccgctgatcgacgccgccggcttcgatccggccgccgacgatggtggcggggctctggctctcaccgtgctggccctggtctacggcgccctgccggtgcccttcaagatctgggcgatcctgctggtccgccgcttccccctgacccgggagatccagtccggtctggcggaagaaatcgcccggcgccgcagcccggcggtcgccaccccgccgggctgcggtccaccctcttcgcggaaaccctcatgttctctctccgtcgccgcaccgcgggcgtcgtgctcgcgctcctcagcctcctgacgatcaccggatgcagcaccatgaaagtcgaagatttcgccggcgccagaccggccttccgcctcgaagactacttcaccggcaaaacccgggcctggggcatgttcgaggaccgcttcggcaatctgcgccgtcagttcgtggtcgacatcgacggcgactgggatggtgagaccctcacgctcgacgagcatttccgctatgccgatggcgagctggaccgccgggtctggaccattcggcccgatggccccaacggctatgtcggccaggccgacgacgtgctgggcgaggcccgcggtgccgccttcggcaatgcgctcaactggacctatcgcatgaacctgaaggtcgggggccgcgagatcgaggtccgtttcgacgactggatgttcctgcaggaagacggcgtggtgctgaaccgcgccacagtcaccaagttcggcatcgaactcggtaccgccaccatcttctttcagaaggaccggccgcgcatgacccccgccctcggcctgcagaccgatcgccggccggcgatggcgatgcaggcgccgcgcgaatgatgcgggggatccctgccaccgacacggagttttcatttgcctgaaacgatcggcacgcctaaaccgggcgcagccggcggcaccaggccccggctgcgcccgagcacggcgaggccctgcgcatgatcaatctctatgtcaccgaaccgggtgtgctccgccgcgcacccgccggcagcccgatcggcgagaccgtggtctggatcgatatggtcgatccgtcgatggaggaactccagcgcgtcgaccaggccctcggcgtcgacatccccaccaaggaggagatgcgcgagatcgaggcgtcgagccggctctacgaagaagacggcgcgctctacatgaccgcgacggtgctgagttcggtcgaaaccggcagcccggtcgccagcgccatcaccttcgtactgacccatggccggctgatcaccgtccggcacaccgaccctctgcccttccgcgccttcaccacccatgtcgaccggcatcccggtgccgtgaccggtgccgaaggcgtgcttttcggcctgctggaggcgatcgtcgaccggctggccgacgtgctggagctggtcggcgccgagatcgaccaggtctcgcagacggtgttcgaagccggccagcgcacccgcggcatcacccccggcaatggcggcaagaccggcaagacgggcaagagcaaccagcgaccgccggcgcctgattacgaggcgctgatcgccgcgatcggccggatgggtgacctcacctccaagatccgcgagagcctggtctcgatcggccgtctggcgggttttgccggccgcaatctgcgcggccgggccagcaagaccggcctggcggcgatgaagaccatcacccgtgacgtggtctcgctgtccgatcacgcaagctacctcgccaacaagctctccttcatgctggatgccacactcggcctgatccagatcgagcagaacggcatcatcaagatcttctcggtcgtggccgtggtcttcctgccgccgacgctgatcgccagcatctacggcatgaatttcgaggtgatgcccgaactctcctggcatctgggctatccgctcgccctgctgatgatggtcggctccgccgtgctgccctactggctgttcaagcgtcgcggctggctctgacccgcctgcgaccgcatgtcgcgtcgcgggcggctgaagatcagacgataatatgctgctgaatcagcaggacgggcagtggcgacagcacgggatcaaggtcggggcagcagcagcggccgtgcggtgacgcacggcctttcggccgttcgcggccataaactgcctgccgccctggtcatgctggtggtgttgttcgcccagatcctgggcggtgctgcgctcaacgtctccgccgcaaaagctgccgagaccggccggctggtgatctgcacacccacaggtctggtgcagatcgccgtcgacgacgacggccgtccggtcgatggcgacggccatatccgcatcaatcacggcctgccctgcggcgggctctgccttgcgcccgccctggtcgcgaccgcccccgccctgcccgaaccggcggcggaggtcctggcccggctgcagccggtcgcccgcggcctgccgctgccgcgggaccgcctcgccccccgcccaccggcccgcgccccacccctggcctgacaccgcctcgttcgctccgaaccggtatcagatccaggacatccgacatgatcctccgccagaccgcggccggcacccgccggctgctgcccgcgacggcccgtgccaccgtcgccgccctcgccctcaccggcaccgccatgcctctgcccgcccgcgccggggaagccaccggtgtcggcagcaccgaactgcccgcgctcagcgtcaccgcccgccgcggcagtccgcaggcacttgaagacgtgccggccgcgatcgagatcatcgaccggacccggctcgacgccgtgccggcgacaaccgtcgcccgggcccttgaacaggcgaccggtgtgatcatcgccgatggcggctccaccacccgcttctccatccgcggcttcgaagacggccaggcgctgatcctggtcgacggccaccgccgccgcggccggttcggcaatgtcgacctctcggccttcgacctgggatcggtcgaccggatcgagatcatccgcgggccgatgtcggcgctctacggcgccgacgcggtctcgggcgtggtcaacatcatcagccgggatgccgccaccgaaccggggaccagccttcagaccctggccggcgtgtcggaaaacggcgaaaggctgacccgcatcggccgggctgccgtggaaaccggccggatcggccagacccgcaaccggctcgacctctcgatccgctcccgcgatccgtggagcgaggcgggttccgcctttgacgacctcaagggcgagtcctcgcgccatgccgcctggcgcacggcctgggatgtcgcccccggtcacgagatcacccttgatctcggctatgaagagctgcgagcgaaagggctcggctccaatggcggccgggtgccgatgccggtcgactcgcgcgagcacgagaccagccgcaccggggcgctcacctgggcgggcgaggtcggccccggccggatcaccctctcgggcagcgcctaccacaccgaaggcgacgtgctgcgcaccggctcgctcgacaccacccgcatcgacggccgcgagctgaccggcttctacaccgtgccgctcggcgccgatcacgtcgcgaccgtcggcttcgaatatctggaagaggatatcgacctgtcggttctggccaaaggctccgccgaccggcgcagccgggcagccgtcgcccaggatgaatggacgctcgccgaagactggaccctgctcgccggcatccgctatgacgacttcagcgatgtcggcaccaccaccaatccgcgggccacgctctcctggacgcccgggccctggaccttccgcatcggtgccggcacggccttcaaggcaccgacctatctgcagctctattcggtcatccatcgcggccgatcggtcatctacggcaatgccgacctggaacccgagacctcgtggacggccgaagccgccgccgcctatcgcttcgccgatggcgcggagctgggcgtcaccgtccacaattccgaagtcgaggacctgatcaccacccggctgacgacgcccgggcgctatgactacaccaatatcggcaccgcccggatccgcggcgtcgaaatcaccggtcgcacgccgatcggcgatgatctgatgctgacgggctccctcgaatggatcgatgcccgcgacaccaccgccgacgaacggctgggccgccggccgcgccagcagggcaagatcggcctcgactgggcggccgatgacgacaccctggtccatctggccggcaccggcatgctgtcctattacgcaccggtcggtttcggcgccagcaatctcggcaatgtctccaccgattacggccggatcgacgtcaaggtcagccaccggctgacgcagctggtggagatcaccggcggcgtcgacgggctgatcggcacgcatgtgcccgacaacctccagcccttcgagccggcggagcgcttcttctatctcggcgtcaatctgcgctattgagcccggaaggagacctcgccatggccgtcctcatccgaccgcgcccgcctgcacccgcgcgcgccatcgaactcaccgcactccccggtatcgccggtgtgctgcggcggccgcatgtgctgaacgcgctgcgcggcctgaccgtcttcctgcttgcctccgccatctggttcgggctgaccgaccctgccggcagcggcgccttcacactcgcattgatgtgggggatcttctggccctttttcaccagcctggtcacgccgtcgctgggcaatgccttctgctcggtgtgcccgcatggcttcatgggcaagtatctgagccggatcggcctgaagcggcatgcgccgcgctggctgatccgggccaatatcggcctggtgctggtcatggtgacctattgggcggtctcgttcgcagcacctgccgccttcgcccgctcggccgacatcaccgcgggcttcttcctggcctataccctgcttgccgccgccagtttcctcgtctggcgcgacatggcctattgccgccatatctgcccgctgggcggggtgctcaccgcctatgcccgcgccgggtcggcctggatcaccaccgaggccaaaaactgcgccacctgccgcagcttcgattgcgcccgcgcctgcccccaccacctcagcccgttccgtttcgaggaacgcaacgacatggccgactgcacgctgtgcatggactgcgcaaccgcctgtacctcggtcaaggtggaactgcgccgtcccggtcatcagctggcgcggccggtggcccgggatgacggccgcaccgctcgggtcctgctctggctgacggcggttgccgcggtcggcgtccagttccagcacgggctgaaccacaccccgctcgccgccatgatgccctggaacctggcgggcgggctgctggccgatcggatcccgatgccggcctggttccagtggtcgggtctggtcgcgctgctgctcgccatcaccctcacactgggggctgcccggacaggctggggcctggtcgcccgtcttgccggccgcaatcgggcggaagttgccgccgtgctcggccatggtctggcgccgctcgcctgcatcgccatgctcgcccacggcatcgtgttcttcctggcggtctatgcacccaagctctggaacagcgccattgccgcctatggcctgccggccgcggagatcgggccgctggtcgcgcgcggcacgccctggctcggcatcttcgacctgctgccctggatcgccatcctctggtcacttcgggtgatgcatcgccgcacggcgctggtcctgcccgccggcacaccccgcggccgccgttttctcgccacgacagccgcggcggcccccgtgctgctctatgcgctggtgctggtgatcaagctctgggccgccacccaggggatgccggccggtcatgtccactgacgtccatgcccgggcgttcaggcaccggcggccggcccctgccagtcgccgcgggccaggcgcagcggcgacggcgccgtgtcccgcgccaggcgatagcgcacctcgcgcccgcgcccgtcgaaggccacccccagccagcgcggctcggccgcgcggtaccagagcgtcatggtcaggtcgccggtcacgtcataggcgcgggcggcgatgctgccgccatccggtgccgggcgctccacggtgccccgatcggccaccgccacctccagcagccggccgcgctgtgtgtccagccagcgcggccgcgccggcgtgtccggatgccaatagctggtcgggatcacgtcggccggggcctccacccggccgtcggccccctccaccacgaaactgtcgccctctgcccgcccatcgaccgcataggccgtgccgtcatcgtcggtgcgggtccggatcgcgaccagccggccgccggcccagctttcggtgttgcgatgggtgtagcgatagaccgtgatcggcccgaacgagaccgcaagatcgatctccaccgacaccgtcagccggccatcggcctcgggcgtgaaccgcagcacatggcggcccatcggggcatcgccccggaagacgtcgaaggccagctcacccgtccccggggcggcagccgccagggcgcggccggcaaaaaccggcgccgccagcagcagcccgccccccagcaggccggccaccacggtccgccggtcaaccccgccacgcccgcgccggcaggcatccgaacagtaacgcaccgcctcccagtcgcgggcccatttgcgccgccaggcgaagggccgcccgcatgccgcacacagcctggccggcagatcggccttgcgtcgcattttcggcatcgcatgtctcccgggtggtcaggtctcacaattcgcggtctccgccccatataccgacggcggaagccaacggatcacccgttcggcatctgtcgagggagtaatcgtccgtgacctcaacgccgccccctgccttcgaagacccgatcgggcttgcgatcatcggtgcgggccttgccggcatatccgccggccggctggccagacgccagggcgtcacgcccctgatcttcgacaagggacgcggcatcggcggccggctcgccacccgccgcgccacgctcgacgacggcacggttctccgcttcgaccacggcgcccagttcatgaccgcccgcagccccgccctggtcgccgccatggccggggccgaggccgccaatctggcacgccgcctgcccgccccgcccctgcatggcccatccctgcatggtcaaccgccggcacccgaacgcgaccagccccgctgggtaggccagccccactgggtgggcatgggcggcatgacggcgatcgcgaaacatctggcccagggtctcgacatccgcaccggcacccgcgtcggcggggtcgtccgcaccggccgcggcctctggcggctggaggacgaagacggtctgccactggtccaggcgcgccggctgatcgtcaccgccccgcccgagcagacgctggacctgctgatcgatgtcctgctgcccgaaggctggcgccgccgcatcgcctccaccatcgtcgccccctgctgggcgctgatgctggcggtggacgaggcactgcccctgcccggcccgcgctggcggccggaggacgaggcgattgcctggctcggcgaccagaccgccctgcccggccgcgcggcaggtccgcaaagcctcgtcgtccatgccacgccgcattggagccggatccatcttgaggaaacgccggaggtggccgccgcttccctgctccgcgaactcgaacgcctgatcggccgggcgatcaccccgcgcctgatccaggcccatcgctggcgctatgctctcgcagaggtgccgcttggctcactttgcctggccgataccgggaccgggatcgccatcgccggcgactggtgcatcggcgggcgtgccgaggccgcggtggacagcggtcgcgccgcagccctggcactgatcggctgagtaagaccggtcaggcaccaagggtttgtcaccaacacttcatttctgatccgagggttgcgcggctaagaatagggttcaccccctctggttgcggtcgcagatcccggcgaccgaccccgctttgtgccggtggcccccgcctcatgtccgtgctctaccagtcctcgtccgacctgcccgacctcgtcgcaggcctctatgagcgccgggcgcatgatctgtatctgggcgagccggtgacggtctacgaacatgcggtgcaatcggcaatgatcgccgaggccgacggtgccgcaccgaccatgatcgccgccgccctgctccatgatgtgggtcagctgatccgcggcgccgccgaggacgcccatcgcctggccgacgacgaagagcatgcccgggtcggcggtgacttcctcgcgagctatttcctgcccgaggtggcagaggcggtgcgcctgcatgtccaggccaagcgctatctggcggcatcggatgccggctatgccgcgacgctgaccccggccgcccgtgtcgccctctccgccggtggcggtgcgatgtcgcaggaagaggcgacggtgttccgcatccgccgccatgccgataccgccctcagactccggcgctactgcgaccgggcgaagcagcgcaatctcgtgctgccccgcttccgcagcttcgcacgtcatgtgctggcggcggcgcggcgcgactgacgccgcgccgctcgttccgtcgatcatcttccgtcagtagtcgtagctccaggtcgcacccacggaactgccgccctcggcaccgacttcggtgtcgaccttgatgttgggcagcacctccagctccaccgtcacggcactgctgccggccccctgctcgacaccgacgaacaggtcgtcgctcagatatttgccggccctgaccgaggcgccggagccggtatcgtcggtgccgacatccagcacgtcgagcccgaacaggtcacgggcgaagccggtgggatcgaaaccgccgcccccgccgccggtcagcgtcgccagcccctgcccgaccctgatcgcatccacggccgacagtttcgctcccggcttgccgaagaaggcccgggccaggatctcgtcctgcgccagcgccggttccgaagtcagcgtcagctgcggtgccgaggcccggccggtgacctgcacgatggcggtgacatcggcattggtcagcgtcgcttcgatatcgagccgcggatcgatatcggccagaccgtcgaaggtgatgacacccttcgagaaggtcagggtccgcccgaccacatcggcctcgccgcgcaccacgctgagttcgccgttgatcaccggcgcgccggtggtgccgcgcaccttcagattgccctgccattcggtgtccagcccacggccgcgcacgaagatccgccccggcgcccggacatcgatgttgagcgccagcccgcccgatgcctgctgctgctgttcgggcgagcccggatccgccaccacccggccgttcctgacctcgaccacgtcgatcgtgcggatcgacggcccgccgctgtcgatcagccggacctccgcctgacgcaccgtcacggtcccgcccagctgtccgtcgcccagcccgccggtcatcgccagattgccgtcgagcaccgcatcgacatcgtcgcggcgcaccaggcgcgcctgatcgatcttcaccttgatgtccatgcgcgggtcggcaaggtcatccagattgaccgtaccgttcacggtgaccgtaccactgccaccgtcgcgcgcatccagcttcaccgccagacagcaccgcccggagacaccgatctcaccggtaatgcccgtcagcagcgtgcccacatcctggttctcataggccgcaccggtcagccggataccgcctgcgacatccggattggcgacggtaccgttcacggtcatgtcggcatcgatccgcccggcgaagcgctggccgtctatgccggcggccagcgccagccggcccagatcgccctgccatcgcagccggccctcgaccggcccggcgtcatccagcgcaatctccgtcggcgccccgcgccggaagggctggagcggagcctttgccgtgacggtcagcggctgttcgcccagacctgcgatcgcgaggtccagatccgccgtgcggtcgccgagcgtcgccttcacatcgcccgagatgatcggcgtttccatgccttcgacctcggcatcgaccggcaggtcgcggattgtgagcgtcaccgcgccctcccgcccgcgcgggcccatggccagatcgatcgtgccgtccagccggccgccattgccgatcggcgcctggaaccggcgcagcgggtcgagcggcaccgccgtcagccggccttcggcggtcagccgatccggcgccatcacggcatcgagcacgatgcggccggccttgccgatccgcaattccggcaggtcgacgcgggtggcatcggcaaggcgcaccgtcgccggcgcccccagccccagttcttcacccagcgcctggcccttcagccggtcgagcgtcagcaccatcgccccctgccggtcggtcgccagattgccgccggcatccagcgtcagccggcccttgaaattgccggtcgccgccagatcgaatcctgtcgccgccccctgtggcgtggccgtggccttcagcgtggccagctgcacgggaccggcggtcacccgctcggccgcgatcgtcgcccgtccacccggccggccctggtccagcaccaggtcggcatccagcgtcagccgctcggccgcgacactgccggccacggaaagggctgccgcctcgccatcggccttcaccgtctggcggccgcgccggtcggcacccagatcgacatccagcgacagccgcccgcccatatcgagcccggccagccggccgagcggcgccagatccggcgaattgatgtcgaaccggccgcgcaccagcgcattggcgagggtcaccgccgcctgaccacgtgccgtggtgccggcgaaatcgagggtcagcgcattcacgtccaggcgcttgccgccatcggccgaagccgcctcggccgtcagcctgagcgggccttccgcggtctcgccatccagggccacgcgaccggtcggggccgtgagcagattgcgaccgtcgagatcgagcgtcaggcgctggacgtcgatcgtgcccagccggccatccgccagccgggccgtcacccgcgccgccggatcggaaagattgccgccgagcgcgatatcagcttccagcctgcccgtggccggtgcgccgaccgcatccgccagccgccccagatcgcgcaccgcaagagtgagtttcgtgccgtcgagcccgcccgcagcccccagcgccgcccgtccggcgaggcgggtggttccggtcgcaagcgacaggttctcggccatgaccccgccctcgcccgtaacggtcacccgggtggcgagatcgatccgcccggccaacgccgcatcggcctctggaatgccgagttgcaacgaccggccttcggcggagacatccgccaccagacggctcgccggattgccggtgaccgtgacatcgagccccagcgtgccggcaagctgcggcaggccggcaagggtggcgagccggctcaatttttcggccgacagcccggcctgggcgtcgatggtgccgtcgcccagggcgtagctgccggtggccgaaaggttggcggtgccgatgtcgagcagtgccgcatcgatcaccaccttgtccgcggcaccgtcgaagctgccccgggttttgagcgacagaaccccgtcggccgcctctggcggcaggcccagcgccgccgggcgcggcccgtcgagatccagatccagcgccagatccagatcggccggcaggtcctgggccggcgcgcgaccggtcaccgccgcggtcagtcgggcggcattggcgaagggcccgccatcgccgatgccctgcagccgcggcgccgccagcgtcgccgccagccgggcatcgacggcgggccaggtaccatcgacatccagcgtcagggtcgccgccgacatcgccgccggctgcgccagcgccagaagcggcgccgtgcccgagacattgccggtcagccgcgcctgcaccgcaccggtgccggtatccatcccggccgtgcccgaaaggctgacgccgccggtcgagagcgccagccggtcgacggccagcgtctggccatccggctgccgcgccgacagatcgaaagagagcggggtttccgaggcgagcaccagcggcggcaccggttgatccgcagatgcgtcacgcgcgagggatgcatcgccctcgacgggtgcatcgcccgctgcgggtgcggctgcatcggccccggcgagcgcccggcccatgccggcccagtcgagttcgccctgaagctgcagcgagggatcgggacgcaatgccaatgcgatgccggtcttaagatcggccagcccctccacatccgcggtcagccgaccggtccagccctccagcgggcccgagccttcaagcctggcggtgatcggcggccggccgggaagatccgccatggtcgcgaccagcccgcctgccgcctcttcggccaccagatcgacatccagcgtgccggccttgagatcggtttcgagggcagccgatacccgtcccgccgggccgtcgaggcgatggatgtcgagcctggcccacgaggtatcgccacgcccgacccgcgccgcgccgtcgacccccagcatggccggcgcatccagaccggtcagccgcggatcgagttcgagcagcgaaacgctcagctgccggagatcgagtgtcagcggcggcagcatgccctcgtcgggcaggcgcacggtccgcggatcgaaaggctccgacggtggcggcggcgtgccgtcatcgggcggcggcgcaaccttgatccgctccgccgcgatggtcgcgatctcgatgcgcccggcgagcagggccgagggccgccacgagaaggtgacgtcgtcggccaccagccagggatcggccggatcgccgatgcggagccgcggcagatgcaggcgcccgaacaggctgccctcgatcgccggcagttccaccggccccagaccggccgcctcgatcccgtcacgggcaaacccggcgatggtccggcgcccctgatcgctgtcggcccagatcgccgcgccgccgatgccgccggccacaaccaccacaaggcccaccaccccatagcccaggatcttccggatccggccacggcgccgtttcgccctgcctttgtcaggtccgggcttgggtggctcggctccgccgctggaggacggggtcgtcggatcgggtgcccgttcgggcgtgtcactgctcacgtttcggtctcactccgcctcggaaggccgcatccgggtcaccggtcggtcagaatgcctgtccaaggctgatatagatctgataggggtcgtcggcatcccggcggtcgagcggcaaggccacatcgaagcggaacggaccgagcggcgtgtaatagcgcagacccagcccggcgccggtccgcagattggtggacagatccggccagggctcttccgagatctgaccggcttcgatgaagggcacgacggaaatgtcctgggtcaccggcatgcgcagttcgaccccggcttccgccaccgaccggccacccagcgggtcgccatcaccgtccagcggccccagcatgcgatagccgtaaccgcgcaccgacccgccgccaccggcatagaagcgcttgtccgccggcagcgttgccgttgcggcaccggcgacggagccgatccggccgcggccggccagcacccagcgccccagctcgtccagcggcacatagatcgagccgttgagttcggccctgaggaagctgatcgccgctccctcgatcgcgccggtataggggatcacctcgcccgagatgcgatagccgcgccgcgggtccagcaggctgtccgaggcatcgcgcgacagggttaccggcatgcccagcagataactggtccgctcgcccttctcgtcgtcgaggatcttgtattcgggggcgagcgccagcgagccgcgccagccgtcgcccagcgcccgttcctggccgaaacgggtctcgataccgctctgctggaacgcgtcggtgtcttcgttgatcagcttgacggtaccgaaattgaaccggtcctcgcgcgggtgcggccgcttgtagttcacgtccagttcctgaagcaccggcgaaatgtcgagttcggtgcgcagcttgtcgccacgaccggtcaggttgcgatgctcccagaaggcacgcagttccggcccgaccgtcgtcgaataacgcacgccggcaccgatgctccgcgggggaccttcgaccaccgtcagtttcaccggcatgctgccgtcggccggcggggtctcgggcgtctcgatcacggccgaggagaacagccccgtggccagcaggtcggcgcggaagctttcgatcttgccgacatcataggtgtcgccgggctgccaggggcgcttgccctccacaaccgtcgccagcacgtcttccagcccctcgacgctggtatcgccgaagcgggtgaaggggccgctgtcgatgtcgaccgtcaccgccatgctgcgggtgtcatggtcgacgaccgcgcggcggccggtctggcgggcgaagggatagccgttggcgcccagcgtcgtcagcaggtggcgctcgccggccacgatttccgcagcctcggcggccgcccccatcggcaggcccagcgccttgggcgtcatcttttcggcatcgaccagcggcggctgaccggccgcccagtcgaccgtccagccggccagcttgtagcgtggccccgggcgcaccgtgatctgcgccgccggcggctcggcatcgcgatcgatgcgcaggcgcacctcgccgtcgaaataaccgcgggagcgcagggccttctggaacagctcgacatcgccctgcccgcggcggcgcagcgccgccaggctcggcggcgggcggtcctccagccggcgcagctccgacaggctgtcgaacagctcgtccagcggcgcatcggccaactcgtctacctgcggctggctgccggtaacactgccggtcgccccctccttctcctcccgcgcccgcttctcggcccgggcctcggccaggcgctgctgttcggccgcctcttccggatccagcccctcgacggtgatctgcgtcgtgtaggtcaccccgcccacggtcgcgaaaagcggctcaccgctttcggccaccggttcctcatccaccagaccaaggctgcggccgacatcattgacggtcccgcatccaccgagcagggctgcggcaaacagcgccggaaccagcggaagacgggaagtgtgggacgggccgatcttgcgacatggcacctgtgagaggcctccggatcaagctgcatcatgcgcgacgggcgccgcttcaccttaacgatccccgcccccggacggcaagccgggctcccccttcgtgccgtgacgaattttggaaccggcccgatcaggggcgggcccggcgcgcaagtggcattgacgcgaccacatatcgcgcgcaacgatcatctcatgcgctcaccgcagaaatgagccgttcacctgtccggaggatcatccacgatgcttggcatcaagctcagcgagatcgaaacgttcctcgcggtcgccgaggcggggtcaatcaacggcgccgcccgtcgcatgcatctgacacagccggccgtcacccggcagatccagcggctggaagcggagctggggttgattctgctcgaccggcgcagcaaaccgccgacgctgaccgccgccggtcgcgatgcgatggagcattgccgccgtgtgctgagtgcggtggaagatctgaaggcgatgggcatggccgagggcgccaccgccggacggctccgcctcggctttgcccatggcgtggtcgatctggccgtcacccggccgatcgacgagctgcgcgcggctttcccgctggtcgccctgcagatcggcagcggctggaccggggaattgatcgatcaggtccgtgatggtcgcctggacgctgccgttgtcctgatcgatcccaacgagcaccccccacaggatatcgaaggggtgcgggtcggctccgaaccggtctggatcgtgggctccgcatgtgacgaaacctcctctggtccgatcgcgcccgaagagctggctcgcgcaagctgggtgctcaaccccgaaggctgcggctatcacatggtggtgcagcgtttgctggaccgtatgggggcacgactggaggttgcggccgaagttctgggaccagatatccagctgtcgctgatcgctcggggtgtcgggttcgggctggtgccggcccgccgggtgatgcagagcgcccaggccggtgacctgcggcggatcgaggtgcgggggctggacctctccctggcggtctgggtgctgcgctcatccctcgccggtcggctcacccccgccatcgatcatctggcaggttcgctcgccgccctctgggcccccgccgcagccccggccgtcgccgtcgccgccgtctgaacccggccgggacctgccggtgccgcctcgtcttcatccaccgtatgggcaatcgccgcagccagcgcgcgggagatgcaggcatagcccaacgcgttcagatggaagcggtcggtgaacagcaggtccggggtcggatgcgcgcggtcttcttcccaggcggtcatcagcgcatagcggctgtagatcggcgtatgggtctcctccgccacctgatgcatcagggtgacgaaggcggcataggtcccgggatccttcgcaccgggatagagctgcagatccatcagcagtgcatcggctccgctctcgcggatcatctccagcccctcgcgcagctgatcggtgaaccgggcacggtcgaccgcacgcagcgcgtcattggtaccggcctgccagatgacgagatcgggatcgttttcggccagcagctcgtccagccgcgtcagctgatcggcggcgatttcgccgcccacaccggcattgatcacccggatgcggctctcggggtaacggcgggccaggtcgcgctccagccggaagggatagctcgcctcgggccgcggcgcgccatagccctgggtggacgaggatccgatggccagcaccaccagcggccggccctcttccagtttctcatccgtcaccggcagatcgcccgccagatccgggccgtcttccggcacacggcagacgccatcgatgctggtatcgagggcaaggccgaagctgccggcatcctgttccggcgcccgcttcggtgtcaccgctgcctcggcagccagtgccgcaggcggcaccgccgccagccccggcaggagcatggcggcggtaacggccagcgggcgaagaacgtggtgcagcaggcgggtcatgatcaggcgcggacgggaccgaaggccttggccggcgggacggctgcggacggcgccgcgggcgcggtgcgggcaggagtcacggtcgtacgagcgggcgtctgggtagtgctgcgcttcaaccattcgaggcccccggcaagcaggacgagaatgacgagaccggcagacaccagtaccacatcgagaaccacgccaccacccagcggaacccggaccagctgcgccgccaccgccagcagagagccggtggcaaagaccgccagaccctggcgccccatcaccgcgaaggggttgttggcccccagatcccgcagccagcggccggccggcgaataggcgacgacatagaccagagccagcagatgcaggatgcgcggcagggtgacgaaggtcttgtcctgaccataaaggaagaaggggatcggcagcatgtcgcgcgcgggatagaaggccacgagcttcatcaccagcgccagcaccagataggctgccgccagccaccaggcccaggcccggtagggcaccacctgcgcccggcccaggatgccggcaccgaccacgaaaccgatcgcgaagacgaactgccaggccagcgggttgaagaaccagccgccgccgttcggccattgcggggcgttcatgccggtcatgttggcgaccacccagaccgtggccgaggccacgagcatggcgccgacgctcgcccgtgcgatcagcatcatcaccggcagggccagcatgaagcagatatacatcggcaggatattgaagtagccgggctgatggcccagcgtcaccacccccatcaggccggcggcggggtcattgaagatcgggcccagattgatccaggaatacagctccggatcggcggtggcgccggccatccaggccaccagcgccgccactacggcgatgcagaagacatggaccagatagaggtcgaaaccgcgctttgccgccttggcgctggccagccagggccggtcggcggtgaacttgcggaaataggcgagcgccgccgccaaccctgccaggaagacgaagatttcggtcgcatccgcgaatccgaagttacggatcgtgatgttttccaaagggtttcccggcacgtgatcgatgaagatcatggccagggcaaggccccgtaccgtatcgatctcgttcagccggccgcgccgtgtcgcgtccatcggttttgtccttggtgaaggtggcccgctgctttaccagcaacaccattgcaacgcaccaggcttcaaccggtacaggggcataatgtggatcccccgcgtcaaaagcggggcaggtccgtggcggccgtgaccattctcccatcggcccacgtgccaccactacaggtggagctgccacgatccggtaatgatcattatgtctattatgcattggcgtcatgatcagatccgacattatgatctacctgtgttcccggtatggttgactttacccgccacaccgcccttcccggggcgttgtggcgggatttttcttccagccaaaacacaacctttacgatggtttataagcatatttacgcgtgagatgcccatgagccaggatccgagtgccgccccgtccgccatcggccagccgccccagtcacctcggatacgcgacacacgtcccgggctcgaccggacagcccgcctcgtgctcattgcggccgccgtggtcgtgaccatttcgatgggcgtgcgccaggcattcggcgtcttccttacccccgtcgtcgccgaactcggcatcggtcgcgaggtcttcggctttgcgatcgccgtgcagaacctgctcttcgggctgatgcagcccttcatcggcatgatcgccgaccgtttcggcccctcgcgcgtggtgctggcgggcaccgccgcctatgtggcggggctggtgctcgccgcctcgaccggttcccccaccgggctgatggtcacgctgggcgtggctgtgggcttcggcctcgccggcaccagtttcgtggtggtgctgggggcggtcggccgggccgtgcccgaagcgcggcggccgcaatgcttcgccctggtcacggccggcggctctttcggcatgttcgcggtggtccccggggcatatgccatgctcgacgccttcggctggcgggatgcgatcctgctgctcgccatcgccgccagtgccatggccgccttcggcttcgcgctcgacggggcacgccggcgcagaccgcagggcaccgccggggccgcgccggcccctgcccgccccgtccggtgccgacacgctgggccaggcgcttcacgaagccgcccatagcggcagcttctggctgctggcactcggcttcggggtctgcggctttcagatcaccttcatcggcgtgcacctgccggcctatgtcggcgatgtcggcatccccggctgggtggcggcctgggcgctggggctgatcggggcctgcaacatcgtcggcgcctatgtgctgggcagcctgggcgcccgcttccgcggccgcaacatgctggtcgccatctacgcgctccgcacgatcttcgttctggcggtggtcgttctgccgccctcggcaccgctgatcctggccttcgccgcgctcttcggcttcacctggctcggcaccattccactcaccagcggcatggtggcgcggatcttcggaccgcgttacctttcaaccctttatggcgtggtcttcctgtcgcatcaggtcggcgccttcctcggcgcctggggcggcggctatgcctacgacctgctcggctcttacgatgcggtctgggcggcgatggccgtcatctcggcgattgcagccctgatgcacctgccgatttccgatcggccggtggtccggcagccgaaagccgcgtgagcggggcggcgatccgggctatactttccggatatcccgttacggaggcgaacgtgatgagcgaaatgctgcccgtcgaccggatgcatatgaggcacgaagcggcagaggacgaagcaaccgacggcgaccggcctttgccagcctggaccattcacgccgccgcgatcggcatcggcctcgtgctcggggccgccctctacggctggggccgctattctggcgtcatctccatggactgggtgggcctgctctgcggctgagccgcaagaccaggcccggcccccattccttgatcagaccttctcgacaatcagcgcgatgccctggccgatgccgatgcacatcgacaccagggcgtagcgcccgccgcgacgctccagttcgcgcagcgccgtcagcgtgatccgcgcgcccgaagcccccagcggatggccgacggcgatcgcaccgccattggggttcacgcgggcatcgtcataggccagatccagctgcttcaggcagcccagcacctgggtcgcgaaggcctcgttgatttcgatcacatccatatcggcaagcgagagcccggcgcgggccagtgccttgcgtgccgccggcaccggacccagccccatcacccggggctccaccccggccaccgccgccgccacgatccgcgcccggggcttcaggccgaaacgggcaccggccgcttcggtgcccagcagcagtgctgccgcaccgtcattgatgcccgaggcattacccgccgtcaccacgccatcggccgccagcggccgaagcttcgtcagcgccgccagggtgctgtcgggtcgcggatgctcgtcggccgtcacctccagcgccggcgccttgcggccctggtcgacggtgacggccgtgatctcgccctcgaagaagccggccgcgcgcgccgcttcatagctcgcctgcgaccgcgccgcaaaggcgtcgctctcctcgcggccgatggccaggtcgcgggcgatgttgtcggcggtctcgggcatggtgtcgccgccataggccgcgatcaccttcgggttcgggaagcgggcgccgatggcgctgtcatagaccttgaaatcgcggccaaaggcctgttccgatttggcgaccacgaaaggcgcgcgggtcatgctttccacgccgcccgcgatcatcagctcgccatcgcccaggcggatggcacgcgacgcatcgatcaccgccgccatgccgctgccgcaaagccggttgacggtctgtgccgccacctccaccggcaggccgcccatcagcgcgccatggcgggcgacgttgcgggcatcctcgcccgcctggcaggcacagccggcaagcacatcctcgatcgcggtcggatcgacgccggtctttgccatcagcgcccggatcacctggcccagcaggtcgtcggggcggatgcgcgacagcacgccgccctggcggccgaaggcgctgcgcaggccgtcgaagatgaaggcgtcggtggtggcggacatgggaacggttcctccgggcttttctctggtcttgtctcaggcttcgtcgcgggtcagcggcaggcccaggcgggcgcggcgcgacagccaggggctgggccggtagcgcggatcgccggtcgccgccagcagcccctccagcaccgtcagcacatgggcagcccccaggctatcgcccaggcgcagcggccccttgggatagccgaggcccaactctacggccggatcgatgtcggccggggcggcgatgcgcatctgggcgatctcgcagccgacattcacgatctgggcggcgatgcgctgggcgacgaaaccggcgctgtcgcggatccgcgtcaccggcacaccgccctgctccagccgcaccgccatgccggcggcgagcgccggatcggtggcgggcgaggtcatcagggtcagccgccgctcgaagccgaacagcgggtcgatcgccagcgcccgggccgaatcgacccccgcctccagcgccgccgtggtgcagtcggttccaagcggcagcagcagggcgatcgcgccctcgcccggccggtcgcccgcatccaccaccatgccggcccgcgccaccagctcctgcgccgccgcccgccaggccggatcggcggcaggccccacccagaccggcccgtcgaccgcgcggccagccagcgggtcgggctcggggtccggctcgatccgcgcgcgcccgttctcataagtatagaagccggcgccggatttccgccccagcagcccggactccatccggttgcggccgatcggcgacgggcggaagcgcggctcctgaaagaactggtcgtagatcgattccatcaccggctgcgagacgtcgagcccgaccagatcgaacagctcgaacggccccatgcggaacccggccgcgtcgcgcatgatccggtcgatatccaccggccgcgccaccccgtcctgcaggatgcgcagcgcctccaccccgaaaccgcgaccggcatgattgaccagaaagccggggctgtcggtgacattggccggcagatggccggtgcggccggccagatcggtcagggccgcggtcacccagggggcggtgcgggcccccgccaccacctcgacgatcttcatcagcggcacgggattgaagaaatggaagcccgcgacacgctcgggcgccgcgcaggccgccgcgatcgcggtcaccgacagcgacgaggtgttggaggccaggatgcagcccggccccaccgccggttccagatcacggaacagcgtgcgcttgacctccagcgcctcgacgatcgcctcgaccaccagatcggcgcctgcgaacgaggtcggagcggcctccacaaccttcagccgacccagggttgcgtcgatgtgatactggtcacactggccctttgaggccttgcgtgccagcatgtcggcgatgaagccacgcgccgcatcggctgcgcccggcttcgcatcggccaggcggacctcgaccccggcttcggccagaacctgggcgatgccgcggcccatggatccggtgccgatcaccccggcgatatcgatccgtcggggggcggaagtctcggttcgggcagcgaaatcggtcacgggcggggtcctccggcaggcgccgccatgcgatttccgcagggcggactcatattccatcgcgttgacggggaggttaggcagtgtcagattggcctgcaaccgcaatccatcagcatgcgcatccgcggaatttgcccgaggccgagcctcgtccggacaattttcacgggtaaacgacggagcggcggggtatgaattccggcagacgatcggaagcgccccaggggaggaagttgggagtacaggcatgcgcaaacgtgccgagatcgagcccattgcagagctcgacccggaagaagccgcacgcgatcggaatttcgtgacggcattggcccgcgggctcgaggtgctgcgcgccttccgcgtcggcaaccagcccatgggcaatcaggaactggccgagatcaccggcctgccgaagcccacggtctcgcggctcacctatacgctgaccaggctgggctatctctcttataacgagcggatcggcaagtatcgcctgggctcagcggtgctgacgctgggctacagcatgctggccgggctgacggtgcgcgacatcgcacgtcccctgctgcaggagatcgctgactattccggcgtgtcggcagccttgggcgaccgtgaccggctgaacgtgctttatgtcgaatgctgccgggccgataccgcggtcacgctgcgcctcgacgtgggctcgcggatcccgattgcgaccagcgccatcggccgcgccttcctcgccggcctgcccgaacaggagcgcggcttcctgatggaacacatccagcgccgttccggcgccgaatggcccaagatcaaggaaggcatcatacaggcgctggacgaggtgaatgcccgcggcttctgcacctcgatcggcgaatggaccaccggcgtcaatgccgtgggcgtgccgctgcgccggccctcgggcgggctgatggcgatcaattgcggcggccccagtttcatcgtccatcgcgagcggatcgagaaggatatcggcccccgtctggtgcgcatcgcccagcagatcgaagcctcgctggtccgccgctgaccgccacgaccgacgccccccccaggaccgacgcccccaggagttgcagacccgacatgaccggacgccccaccatcgtctcgcccgcctccccgcccgatgcggtggaactggccgcaatcctggccgagggtgaaccgccgggcgcctacaatggtctgatcggcacaaagctggtccgctggcagcccgattacgccgaggtctcgatcgagcttggcccccagcacctgaaccgtgccggcgtgccccatggcggggtgatcgcctcgatgctcgacagcgcctgcggctatgccggcaattactgccccgaccccacgcgggcgcgctattgcgtcaccctgtcgctcaccatcggcttcatctcccagacccgcggcaggcacctcaccgcccgcggccgggtgatgggcggcggccgcaagatcttcatggtcacgggcgaagtcaccgacgagaccggcgcgctcatcgcctcggcccagggcaccttccgctatcgcggcggcagcgaatcgctcgaaggcgtgccgcggggctgaccttcgatggcacgcaccccatcttctgctacgatgcgccggagatggaggctctcatgcaaaacgtcgacccgttgggccttgatatgctcgacttagacgttcttcgccgcaagatcgccgaggccgatgccgaccctcggccagatcttgacgaagaagacctcgatcgtcatttcgcggtgctgctccgggaagcactggctgctcgcagggcctgagtatttctatgcatacctgaatatttccctgcatatctgtcatccctgctcagacgatccgtctgaccggcgccccatccagccaggcggccaccgcctcggcggtctggcgatagaagatgcggaagttttcggccgtcacatagcccagatgcggggagaccaccaccgtcggcagttgccggaacgggtggtcggcgggcagcggttcccggtcgtagacatcgaggcccgcgccggccaggcggccggtcgacagggcgtcgatcagcgccgcctcgtcgacgatcggcccgcgcgaggtgttgatcagcaccgcccccggtttcatcatcctgagcgccgccgcatcgatcagcccgcgcgaccggtcgcccagtttcagatggatggtgacgatatccgccgtcgccagcagatcctctttcgagacgcgtcgggcccccacctcccggcagcgggtatcggtcagattggggctccaggccacgaccttcatgccgaaggcctgcgccacctctgccacccgtccgcccagccggccaaggcccagcacgcccagggtcttgccctccagcccccgtcccatcaccgtctgccagggctgccccgccttcatgcgggcgctttcggcgccggccccacgcatcacctccaggatcagcgcgaaggtcagctccaccgtgggggccgccaggccttcggtgccgcagaccgtgatgccctgtgccccggccgcctccatgtcgatcgcggcattgtgcatgccggtggtgacgatcaggcgcagatccggcagccgttccagcacccgtgccggcaggggcgtgcgctcgcgcatcacgcagacgatgtggaacccggcgagcgccgccaccaccgcctcctcgtcggcaaagccggtatgaaagaccgtcagcgccgcccggtcttccaccgccgaccagtcggcgaagccggttgcgacatcgtggtaatcgtccaggatcgcgcagcgataccgcatcggtcttctcctgcctgcaaacgccacgaaccgccgcggcaccggccggcggcggttcgacagggatgatacaggagatcggggcggaaggttccggtcagatgaacagcttgcgcagctggcttgaaatcacatccagcaggctgaccatgacgatgatcatgatcatcaccgcgcaggtctcggcgaaatagaagccgcggatcgcttcccacagcaccacgccgatgccgccggcaccgaccatgccgaccaccgtggccgagcggacattgctttcgaaacggtagagcgaatacgacacccagagcggcagaacctgcgggatcacgccatagatcacctcggccagcggcccggcaccggtggcgcggatgccctccaccggccgcgggtcgatcgcttccacggcttccgagaacagcttggccagcacgccggtggtgtggacgaacagcgccagcacgccggcgaaggggccgaggcccaccgccaccacgaacagcatggcgaagaccatttcgttgatggcgcgcagcgcatccatcatccgccgcaccggctgcaccacccagaccggcgccacgttcgacgacgacaggatgccgaagggaatggcaaaaacaaccgccagaaccgtgccccagagcgccagctgaatggtgaccagcagctcgtccagatagaagcgccactggtggaaattcggcgggaagaactcggccccgaacacgcccatattgccggcatcgcggaacaggtcgagcggccgcatctcggcgccgtcccaggaccagaccagcacggcggcgagcaggccgtaggtgacgtagcgcagcagcgatcccttgaggtcgcgcggcggcgtgatgccgggcgtgcggggctgggcaagatcggtcatggcggccggaactttcagagaaaacgacgtcgatggtcgagactggtctgacatgaagaacgaccggcggcgcgggggccgccggtcgtttgaggccgatggatcacgaagccttggcggccttctcgatctcggcggcgcgcttgttcagcgcgtcgagctgggcgtcgatctcggcgatcttcttcgccttctcgtcggcggccatggccgtatcggcctcgagcttcgccttcgagcggaacagctccagctgacggatcgggatcagctggtcgttgctgctcttgcggaacggcgcccaggtcagaccctgcagaaccgccttttccttctcggcgtccgggccttcgacaccataggtcaggaagaagctcgcgatcttctccttggcctcggccggcaggctggtgcgccacacgatcgggtcggccgggatcagcggcgacttccagatcaccttgatctgcttggccttctcggggaaggtcttctcaaggcgggccatgttctcggtgttgttggtcgcaacgtcgacctggccgttggcaaccgccagcgcattggtctcgtggttcgctgccagcgtccgcttgaaggcggtgcgggcatcgacattgttctgggcgaagacgtagtagctcggcaccaggaagcccgaggtcgagttgggatcgccgttgctgaaggtcagatccttcgccttggccagcatgtcgtcgaccgtgttcaggtcggtgcggtcggcctgggtgatcagcagcgaccagtagccgggcgagccgtcggccgcgaccgtctgggcgaagatctcgccgccggcgcggtccaccgcttccatcgccgacttgttgccgtaccaggcgacgtcgaccttgtcgaagcgcatgccctggatgatgccggcatagtcaggcgcgaagaaggccttcacctcgacgcccagcttgcgcgacatgtcggccaggaacgggtcccacatgctcttcaggttctgggtcgactcggtcgagatgatgccgaagttgatctccttcatcgaggtgatcttcatgtcttcggcggcggcggccggcagggccgaaccgacggcgatggcggccgccacggccacctgggtcagacgcttcaggaacatggggtgcatgccttccatggggcgtgggatgcgtgaggcggaagcactgggtggcagggcgcggcgtcagaccgccagcgcctgccccgcagaagcagaggcagcggccggcgcggcgcggtcacgcacgggcaggccgatatcctcgatctcggtcccgtagagacgggcgagcatgtcgttggtcagcgcggcagacgggccgtcatagaccagcctgcccttggccagcgcgatcacccgcgagcagtagcggagcgcgtaatccacctggtgcagcgagaccacgacggtggtgccgtcctcggcattgatccgggcgagcgtgtccatcacccgccgggcgctttccgggtccagagacgcgatcggctcgtcggccatgatcacctcggcctgctggaccagagcgcgggcgatcgcggcgcgctgctgctggccgcccgacagtgtcgaggcccggcgatgggcccattcggcgatgccgacacgctccagcgctgccagcgcccgcatgcggtcgtcgcgacggaagcgccctgtgatcacccgccagagcggcaggctgccgagcgtgccggtcaacacattggtgatcaccgtcagccggccgaccaggttgaactgctggaagaccacgccgatccgggcgcggcgccggcggatgtcgcgggcaatgcggccgttcttctgcaccgaaccgcccagcatgcggatctcgccgccttccgtgcggtctgaggcgatcaagccagaaagatggcgcatcagcgtcgacttgcccgagcccgaggcaccgatcagggcgaccatttcgccccgggcgacctggaagctcacgccgtccagcgcacgatggccacggaacgtcttggtcaggcgcgccacctcgatggcgggtgcgctggcgctgtcggtcatcgccggtcggtccttccgaatgtcctgcatcggggggcaatgtcgcctcgcgcaggggtacccccgtcggagacgtcccggtcaggccggccaggcgggttcagatcacctgcggccgtaccccgggcggccacattgcgcggccccgtcggctatctgattagccggcttcgatgacgtttcggtgacgacgcggtaaagcattgatgaagggccgcccccatggcatcacggggctgccggagggccctgccccctagacaaatccttgatacacatccgcaattccggatctatccggagggatgtcgccccttggtcttcaggagatccgcgccgatgccggtaccgtaccgtgccgccctttacgtcatgcccggcacctcggacccgctgggtgccttcggggctgcctggctcggccgcacggcagatggcggccccctggcgccgcgcccggtggtaccggagacctggtccgccactgcccttgataccgtgacggcagagccacggcgctatggctttcatgccaccctgcgcgcgcccttccgcccggccgacggcgtcgatctggacgcgatcgaggcccgggcggcggagcttgccgccgccctgccccgggtggtgatcccgcaagggctgcagctccgccggatcgcgcatttcctggcgctggtaccggccgcgcactcggacgcgctgcaggatttcgccgcccggatcgtggagggcaccaatgatctgcgccggccgctcgataccgaggaccgcgcgaaacggctggccaaaagccgtctcagcccgcgacagatcgagctgctggaccgctggggctatccccatgtgctggaggatttccgcttccacatgaccctgaccggccggctacccgaagacgagccggcggttgcccggctgttcgatgccctggccggcgccaccacggcttttgccacccggcccttcgtcatcgatgccgtcgcggtcgcggtagaggcagagccgggcgcgcccttcatttgccaccgccgcttcgcgctccgcggttgatgcggcagacgcaggatgggatgctgacacgtcaacgacaacggcgcaaaagcacgacatccccctaccgcatccgaaggcagaatttccatgaagggcaaggtcatcggcttcgacagccggacgggcacgggcgccatcgaaggcgaagacggcctgcgctatgaattctcgggcaccgaatggcgaagcgtcatccgccccgaagccggtgttcaggtggacttccatcccgagggccagatggcccaggcgatctttccggtgcaggcgccggccgccgcccgggacggggacggcttctcgtggtgggcgttctatttctcgttccgtggccgcaccacccgcaaaccctattggctgtatctgatcctgccggtcttcgtgatcagcatcctgttgaccctgctcgatgtgggcctcggcacctacaatgccgaaaccgggggcgggttgttcagcgggctgttctctctggcggcaatctggcccagcctcgcgatcggcgcccgccgctgccatgatcgcggccgcagcggctggtttcagctgatcatgctgatcccgctgatcggctggatctggctgctggtcgaaatcggcttcctgcgcggcaccgagggaccgaaccggttcggtcccgaccctctgcacaccggctactgatacatgccggcggctggccgccgtcagccgccgatcgcgcggatgaaggcggcaacggcgtcgtccagcgcgccgccattgtcgaccacaaccacatcaggtcctgcgggcatctccgcccgggcccgggccaggcggcgccggatgtcctccggcgtctcgcggccgcgggcggccagccgttcggccagcaccgcatcgggggcatcgaccaccacgatcctgaccggcgccgcccgccgccgggcatcgtccagcacggcacgcgacacattggcgaccaccgtcagcccgttgcgccgcgccgccgcaaccgtcgccgggatgccgtagcaaaggccgtgggcctgccagtgcagcaggaagtcgccgaccgtcgcccgggcttcgaaaccggcaacagtttcgggctcgtgatcctcgcccccggcatcggccggccgggtgatcacccgccgggcgaagacatgacggccgctcggggccagttcggcccgcgcgcgcgccatcagcgtgtccttgcccgcgcccgacggccccaccaccagacagagcaggcccccggtctcaccttcggccgcagccatgatcagagcacctgccggccgcgccgccacacggcccggatcagcggcacatggccgtcgaccacggcgaagcgcaccagatcggcctgcgcgccggccgcgatccggccgcgatccttgagcccgaccgcacgcgccggaatgtcggtgacggtgcgaatggcggccgccagccccacgccctccacatccgccagcatcatggccgcatgcagcaggctcgccggcacgtaatccgacgacagcacgtcgagcagcccggcttcggcaagagcccgggccgagacattgccggaatgcgagccgccccgcaccagattgggcgcccccatcagcaccgccatgccggcggccttcgatgcgcgcgcggcctcgatcgtggtcgggaactcggccaccgagcagccatcggcctcggcttcggttacatgctcggccgtggcgtcgtcatgggaagccagtgcatagccgcgcgcctgcgcctgtgccaccacataggcgcggttggccggggcgtgttccgcctgcatgcgcttctggttgacgatcatctccccgatctcgtcggcgctgacgccatgcttgcccatataatattcgcggtatttcgcctcgtcgacgaactgccgctggccgggggtgtggtccatgatcgacagcatgccggtcagcggatggtcgatcagcggctcgaccagcgcctgcatccgttcatgagcgatctcgcagcgcagatgcagaagatggtcgacgcgcagcaggtcgcgggtcttggcatcggccactgcatcgatcatgtcggccagatcgcgcgcccggttgccctgcttcagatcgccgatggtcacggcgtcgaagaccgtggtgatgccggccgcggccagttctgcatcatgcgcccgcacggccggcaacgccggccagcgcacccctggccgcggcgcgaaatgccgctccagattgtcggtgtgcagctccaccagcccggggatcagatgatcgccctcaaggtcgatcgcacccggcacccgagagatcccctcggccagttcgacgatgcggccgtccgcgaccaccacggtcgcccgcgccagcacggtgtcgggcgtcaccacccgggcattggtcaggatggtctgggcggtcatgcggcggctccggcgggagtgaggggcagaaggcgggtcgccaggcgatcacgcaccgcccggtcgtggaagatggcgacgatcgcggcaccattgctgcgggcggcttcgatcagtccgcaggcggcatcgacattgccggcgtcgagcgaggcggtgggttcgtccagcagcagcaccggatgaccggcggccaggccgcgggcgatgttcacccgctgctgctcgccgcccgaaaaggtcgcgggcggcagcgaccacagccgctcgggcaggttcagcgcgaccagcagttccgctgcgcgcgtctcggcttcggccgcccctcccccgcgccggcgcagtggctcggcgacgatcctgagcgttgcgacacgcgggatcacccgcaggaactggctgacatagcccatggtccggcggcggacatccagcacctcgcgcggctccgccgtgcacatgtcgaccacctcgtcgccatggcggaccagaacccggccctgatcggccagataattggcgtagagggttttgagcagggtgctcttgccggtcccggaagggccgtccagcaccacgcattcgccgggcgccacttccagatcgacccggtcgagcaccggcagccgcacgccgccctgggtgtgaagcacgaaggtcttggagatgccttcggccttgagccgccagccgtccgcgaccggcatcgccgttccggcgagatcttgcgtcatcggggtcaccatcggatcagacctggagcacggaagagacgagcagctgggtataggggtgctgcgggtcgtcgaggatctggtcggtcagcccctgttccaccacccggccgcggcgcatcaccatcagccggtcggcgagcaggcgggcgaccgccaggtcgtgggtgacgatcagcaccgacaggcccagatcctcgttcagttcgcggatcaggtcgagcagccgcgcctgcaccgaaacgtcgagcccgccggtcggctcgtccatgaacaccagcctgggaccgatcaccagattgcgggcgatctgcaggcgctgctgcatgcctccggaaaaggtgcgcggcagatcgtcgatccgcccgccatcgatttccacccgccccagccagtcgagcgcccggtcgcggatccggccgtaatgccgggcgcccgtcgccatcagcggctcgccgacattggcgccagcggaaacatccagccgcagcccgtcgcgcggattctggtggacgatgccccattcctcgcgggccagccggcggcgctcggcctcgcccatggtcaccacgtcatgggtggtgccggcgcggtcggtatagagcgcctgaccgccatcggcttcgatccggcccgacagcatgccgagcagcgtggtcttgcccgatccgctctcgcccacgatgcccagcacctctcccggccacatccggaacgagacgtcggtgcaggcgatggcggtgccgtagcgcttctccagcccctccaccgccagcaacggccgggcgggggacagggtctcggcggcctttgcgatcgcgttcatcgcgcgccctcctcgcccggatggaacggggcatccatgcccggcccctcatggccggcctcgcgccggctggtgcagtgatcggtgtcggaacagacgaagatccgcccgccccggtcgtcgacgatcacctcgtccagatagctgtcggtggcaccgcacagcgcgcagggccggtcccagccttccacgtcgaaggggtggtcctcgaaatccaggctgcgcacggtggtatggggtgggatcgcgtagatccgcttctcgcgcccggcgccgaacagctgcaggaagggcgcatcatccagcttcgggttgtcgaatttggggatgggcgagggccgcgccagatggcggccggccaccatcaccggatagtcataggtggtggcgatgcggccgtggcgggcgatgtcttcgtagagcttcacatgcatcgcgccatattcggccagcgcgtgcatgcgccgggtctcggtctcgcgcggctccagccagcgcagcggctcggggatcggcacctgatagaccaggatctggtcttcggtcagccgggcttcgggcacgcggtggcgggtctggatgatcgtcgcctcacgcgtccgctcggtggtggcaaccccggcggtgcgggcgaagaagcggcggatcgacaccgcattggtggtgtcgtccgcgccctggtcgatgaccttgagcacgtcgtcccggcccagcacggcggcggtcacctggatgccgccggtgccccagccatagggcaacggcatttcgcggctggcgaagggcacctgatagccggggatggcgacgcctttcaggatcgcccggcggatcatccgcttggtctgctcgtccagataggcgaagttgtagccgtcggcgctgctgccatcggcgtcagcggcaagaacggtggtcgtcgcgggggaggtcattctgccgcatccctgttctggtcgtcggcgtcctggtcgtcagcgtcctgttggccaccgtgccgctcgccatgcgcgcggcgcaggcgacggaccatgtcgagttccgactggaagtcgacataatgcggcagcttcagatgctgcacgaagcccgaggcttcgacattgtcggcgtggtagagcacgaattccgggtcctgggccgggcccatcaccgcttcgcccagctcgcccgcgcgcatcgcccggtcgaccagcgccatggccatggccttgcgttcaacctgaccgaagcccagaccatagccgcgggtgaattgcggcggcgccgcagccgtgccgcggaactggttgatcatctggcattcggtcagttcgatctcgccgatctcgaccgcgaaacccagctcttcgggcaccatctcgacggcgactttgccgatgcggatctcgcccgcgaaggggtggctgttggcatagccgcgctgggtcgaatagccgagcgccagcagaaaaccctcgtcgccgcgggccaggctctgcagccgcagcgcccggtcggcggggaaatccagcggctcgcgggtgaggtcggggaccgtctcttcgtcctcgtccacggcgggcagctcgcgctcgatcagcccttcatggttcagcagatcggtgacccgcggcatggcgtcgtccagcggctctgccagcggcagaaccggttcgggcgccgtctcgccgtccagcaggccgaaatccagcaggcgatgggtatagtcgaaggtcgagcccagcacctggccgcccggcagatccttgaaggtggccgagatgcgccgggcgatcgccatgcgcgcggtatcgaccggctccgtcgcgccgaagcgcggcagggtggtgcgataggccctgagcaggaagatcgcttcgaccaggtcgccctgggcctgtttgatggcgagcccggcgagttcgggatcatagaccgagccttcggtcatcacccggtcgaccgcccggcccagctggctggtgatctggtcgacgccaagctccgccacctgcggatcgccgcggcggtcttccgccagcagccggtgggcattggcgatcgccgcctcaccgcccttgaccgcaacatacatcggatcagccctccggggtgatgcgggtggtgcgcggcagggccgccagccggtcgcccgccgtcagcacaatgtcgagcccgcggggatagagcggcgccagcgccgcgcgggcctcaacgaagccggctggcagcccggtgaccgccagatgtgccgctccatcgatgccgggtccttccagccgccagcctgccgccggcccggccgacagcgtctcgacctcgatcaccagcgtggtggaccggtcgggataggcatcggtgccgagggcgaaacgatcgggcgccggcatcgcctcgggatcgccgatcaccgcaaaggccgccttgtcgggggcgaccgccagcggcgcgccggtgtgaaagcgcagatagggcagcgccggggccgagacccggtccagccagacgggggtgtcgtgatcggccagcgccagcagcacggcggctgcggcgcgcgacagcggccggtccagccccgggaccgccgtcaccctggcgatacggccggggcgggccatggcgtccagcacggcgcgaaaggtggtctgggcatcgccgaccgggtcggggaagccgggggcaaggctggcgagcggggccaccgccggcatgtcaagggtcaggctcatccgtgtcactccccgcggaccatggtgaagaactccacccggctcgccgccgccttgcgcgacgccagggcccgggccgcggcctgttcggccgccagcggctcgaccaggtcgcgcatcagccgggggccgtgggagccggtctggagcagcgcgtccagaaccgccaccagttcggccttcgcccggtcgcgtccggcgacatagccgaccccggcctcgccgtccttcagccgcaccacggcgcgcgagacggtcatctcgcccagattgaaccgggcccctgccccgcccgctcggccgcggaccatggccagaccggtttccgggcggcgcagggccaccgcccccgccagcacaccggcccggccgccgggcagatcatccagcgccgcctgcaaccggccgcgatcggcacgggccagcaccgccagccagcgcctgcgcgccgcctggtccgccgtgccaccggccgtttccgccgtgccgccggccatctccgccgtcatcgtcatcggacttgttccttccgtacccgcgtcgaagcggatgtcgacaacttggtatatttgtatagacatccgtatctctcatgggcatgatgcctccatccccgcccgagggcaagaccgggagggtgacgtttgcatgacgatgcggtaccgcagcaggaccagaagggggatcggatggccattgaccgggaaccgggggtgacgctctggcggcagatcgaacgggtgctcgcggacgagattcagcgcggcatcatgacgccgggcgcccagctcgccaccgaacaccagctggcggaacgcttcggggccaaccgtcacaccgtccgccgggcgatccgcgaattgaagacccgcgggctgatccgcgtggaacagggccgcggcaccttcgtgcatgaaaacgtgatggactatgccctgggcccgcgcacacgcttcagcgccaatctgaaagcgcaggagcgccggccggccggcatgctgctggaggcagccgccgtcgccgccaccggccgcgtcgccgaggggctgggcgtcgcggaaggcgcgccgctgatctatctcaccaccctctctttcgccgacaacgtgccggtcagcctggggcggcattacctggatttcgaccgcttccgcggcatcgacgaggtgttccgcgaaaccccctccatgaccctcgccctcacccgcttcgacatccacgactacacccgcggccgcacccgcatcaccgcgcgcatgccctctgccgaagaggccgggctgctgcgccagccgcccaaccggccggtgctcaagacggaatacatcgacgtcgatgtaaatggccggccggtgcagtacggcatcaccctctttgccggcgatcgggtgcagatcgtcaccgacccgcgcaacccggatgcaaccgacagaaccgatgcatcgacatcaatgtaaatcgccggcgcccgcgccgaccatggcgtgacgccagagaattttcaccgccagctcagcgacttacggcagatccctgcagcgaatttcggtccacgggttggtttcggcgcgccgatcccctatatttccgtcgaacccgccacaacgaccatgatcaggacccctcgcttggtgacgatcagccgacgcgcggccctcggcattcttgccggcgccgcagctgccacgggtatcgcaggaaacgccctggcccagaccaatccggcccccgcaggggcaccggaccccgagaacaccctggtcatgacccttgcgtcaggcaaggttctgatccgcctgcgcccggacatcgcgccgggccatgtggcgcggatcaaggaactcacccggcagggtttctatgacggcgtggtcttccaccgcgtcatccccggcttcatggcgcagaccggcgaccccaccggcaccgggcgtggcggctcgggcaagaagctgaaggcggagctgtcgaacacgcccttccgacgcggcaccgtgggcatggcccgcagcagcgatctggacagcggcgacagccagttcttcatctgctacgaccgtgccggccatctcgacggcagctataccgtctggggtgaggtgatcgaaggcatggatctcgtcgaccgcatcgcgcccggcgaaccgccgcggcgcccggaccgcatcgagaagatgcaggtcctggccgacgcagccccgaagtaatcccacagccgcggcggcccgaaaggccgccgcggaccgttccatctgtccgtttatcaactcgaagttgataggtgatgcagcagactttccggatcaacatgcaaggaggatctcccatgaacagcggccgtcccgataccagtctctggggccccggcaaggccatgttcgatgatgtgtacaacctctcggatccggcagcgtactggcagcgcctggcacctctcgattaccagacccccgagatcgccgcaggcttctaccgctcgctgctcggcagcctggcggtggcacgcggccgcgggtcgctgaagttgatcgatctgtgcagcggctacggcgcgctgccgatgatgctgaaccacgatctgcagcccggcacgctgcaccggctctataccgatcccaagcgcgcggctcagcccgatgatgccggccgcatcgcctatgaccgcaacatgctccaacgccgcaaggcggccgcccagcaccgcatcgccggtgtcgacgtggccgagaatgcgctgcgctattcccgcaccgtcggcctgatcgaacgggccttcgtcgaggatctggagaacgacgcgccgagcgccgagctggcccgctgggcggccgataccgacgtgatcgtcgaggccggcggcatgggctatgtcggcgaggcgaccatctccaagctgatctcggcggccgaggacggccgcaagccctgggtgctgtcgatgccggtgcgcaccgtggatacgcacggccttgaagagatgctggccgatcacggctatgcggtggagcacagctccaagacgttccgccaccgccgcttccacgaccagagcgagcagaccgccgcgctcgaccgcctggccgatttcggcatcgacaccggcggtgccgaaatcgacggcttctaccgcgcccgcctgctggtcgcccgcccgaccgcggaagccgcagcctggcccatccaggccctgctgccggcagcctgaccagtagaatacggcctggcttttggccggtcagaccgacgacgggtgatcgcttcggcggtcacccgttttttattttgagcggcgacatacaactatgtggagagcgcttcaagcttggctgagatggcgcaacatgacccggtgcaggcgggttggccttcccctcccccggcccgcccggccctggagtgccgcacggatttgatctggcatcttgttagctagtgggaccagcatcaaatccgatgtttcaggcttcagcgacaactccgtaacgccttcctcggcgagtcggtcgttgaggcgagagagaagggcgcgcgcgcattccgcgttcattccctgaagtgtatcttgaacagcttttggcgaattaactcccaggtcattcaaaagatcaaaaagttgccctgaattctccgcaaatttcggcatggcgtcaccccagaaatctcgcatgcgacttacaaaatcatggacatccatgaacggccgctcaggatcgacagagttggacgccggattgattgctgtaagacgtctctcatgcgcagccatgagagcggaaataacatgatctcctcgacgcacaagtctccccaggtcactgagatggtaggcctcatcaggtgaaggtccagcatcgtccgacttgtagccaatgtcatgctcaacttcattccagacatgagctatcatcgtacatatctgaatttcgcaactaatatcaccgacattatcgtaaattccaatcaattgatcttggcgcaatgcagcctgaacgtgagtggctcgataataattttcatttaaatcagtcttcttatccttacgatcaatctcgattgtttgctgtccggccgggccacaaaacaattcttccattttttgaacaatttgattacaatctttttcttgataagcagatacacgaactccagcaagatcactaatcgatgcgaatatctcgtctatagacgtataattgcggtcctcgcgagacgcgaagcggcgaagtttaccctcaaatgatttttccgtcttgatacgaaaagttacgtgagcacgaatcgcattctgctcgcacacatcctctctgcagatttccgccacacgatcagcaagtttgacgtagcgatcacgttcacgacgatagcgggcaaccgcctcagtaataagttcatcagagaatggcatgaccgacagcgcccccaggatatccgctcagcaggctttcgacgccctgctgcgatagccaaatacaacaaagttgtgacctattaacatacttaaccgaaattcgggctcggacgcaagcaatcaggcgttgatggctgtccgcacagcacttacgaactgatccggttcacatcggattgggtggcgctccgttgcaaatcctttccgcattgcggaaacagcacaggagcggcctgctgcggtccggctcccgtttgcccatatgctcgaatctgatatgattgagcatacaggaggtgcgatcatgccgaatgtccatctgacggaaccgatgcgggactatgtcgacggcctgatcaggtcgggggcctatgccaatctcagtgaagttgtacgcgcagggatccgcctgctgatggagaaggacggcgcccggcagttttatgcgttgaaagccgagcttgagaccgccgctgccgcggcggagggtggggctttcatcgaattcgacccgcgagggttcgagcctgatgccttcaagagctgatcttctgaatgtcgatcaagctctctgatctcgccctgcgggatctggacgaaatccggcagtacaccatccggcagtggggcagagagcagtggctgcgctattatcgcggcctggtgtccgtcttcgagcagattgaacacgcgcccgaggccggacggccacgagatcttttcctgccgggcatgcgatcggtcggcttcggccggcacattatattttatgcaccgatccgctccgcgggcggccgcacagtcatactgcgcattctgcatcagaagcgccatctgccggcgttgatctattatgaggacatcgagtgaaggcgttgccttccttcacggtccgcccgcgtccgagccgggcgttatcgaaccgctgcgtcgctcatgccatcgacggcccacctcaccgccgccgcctttttcacccctccggctttttcgctcgcatcggcggatgatcgggctaggatggggcgcgtcagcggtgaacccggttgcgggcggtgccgtgtggctttttgacgatcctgcatccacatccttccgaccacccgttacggagccctccgctcatgaccgacaccgcgctcgaccccgagaacacgctggtgatgaccctggaccacgggacggtggtgatccgcctgcgtcccgacctcgcgcccggccatgtcgcccgcatgaaggaacttgcgcgcgaaggcttctatgacggcatcgtcttccatcgcgtgatcgagggcttcatggcccagaccggcgaccccaccggcaccggccggggcggttcgggcaagaagctcaaggccgagttcaccaagaccgcgttcgagcgcggcgtgatcggtgcggcccgcacccccgatccggacagcgccgacagccagttcttcatctgcttcgccccggcccgcttcctcgacggccagtacaccgtctggggtgaggtggtcgagggcatggaggcgatcgacaagatcgcccgcggcgagccgccgcggaagccggatgcgatcaagagcctgaaggtcaaggccgacatccagggctgacacgcaaccttggatacgccagacaccacgtccgggggcggcaacaccccggacatcacgaccggttcgaaggccgcgacgcgcgacccggccgaagtcctgcacgaggtcttcggctacaaggcgttccgcggccttcaggccgagatcgtggaccacgtcacccggggcggtgacgccctggtgctgatgccgaccggcggcggcaagtcgctctgctaccagatcccggcgctctgccggccgggggtcgggcatcgtggtctcgccgctgatcgcgctgatgcaggatcaggtggaggcgctgcggcagctgggcgtgcgcgccgccgcactcaactccaccatccccttccgcgaggcgatggcgatcgagcaggcgatgcgccggggcgagatcgacctggtctatgtcgcgcccgaacgcctgctgaccgaacccttcctgcgtctgctcgacgagatcgagatcgcgctgttcgcgatcgacgaggcgcattgcgtctcgcaatggggccacgacttccggccggaataccgccggctgacggtgctgcacgaacagtggcgtcatgtcccccgggtggcgctgaccgccaccgccgacgcccccacccgcgccgacatccagacccatctggaccttggccagggccgggtgttcctgtcgagcttcgaccgccccaacatccgctaccgcgtggcccccaaagagacgccgcgccagcagatcaaggatttcctggatcgccaccagggcgaggccggcatcatctactgcatgtcgcgggccaaggtggaagagaccgcaacctggctgacatccgagggcatcgacgccctgccctatcatgccgggctcgacaaggatgcccgcgcccgcaaccaggaccggttcctgaaggaagacgggctggtgatggtggcgaccatcgccttcggcatgggcatcgacaagccggatgtgcgcttcgtcatccatctcgacctgccgaaatcgctggaagcctattaccaggaaaccggccgcgccggccgcgacggcctggcctcggaagtgctgatgctctacggcacgcccgacatcgcccggatctatcagctgatcgaggcgtcggaagcggccgacacccagaagcgagtggagcggcgcaaggtcgatgccctggtcggcttctgcgagaccacgcgctgccgccgccaggtgctgctggactatttcgacgaacacggcacgcagccttgcggcaattgcgacacctgccttgagcccgcccgcaccttcgatggcacggtcatcgcgcagaaggcgctgtcggcggtgtatcgcaccggccagctgttcggcgccgcccatgtcatcgacgtgctgaccggtaccgtcaccgacaaggtccgccagttcggccacgacaagctcagtgtcttcggcatcggcagcgagctggacaagcgcggctggaaggcggtgttccgccagctggtcgcccatcgcctgctggtggtcgacaccgccggccatggcgggctcaggctgggcgacaacgagacctgccggccgctgctgcgcggcgaaaccagcctgacgctgcgcgaagatccggcgccgcgccgccgcggccggggccccgcccgcgaccgcagccggcccgaacgcccgagcctggcgggcgaggacgagaccatgttccaggcgctgcgccgcctgcgcctggcgctcgcccgcgcccagggcgtgccgccctatgtgatcttccacgacgcgaccctggtcgagatggcccgcaaccggccgctggacgagcgcgcactggccgaaatcccgggtgtcgcctccaccaagctcagccgctatggcgacgccttcctggcggtgctgcagggcgaggatccggaggcggtcgccgacgggttctgaccctccagggccaatcgggcgatgacgtccagtttcatatggtgaaatctcgggccggcaccggccggccgaagaaccagccctgccccagcgcatcgggatgttccaccgccagatggcaggcctgggcctcggtctcgataccctcgacgatcacctcggcccccagaaggcccgcaagcgcgaagatctgcggcacgatcgaggcgctgatcgcgccggtgccgatcgcccgggtaaacagccggtcgatcttgatcgcatctaccggcagttcgcccagatgggccaggctggaatagccggtaccgaaatcgtcaatatgaatgcgatagccgcggtggcgataccgggccaccgccggcgccagctgctgatattcggcggtcgaccgctcggtgatctccagggcgatccgctcgggcgcgatgccgagccggcgggtttccgtctccagaagatcgaagatgtccggatcgagcagatccatggtggtgacgttgagtgccaggcggaaatcgcccggcccggtcagatgcggcgccatttcgtccagcgcgcggatcaggacataacgggcaagttcgccactcaaccccgtccgttcggcaaccggtacgaaaaggtcgggcgggatctcgccgccatcgggccggtcccagcggatcagaccttccgcccccacgaccaccccgtcgcggacccgcaccaccggctgatagaccagtcgcagacgaccggcagccagcgcccggcgaagatcgtgttcgatcgacccgcccggccggcgccactgggtcatggccagggccgaggcggcgccggccagcgcccccagcaggcccacgcctgcgaccaccggcatcggctggcccagcatgccccgatcacccgaggcaacggcgatgcagatatcgaaccgtcgcgagcaggcggcgggatagacgcggccctccagcaagaccccacccgccgtcgggcgcacgttcaggctgcgggtcggcgtgccgtcgccggtgcggaaaacccggccggtgctgcgcgcatagctgaaaaccagccggccttcgttgcgcatgaaatcgtaggcggcgtccgagatgaacacgatcgtccggccgaggctcaccatgtcggtggtgatgcgccgggccgccggattgcgggaggcggtccagacccgcgcgccgctcggtgcttcgtaatccggcggatccagcggggtcggcaggtccagctgcccccaggcggccgtgcacaggatccggtccccgtccagccggccgacatcgcggatgaagcgcgaaacgaagatccgctcgcgcagcagggccagatccagctcggaacaggtggccgccatatccgtgttggcggccacaagcatccgcgccgcctcgtcggcgatctcgtccgatcgggccaccatctcggtcagatgtgtctcaagcgtcgcatccgacattcgccgggcgacgaattctccaccagcgagcgcaagcgccgctcccgccagggccgcggcgaacaggagcggcatcaaccagctgcggcgaacccccgtccgatcgatccatccataaagaccccgcgacagcagtgacaccttaaacccctcgcccccggatcgagcaccgttgcatcctgcaacccggttgctcgcgattgggagtgtataggtattgatgccggaacgtacagaggcaggcaatagaatttatggagaattttcttaaaaaccaatcgaaatccattgttcatccgcgccgtgcaaggcgaacacctgtaatgaccacagctgcaccccaaagacgggcgagcgtcagttcttcccccagcagcagaaccgcaaccgcaaccgcgatcaccggggtcagataggtgaagaccatcgcccgggcgacacccagccgggcgatcccttcgtaccaccagacgaaggcaagggcagaggcgaagacgacgctgaacccccaggcggcccagtcggcggccccgagcgccgcccagggctgatcggccagccccggcagcgccagcagacagagcgccagggcgccgaacagcatggtccaggccgtcaccgccagggcgcccagccgcgccagcaggtggcgcgacagcgcagaatacagcgcccaggccgccgcggcgcccagcatcaccagatcgccggccagatcaccggtctcgagatggagtcccgtcaggctgttgttgaccaccagcgccacaccggcgaaggccaccagaatgcccgcccaggcccgcggccccgccttctggccggtcagatggccgaagatcgccccgaagatcggcgcggccgacatcacgatcgcagcactcgacgcgctggtcatgtgcaggccggtggcccagaagccctgaaacgcggtgatgcccaccagccccagcccgatcagcggcagaatgtcgcgccgctggagatgcagacgcacgccgcgcagccgcagcaggatcagcagcagcaccgcgcccgtaatataacgcgtcgccgagaaggcgagcggggacatctgatccagcaccgatttcgcgatcggaaaattgaccccccagatcgccgcgaccgtcagaacctgcaggaccccactctgatacggcccgcgcgtatcgctgcccggcgtgccgctggctcctgcccgcatcgcccctttgccttccatgggtctctcctcccgatcctgttggccgcctgcttgttggtcgcctgcatggccatcatccgccgccgcgaggggtgatcctgggccgcgcccgaccggagcgtcaagcaaacgtatgatcggtggatcgtatgatcggtggatcggcccggatccggcccgcggctggtggatgtctcttcaaggtcacagccggcggggttttgacacgcccagggcacggtctgccggggcatgatcaatcccgatggtgagcggtcgatatgcctcgcccggcaatcgaccctgaccgcgacgcccaaccaggccgagtggacgcacgctctccagcaagcctcaaccctgtcgcctctcgcggcggccgcattgcgcggccgccgttttttttgggggaaatgacggggcggcgatggttgcggcacagccacaacccgtggcattccgggcgcgggctcaccagcagactttgcaggacccccggtctgcgcctatatcgcttgggtcagctttcgtgccgcaatgcggcacccgtgttccggcggtttccgggacgatgaggggcaggaacgaccgcatgaccgaccgcgcgcccgaccgccgggtcagggaccatgtcgacgacccggtgggtgacactgcgcaggtgacggatgcccggcaccgcccgcagacccatgccgagcgcgaggcgcgctctcccgcgaagacccgaccgatcacactggcgctgcagggtggcggctcgcatggcgcctatacctggggcgtgctcgaccggctgctggaagacgaccgtttcggcgtcgaagccgtcagcggcaccagcgccggcgcgctgaacggggcggccctggtcgcaggctttgcgaccggcggccgccagggcgcccgcgacgcgctgaaccggttgtgggaagcagtgatggaggccggacgctacagcccgctccgccgcaccctgctcgaccggctgatgggcggctggaacatggatatgagcccggcgcggatgctgttcgatctgaccagccgggtgctgtcgccctaccagctgaacccgctcaacatcaacccgttgcgcgatgtggtctcggaggcgatcgaccttgatgccgtgcgcaaatgcggggcgatgaagctgttcgtgtccgccaccaatgtccgcaccggcaagatcaaggtgttcgagaacgaggctatcaccgccgaagccctgctcgcctccgcctgcctgccctatgtcttccaggcggtcgaaatggacggcgatgcctattgggacggcggctatatgggcaatcccgcgatctttccgctgatctacggcgcccgcagcgccgatgtggtgatcgtgcaggtgaccccgatcaatcgcgacgagatcccgaagaccgcgaccgagatctgggaacgcgtcaacgagatcagcttcaattcgtcgctgatgcgggaaatgcgtgcgatcggcttcgtcgcccgcctgctcgacgagaaccgcctggatccgcagcgctacaagcgcatgcgggttcactggatcgacggcgaacaggagatggtgccgctcggcagtttctctaaaatgaacgccgatcgggatttcatcctgcatcttcgcgacatcggccgcgcctctgccgacacgtggctgaccgccaatgccgatctggtcggcaagcggtcgagcatcgaccttgtggagaaattcctgtgaccacggtccctgccgctctccgacatctgaccaccgccgccctgatcgccgccgcggtgggcgccgccctgcccgcccaggcgcagggcgttgccgcaggcgccacaggggccgccgcgcaaaaggcggctgcggccaaacccgtaccccagggaccgcgcggcatcatcggccggatcgagacgctgaccgcgaagcatgaagacacgctggtcgatctggcccgcacgctgggcatcggctatgtcgaactgctggcggccaatccgggcgtcgagccctggctgccgggcgaaggcacgaagatcaccgtgcccgccgcccatctgctgcccgacgtgccacgcgaaggcatcgtggtcaatatgggcgacctccggctctattacttcccgaagagcggcggagcgccgctcagcttcccgatcggcatcgggcgcgaaggcttcgccacgccctatggcgtgacccgggtcaccatgaagcgcgacgggccgacctggacaccgacgccctcgatgcgcgcccgcaaccccaacctgcccgccttcgtcggccccggcccgaacaatccgctgggcacgcatgcgatgaatctgggctggcagaactatgtgatccacggcaccaaccgcccctatggcgtgggccgccgggtcagccagggctgcgtgcggctttatccggaagacatcatcaagctgttcggcatgaccgaaagcggcaccaaggtgacggtgatcgaccagccggccaaggtgcaggtgatcgacggtcagttgtatctggaggtccaccccacccagctgcaggtcgaccagatcgaggaagtcggccgcttcacccccgaagccatgcccgaggtggagcccaaggtggcagccgccgcgaccaaggccggtatcaaggtcgactgggaagcggtgacccgcgccgtgatcgagcgcaccggcctgccggtgaaggtgagcctgggcggcggcaccatccccgaactggcggcgctgccgatcaaccccacgcgcaccccggtggaaaagaccctgcccggccagcagtcggtgccggcggaagacggcgggccggcgcggatgacaccggtttcggcgaccgcagccccccaggcggcggcggacagcctgccgaaacccgcggtcgatccgcgcaaggatccgctgaccgcccataccttcccggccgagctgaagcctgcccagccgatcgcccggccggcggagcccgccaatgtggtgacgctgagcgtctcaccggccgcccgcgccgccgccgaagcccgggcggtgcagccggtggcgacgcctgcccctgcggcccttccgacggccaccgccgccatcccgcccgtcaccgccaatgccgcaccgatcaaccagccggcgccgccggcagccgtggacacgcgcatcccgcgcggcgccccggtgcagttgatccagccggtcgcggactgacgcgccgcgctccgattgcagctttgcaacgctgaccggatcagcacagagaaacgagaagggccggcggagatgctccgccggcccttcttttcgtcgacgtccggtgatgcccggctccggtggacgtcctccgccgcagcggaaaccgaagccaagcgaaacccccggcaggccaggcccgaccgggggtttccgtcgcgccggtcacccggcgcgagcgatcacttgcgctggccggcgctgaaggcgcgctcggcgcgctcggcggcccgctcggcacggtcggccgaagcggcagcggcctgggcgctgcgggcgctctcggcggccgaagcgcgcgaggcgtcggcgctctgcttcgccgaggtggcggcagccttcgcctcgttgaggagcatacgatcctcgtccgagaggttcgcgcagccggcgaccgcgatcagggcggtggcgccgaagaggggcagcgcaacgcgcttgatacggttcatggtcatggcacatctccagttgtctgggcagcatgtggcgcacccacatgcgtaccgaggcgaccgtagcacaacacccgtcacgtttcaccggtctgcggagggcggaccgcacggcgccgcatcgcatcgggcctctgttgcacaaaaacaacaggactgcggcatctgtagcaaatgtccgtttatactgtggacgtatggtgtctgagaccacaccctcatatgccgctgatcagtctgccgctgctcatgatcacagcgctgcccgccaggcgcaccgcggaaatcccggtgtgatccaggtcgagttccagatccagccggctggggcggcccatcgcttctccctgaagaatggtccaggcgaccgtccgtggcaccagcaccggctctatccccgccagccaggccgccagggccatcgcggccgaaccggttgccggatcctcgccgatgccggctgccgccccgaacatccgcgaccgcacctgccgcgccgcccggtccacaaccatcggatacaccagacgcgatggcgcgccttccggcagcagccgggccgccacggcagcatccggccggcagcggtccagatcggcatcctgcgccagcggcacgaacaggaagggcatgccggcggacgcgaccagcgccccatcggcaatcgcacgctccggcagcgacagaagtgcagccagatccgcacgtgccggggcatcggccaccggctcgggccggcgcggtgcccccatcaccgcccgcggcagtctgcccgcgccatcggccaggatgtcgaccggcaccgggcccgccgcttcctcgatcaccacccggacagggctgccgtcgcaggcggggctgatccgccccagatgggccagcgccagcacgccgccgatcgtcgggtggcccgcgaagggcagctcgatctcaggcgtgaagatccggaagcgcagatcgcaatccggccgggtcggcggcaggacgaaggtcgtctccgacaggttgaattcgcgcgcaatccgctgcatcgctccctcgtccagcccgtccgcatcgggcagcaccgccagcggattgccgccgaagggctgatcggtgaagacgtcggccgtcagaaaggcgcgccccgggacgtcggcagcggacatgggcttctccccttatggtggatggcgaggcaggacgaacgcgccgatcttgcaccggccgcgcgatccgcgccaccccgtcccgtcagcaggggaatcgggtgaaagtttttaaactgcgatgaggcttgcgaggaagtcgtcgtcccaggcggcgaccttgcgtcggaggcgtagggagtcctttcccggtgcttgtcgcagcaggttatgtgccatgtgcttcagggttgtgaagttggctggggcgttttgggtacgcacccggcattcgtcatcacggaagaccatatccatgacccagtggagactattctcgatggcccaatgacttctgatgatcggcccgacgagagcggcgatgagcgccaatgatgtgatgtagagccgggtttcgctgtcgattttgtcgccgatccgtcgcgtgctttccacgacgacgatgcttttgaggccgggccagtcatgtcgcgcccggagccaggcgacatcatggatgacggtggtcttgcgggtttcgatccggccatgatcgccgtcgacggtctcgtgctggctgatggtcgtatcctggaagcccttggcctgctgttcggcgacgaacagggcgacgtcctcgcgcagcgatccttgattgcctttgagggccaacacgtaatcggccttcttgtcggtgatcctggccgcaatgtcgcgctggcatcccatggcgtcgatggtcacgatggccccttcgatcgccagcaggtccaatagcttgggaatggccacgatctcgttcgacttctcgtccaccttgacctgacccagcaccagacgctgccgggcggcgaaggccgagaccatgtggatgggcgccttcgcgtccttcttcccgcccgaacgccgcacggtcttgccatcaatggcgatcacgccctcaggcgtcccggtaaccgacgccacccacgacacgaagcaccgctgaaagctctccgcgtccagcgacgcgaagatgtcacccagcgtgtcgtgcggcggcgtgccatccgcgaatggccggaagcgccgcagcagatcgagcttcttttggccaaagcgcgcgatgtccgtgaaggtctccgctcccgccagcaccgccagaaggctcaggagcagcacctcatcaagcggatacacaatcttgccagcttgccgcccgtccggaagctcctcaaaatgctcaagaaacccaatcgcttcgcccaaggccccacacggttccatccatccctcccaagccagcaacgtcgacaacgagagattcagactttttccgtcctgtcacgcactgtttcacccgattgccctggtcccgtcagcttccgcgctggccgcgccaccgggagcgtggtttactcgacggccgcccgaaaatgcgggtgacgggatgaatggtccgccatacggacccggtgtgattggacggatgacgatgacgacgatgaccgcgcgcgtgtcctggctggacggcatgatgttcgtgggcgaaagcggctcgggacatacggtggtgatggacggggccgcccagcatggcggccgcgatcacggcatccggccgatggagatgctgctgctcggcatgggcggctgcagcgccttcgatgtcgtccagatcctgaagaagggtcgccagccgatccagggctgccggctggagatcgaaggcgaccgcgccgagaccgaccccaaggtctatacgaagatcaccgtgcgctatgtggtctatggcgacggactggacccggccaaggtcgaccgggcgatcaagctgtcggccgagaaatactgctcggcctcgatcatgatgggcaagaccgccgacatcgagcacgtcttcgagatacggccggcagcggcagcccgcgatgccgaggtctgacacaccgcctgaactgcgtgcagcgaccgtcggcagcccggcggacggcaggccgggtcgcgacgcgccgctctggatcctggtggtcatcaccgcgatcgggccggtggcgctcaacctgttcgtgccgtcgatgccggcggcgcagcgcgggctgggcctcagcgatgccgcgatccagctgaccctcaccctttatctggtggcgctggccggggcccagctgatctatggcccggtttccgaccgcttcggccgcaagccgccgctgatcttcggcatgctgtgcctggcgctgggcagtgtcgtcgcgggttttgccgaagatgccgtgcagctggtcagcggccgggtgctgcaggcgatcggcggctgttccggcctggtgctgggccgggcgatgatccgcgaccgccatgatccgtccgaggcggcgtcgcggatcgccaccgtcacgctcgccatgatgctggcgccgatgctgacccccgcggtcggcggctatgccgatcaatggctgggctggcgggccgggttctgggtcatcacctcgatcgccgccgcgatcttcgtggcggtgaccctgcgcctgcccgaaacccatcacgaccgccggccgatgccgggcctggcgcccatgctgcgcgcctatcgcggcctgctggccgatcgcggcttcctgggccatgccggcgccgccggtttcggcaccgccgccttcttcgccttcgtcgccggcgcgccctatgtgatcatcgaactgatgggccgcaccccggcggaattcgggctctggtatatcgtcgcctcgggcggctacatgatcggcaacatcatcaccgcgcgcctcgcctcgcgcgtcgggccgatgcgcatgctggccgcgggcgcgattgcggcggttgccggctacggctcgctgatcctggcggccggcctgctgccgatggcgccgatgaccatcttcctgccgatgaccggcatcgcgctcgccaacggcatcatcctgcccaatgccaccgcccgcgccctggtggcgggcggcaccggcaatgtcggtgcggcggccgggctggccgggtttcttcagatgggcggcggcgccgtcgcctctcaggtgatcggctggacccgcgccgacgatgcctggccgctggtcttcgtgctggtcggctgcggggtcggcacgcttctctgcacccggatcgcctggggcgcagagcgccgccccggataggtcccgccccgcacaaaaacccgatccacataaaaaaagggaccgcaccgagccagaaggtgcggtccccgaagtgtcggccgcgccggtggtccggtagaccggcggcgaccggagacgtgggtcacgagagacaagatgccgtctggcgcgggtgccggctttgacctgtatcaagaacccgggacattcctgaaaaattccggtcatcccgccccgggccggtcaccgccgggcttgccgcccctttcgcactgcgcgacgatgcaggccagaacaaagcgccgcggcagaacggcgccggaaggaccctggggaaatgcgcgagatcgaactcaggctggcggtcgtctgcttcggcggcatctcgctcgccgtctatattcatggcgtcacacgcgaactggccgggctggtcagggcgtcggaacgtgtcggcgcggcccgccacggccggcctgaggggcgtctcgacccggtcgaacaggtctatgccggtctgctggcggatatcggccgcgaccggccgatccgggtggtgatcgacatcctgtccggcgcctcggccggcggcgtcaatgccgtcacccttgcccgcgcactcgcccatgacctgacgctggagcccctgcgcgcgctctggctggacggggcggatgtcgatgcgctgacggccgagcgcaaccgcgccggcccgttttccaagctggtgctgcggcctctgctaccgatcgcccgccggctggcgctcggcccctcggccgcggcggaagccgatttcgccgaaaagctctcgcgcttcctgcgggcccgctggttcgaaccgcctttcgacggaccgggcctcgccggccggttcttcgatgccctgaccgcccagaccccggccgatccgcatctggtcgccgccggtgcggcgccatcgctgatgccacggggcgtgccgctcgatctggtcgtcaccgcgaccgatttccacggccatccccgccgggtggcggtgggggacccgccctgggtgaccgagcgcgaccaccgccaccggctaagtttcgcctatctgcaggacggcagcggcgtgcgccgcgacgatttcggcccgggcagcctgccggcgctcgccttcgccatgcgcgcgacatcatccttcccaggtgcctttccgcccgcccatctggccgagatcgacgaggcgctcgccgcccgcgggctcggctggcccgaccggcagcgcttcgtcgccggctgcttcgcggcccaggcgcgcggcggggtggatcctgaaaagatctggctgatcgacggcgccgtgctcgacaacaagcctttcggtgcggcgatcgagcggatcccgatccatcccgcaagccggccggtggaccggcggctggtctatgtcgacccgcatccccgcgaccatctggcgctggagaacggccatctgcgcgcaccgggcttcctgggggcgatgaaggcggcaatgaccgacatcccccgccacgagccgatccgcgacgagctggagcacatcgccgaaggcaaccgccgcgccatcgagattcaggatgcgctgagccggacctggcggcggatcgaggcccgggtccatgacgtcgcagggccggcgctggacgccggatcggacgccgaggcggtggcgatcgcccgcgaggccggccacgaggccgcgcgtgccgatgccggttttacttatgacgcctatctgcgcctcaagaccggccgcgagatcgaggcgctggccctgctgatcgcccgcatttcggggctggcgggcgatgatgccgcaccgcttgccggcacggcacgggccgagctggtccccgcggtgcgcgccctggccgagcgcgacgggccggtcgccttccttcgccgcttcgatgcggccttcgcggggcggcggctgcgcttcctgctgcgggtggtgaacatgatcgccgatggcgacaacccgccgccgcccgacgccctcgccggcctgaaagccgatctttatgccctgctcgcccggatcgagcgcagcgccagcggcggcggcgaggcggccgccggggttgcgagcctggcgccggaagaggcggcgggcgaggtggccaaaatgctggcgctgatcgacgccacccgggcactggacgcgcggctggcggcgctggatgccggcaagggcttcggcctgatccaccgccgccggctgattgccgcccatgtcggtttcgcctggctggacgtgctgctgctgccgcttctggacggcgccgaacaggacccctcgcagaccgtgggcgtgatgcggatcagccccgacgatgcccggctgctggagccgggcggcgccgccgccacgctgaagggcatcggcatgcagcatttcggcgcctttttcagccgggcctggcgcgagaacgactatctgtggggccggctgcatggggcggagcgcatggtcgacctgctggtcgatgccgcaaccagggccggtgtcgcaacgccccccgatccggtgccggcgaaatgccggctgtttcgtgcaatcctggagatggaagccccccatctgccgcaggcggccgatctgatccgcgacctgcgtatccgcatcgatcagatcgaggacagccgcacatgaccgacgaccgccaccgatcaggcctttctgccgccgatgccgaagccttcgtagctggcgccaccctgccctctgcaccgcccctgctgcccgaaatccgactgcatcttgcaagcgaggtgacgccgctctgggaggcgaccgaaacccggctggccgaggccggcctgccgccgcccttctgggccttcgcctgggccggcggccaggccgtggcccggctggtgctggaccggcccgaactggtgcggggccggcgggtgatggatttcgcgaccggcggcggggtcgccgcgatcgcggccgcccttgccggcgcggcacgggtggatgcggtcgacatcgaccccttcgccacggcggcggcgcggctgaatgcccgcatcaacggtgccgagatcaccaccctgacggaagatctggtcgggcagctgccgccgccgggcaggcccgaaatcgtgatggcgggcgatgtctgctacgaaaaaccgatggcggaacgggttttcgcctggctgcgggcgctggccggcgatggcgttctggtgctgctgggcgaccccgcccgcgcctatgccccccgcgacggggtggaggcgctggccgtgatcgacgtgccgacggtgatcgaaatcgaagacaagccccagcgccggaccacggtctggcgggttctgcccgcccccctggcctgaccgcccccctggcctgacgacgtcgcaaacattcccgcggcaccagattgcgcagcgggacccgaatgcctaaatatcaggcgacagctcgcgccggcaggcgacgcgcgccataccgtgcggacagatccgtccggcggctggctgcgcggcaccgcccgttcaccgggaggccccgccaggggcacccggcaggggatgcggcccgccggcacgcacgcatggctttgacacgagagagcatgaggagcatcgagcggtgagccggatcctgtacgaccgtctgggcgtcgcgtcgaccgcgagtgatgccgagatcaaatccgcctatcgcaaactggccaagaaatatcacccggacagccgcccgggtgacaaggcggccgaagagaaattcaagcagatcagcgccgcctggcacatcctgggcgacccggcgcagcgcaagcgctatgacgcgggcgagatcgacgaggaaggccgcgagcgcgttgccgccggtttcggtggcggcgggttcggagccggcggcttcggcggtgggcgcaatgccgggttcagcggcttcgagacccatttcgacggccgcaatggcggcttcggcggcgggttcgccgacctgttcgaggaaatcctgggcggccgcgggccgcgcgccggtggattttcggacatgggaggtgccggcatgggtggtgccggagggggtgggcccggaaggggtggtcccggtatgggcggtagcgtgcccgacacggaagcgcggatcaccgtcagcttcacagaggcggcgctgggcgccacccggcggatttcgctgagcggcgccggtgagctggacctgaagatccccgctggcgccaccgacggcaccaagctgcgcctccgcggcaagggccagggcggcggcgacctgatcgtgcgcctggaggtggccccgcacccgaccttccgacgcgagggcaacgacatccatctggacctgccggtgacgctcgccgaagcggtgctgggggccaaggtcgacgtgcccaccctggacggccaggcccggatcaccgtgccggccggcagcagcagcggccgcaagctacggttgaagggcaagggcgtgccggcccgcagcggcgtgggcgatctgtatgtgcatctgaagatcgtgctgcccgaccagcccgacccggcgcttcaggcagcggtcaaggactgggccgaggcccatccccagctcgacccgcggcgcaacctcaagggctgaccaccggcggtcacgccccctgcccttcacgcccctcgtgatccacgatcacggggggccgtttcgttgcagccagcgccagaacgatccgcggctttgcataggcacggtcggcaaaggcgccgagcgccggccgcgagcccaggcccagcccgacccagtcggcccggtgcagccaggccatcagccgcatgtcagcgacggaccagcgcccggcgagcgtcggcccgtcttcgagcgccgcctcgacccgggccacccggtccttcagcacctggcgggcctgctcgatcgcctcgggcagatggcggggcgccaggcgacggagcgcgatcgacgccatcatcggcggcaccagatcggtctcgatccaggccgaccagtgttcggccaccgcccgctcggccgggcgccgcggcagcagcttcgacggctccgccgcggccagggccgccaggatcgccgccgcaccgacgatcggcgcgccgcctgcgatcgccaccaccggcggccggaaggccatggggcagtcgcccatgaagaccgcgaccgccgggtcgatcaccggatcgaccggcgccagatcgaccaccggccggcgcagttcggcaagcgcgagcgagaccgccccgccatcgggcgtgtcgcccggatgaaaggcgatcgcgcgtgcaggattggcacgggcggcgtcggcaggcttgcgggtcatgacgggaaagcggtcctcagagcggccagaacagaagcagcagcggcacggagaccgccgcgacaacgatctccagcggcaggccgacccgccagtaatcgccgaaatgatagccgcccgggcccatgaccagggcgttgttctggtgcccgatgggggtgaggaaagacgaagacgcgccgatcgccaccgccatcaggaagggatcgggcgagacgccgatgccctgggcgaccgcgatggaaatcggcgccatgatcaccgcggtcgcggcattgttcaggatgtcggacagcgtcatggtcacgaccagcagggcggccagcagaacccagaccggcacatcgccgccgaggccgacaatgccgtcggcgatcagcccggtcacacccgtgctttccagcgctgcgccgagcgggatcatcgcgcccagcagcacgatcaccggccattcgatgccggtatagagttcgcgcaccggcagggcgttggtgaccaccagcccgagcacgaccatggcgaaggcgaccgccgccggcagcaggccggatgccgcaagcgcgatgccggcgccgaacagaccgagcgcaatccggccgcggcgctgatcgtgcttgatgatgtcgcgctccaccagcggcaggcagcgcagatcggccatcaccgcctgaagccggcgggaatcgccctgcagcagcagcacgtcgccgatctgcatccgcacccgtccgagacgggagcggatggcggcgccttcacgcgacagcgccagcaggttgatgccataggtctcgcgcaggcccagctcgcccgcatggcggccgatcagcggcgagccgacacccaccaccacctcggccatcacgacatcctgggactgaagatgttcggccgagggacgttcggacgccgcgaaatccagccccgccgcccgggcgcggcgggtgatcgcctcgctttcgccgcgcaccagcaacacgtcgccctcggtgatcttctgccgggccatggccccgaagatgcgccggtcgtcgcggatcagccccaccaccgtcagatcgctgtcggtccaggacgcttccgcctcgcccaccgtgcggtcgatcagcggggagccgggcttgacggtcagctcggtcatataggcgccgacatccatcagatcggcgacggcccccttgcccagccggtcgcccgggatcagccgccagccgagcaccgccatatagaccagcccggcgagtgccgccggcaggccgacccaggcgaaatcgagcaggtgatagggctcccccatcgcctgggcgcgaaagcccgagacgatgacgttggggggcgtgccgatcagggtgaccatgccgcccagcaccgtggagaaggcgagcggcatcagcacgccggcaggcgaccgtccggccttggtggtgctctggatggcgatcggcatcagcagggccaaagcgccgacattgttcatgaaggccgagatcaccgcgccgatgccgcagagaacgaggatatgggtcacggtgttggccgaggccttgcgcaccaggccggtcagcggttccagcgccccggtcagggccagcgccctgctgatcgccagcacggcggcgacggtgatcaccgcatcatggccgaagcccgagaaggcgtccttcgccgggaccagccccagcaccacgcctgtcagcagcgtgcccagggctacgaggtcgtagcgcggccgcccgagcacgaacaggaccagcgcgatgacgagcagcgcactgatcaggatctggtccagggtcattcaggtgtctttccgggcggccatgcttgggttcgagggttgccgatgcgccgtcttcggtcaacgctgttgtgccggagggctgcttgtcgcaggcttggcgcacctcatctccccctgcagctccatcgaattctcgcgaggatcgcatgaccagcccgatcgacctgttctactggccgacccccaatggatggaagatctccattgcgcttgaggaactgggcctgccctatacggtcaggccggtcaacatcggtgccggcgaccagttccagcccgacttcctgaaattcagcccgaacaacaagatgccggcgatcatcgatcccgagggtccggaaggtcggccgatctcgatcttcgaatccggggcgatcctgatctatctggccgagaagaccggccggttgatgccggccgacccccgcggccgctatgcggtgctggagtggctgatgttccagatgggcggtatcgggccgatgctgggccaggcgcatcatttccgccagtacgcgcccgagaagatccagtacgccatcgaccgctacaccaacgaagcgggccggctttacaacgtgctggacaagcggctctcggaaaccgactgggttgcgggcgacgattattccatcgccgacatcgcgatcttcccctggatcgtgccgcatgagcgccagggccagtctttcgatgaacgcccgcatctgaaacgctggtacgagaccatgaaggcacggcccgcggtctcgaaggggctggatgtcggcaaggagctgcgcagcggcagcgccaccgaccccaaggccttccagaccctgttcggcgccgcccagtatcagaagcgttgatatcgatggccggcgcgctgatccgggcctccggtgacggcgtaagttgagtgagacggttcggggtgtgccgatcgtcaccatcctgcctcatctcctggtgcaggatggacaggcccgccccacctctctcgtccatcatcccgtcgctgtccgaccaggccggagtccgcgcatgaccgatcgatcgaccgccactgccagccgccgccggccgttccgccggcccgccggcaggcgtgcccgcaccttcgcggccctggcggccctgatcttgccgggctgcgcggcgctcgaccccaagccggtcacggtcgatcaacgcattgccgccttcccgaccaccgggctcgacctggaacggccggtcacgctgcgctggtcggacgaacaggtgccgttcatcgaggcggaaaccgatcgcgacctggcctatacgctgggtctggtccatgcccatctgcgcctggcgcagatcagcctgatgaagcgggtatcgcagggccggctgtcggaaatgggcgggccggtcgccaacgacatcgatcatgcgctgcgcatcctgggcttcggtcgcggctcggccgcgacagcgcaggcgctcgcgcccgatacccgcatctgggtcgaggccttcgtgaaggggctgaacgactatcaggaccgcctggcccgggccggtggcccctggccgccggaattcggcctgctgggcatccgggccgaaccctggacggtggaagacgtcctgaccatcggccggctggccggcaccgacatcaactggctggcctgggccgggctgctgcgcgagcgtgcgcgcaacggcccgcaggatccgcgctggcgcgaaacctgggcccgcgccaccgatgccggccatggcagcgtggtcagctttcccgccaacgagacccatgcgcggctggaacgtctgctgaccgaactcgccgggctgtcgcgcaccggatcgaattcggtggcggtctcggggcagatgaccgaaagcggatcggcgatcatcgccaacgacccgcatctgggcatgagcctgccgaatttctggctgttggcgggcatgcgctccccctcctatcaggcggtgggcatgatgccgccggggctgcccttcgtcgccgtcggccgcagcccgcatctcgcctggggcggcaccaatatgcgggcgctgtcgagcgagctgtacgacgtgtcagccctgcccgccgatgccttccggaccgagacccacaccatccgcacccgcttctggttcgataagaccgtgaccgtccgcgtctcgccctatggcccggtcgtgtccgacagcgagatgatcccgtcgcgccccggcgaggcgatcgcgctgcgctggctgggccatgacgtctccgacgagatcggcgccctgctcggcgccatgcgcgcccgcaccggcgaggaattccgcgccgcctttgccggccgctatgcggtttcggcgcagaacatgctgtgggtggacaccgacggccatgtcggccaggtgctggcggcccggctgccggtccggcccgacggcatcccgcaggatctggtggcgcgcgccggcgacccggatcgcgactgggcgcgcttcgtcgatgccggcgaactgccggcggcccgcgaccccgcggccggcttcctggccagcgccaacaaccggccgaccgataccgaccggctggtgccgatcgggttgttcttctcggccgatgaacgggtgcggcacctgcagagcgtggtgcgcgacaccgcgccggtgtcggtcgacgatctgaaacggctgcagcaggatgtgacctcggatttcgccgaggcgctggcggcgatgctggccgcagccgcgcgggatgccggcgtcgccggaaatcaccgcagtctggagctgatcaccggctgggacggcgcctatgccgccgatgccgcggcaccggtcgccttcgaagtgctgctctcacgcgtggcggcgggggtctatggcggggccgaagcgaccgacggccgctttgccttcgcctccagctggacccagctcaaccgctatctggcggccgacctggcggctctgcccgaagccgaacgccgccggatcctggaggacggcctcgccgccgccgatgcggcgctcgccgactatcccgcctggggcgacatgcaccggttgcgcctgtcgcatctgctgggccaggccccggtgatcggcagcttcttcacctatggcgactggccggtcggcggatcgcgcgagacgccgatgaagaccgcccacgatctggtggaagagctgcacgccgcccgctatggcgcccagtcgcgccatgtctctgacatgggcgacccggatgccaactggttcgtgcttctgggcggccaggacggctggctcggctccagcaccttcgccgatcaggtgccgctctggcgcgggggcgactatctgaaactgccgctgaccccgcccgccgtggccgaacgcttcccgcggcggctggacctcaccccagaggggtgaggtccgcactgccggtcgtgtggcatcaccacccgaccggcgcgatcgcgattgccggcatcaggctgatcagcaggatcaccagcagcatcagcatggcgaagggcaaggcgccggcgaagacgtcgcccagcgtgatgcgagggtcgtcgagcgtcgagcggatgacgaagaccgagaggccgagaggcggggtcagcagccccacctcgaccgcgatcaccgtcaccacgccgaaccagaccaggttcatgccgaagccgtcgaccaccggcagggccagcggcaccaggatcagcaggatggagctggaatcgaggatggtgccgagcaggacggcgatggcgacatagaccaccaggaagcccaccgggccgagcccggcatcggcgaagagcgcgcccatcgcctcgggcacgccggtcagcgccagcatgcggctgtagagcgaggccgcgatgatcagcagcgagatcgacgccgtgacatggccggtctccaccagcaccttccagaagccccgggcatccatccgcttgcgggcgaccgcgaccagcaacgcgccggcagcgcccaccgcaccggcctcggtgggggtgaagagcccgccatagatcccgcccagcaccagggcgatcagcccgaccaggggcgcgccttcggcgaagacattgccgggacggtcgcggcgggcggcggctgcggcctgggccgccgccagcggctgcacccggtcggggcggaagcgggcgagaagcacgatatagataccgaagaccagcgccatcagcagccccgggccgatgccggccaggaacatatcgcccaccgactgttcggcgacgacggcatagaggatcagcagcaggctgggcgggataagcataccgagcaccgaggagcctgcgaccacgcccaccgcaaagcgcggcagatagccgaggcgcatcatctcgggcaccgccaccttggtgaagaccgcggccgaggcgatcgagatgccggtgaccgcggcgaaggcggcattggcgccgacggtcgccacccccatgccgccgcgcagccgcccgaccacccgatcggccagacggaaggcatcgcgccccagatccgagacgccgaccagatagcccatcagcacgaaaagcggcaccacgccgaagacatagctgtcgatcgaatccagcgccgcctgggcgatggcggcggcggcgaccgaccagcggccgcgcacttcccagatcgccagcagcgacaccaggccgagggcgaccgagacatgcatgcccgcccagatcaacagcagcagcgccaggatcgacagcaggccgatttcaagaccggtcatgaccgcccccctgcggcacggcgtgcggccgcggccgcgaggatcagataaaggccgatgaccagcacggagcccgcgatcatcagcgcccggatcggccagaccggcagggtgaaatcccccgcagcaccgacatagtcgccggcttcgatcgcccgcaacagccggggccagagcgcccaggcgaggatggcgaagaaggcggcgcccgccagatgatgaacgacatccagcgccgccgccgcccgcggccgggccgccgccagccggtcgagcagggcatcggaccgggtgaagcgccccgaggcgagcgcgtggcccgcctggaggaagacgatgccgacgatggagagcccgacgaattcgggcacgcccctgagcggtgcggcaaaggccgcacggcccagaacatcggcattgaccagcaccatcatcaccaggatccaggcggtgccgacggcgctggcgagggccgcgacccggccgagcggcccggtgcgcggcgccgtggcgggcgtctccacccgccccggcccgctcatgccgggtcctgccatcactcgcggtcccagttgcgcggcagctgaacgccagccgcacgcagaccatccagatagccctggaccaccgcctttgccggaacgcccttggcttcaagctcgtcggcccattccttcgagacattgggcagggcatccgcccagcgcttgcgctcagccggcgagagttcggtgatggtggcaccaccatcctgcatggtcttgaacgaggcgttcacccgcgcgacctgggccttggcgaaggtgtcggcatagatcgccgcctcggcggtcatggcatccttcaccggctgaggcagatcggcccagacatcggcattgacgctgatcgcaccggcgaactgggcgccgatattgaccttggtgatatagggtgccacctcgtgcagcttggccgccgcggcggcggtcgcgaaggtcagcgtgccctcgtacaccccggtcttgatgtcgttgtaataggtctgcagattgccggcgacggcgaccgcgccggtgcccttcagccagttcgccgccgggccgggggcggcgatcttgcggcccttcagatcgtcgatcgacttgaccgggaagttggtgaacaggtgatagctgtcgagcgaggcgccggcgagcgggatctggccgtagcggctccattcctggtccatctcgggcacgcgcttcgacacggccgtgacggtctgggtcaccaggaacaggttgtcggtggtgaacggcaccatataggtgacgttgtgcaggggcatcttggccgcttcgaacagcgtgccgacgaagcccatatccgagatgccttcctcgatcgcctcaagttcgctgccgatcttcgcgaccgtgccgccataggcttcggtccactcgatgcgatactggtcgccgccatccttcagccgcttgttcacgccagggatgaaggtctcgctcagggtcttgacccagaggaaggccggcgggtggccggccgtcaccgtgatcgggatggtttcggcggcgctggccggtgccaccggcagcaccagggcgccgagccccatgacagccagcgctgccgtcaggccacggcgaaggccgcaggccggagcggtattggtcatctgtcgtttcctcccaggaggagcccgtcattgcagaaaccgccgtctccggtgggctcggtcgccacgacatcttgaaggccgtgatcggtgccggtgccggcgggtggtggaacagcatcagccgcccgatgcctccatgcgcacgagttcagcgtcgagcaggtcggcggtgatggcgatgtgctcttccagcacccccaccgcgcggtcggggtcgcgggcgagcaccgcatccctcaacaggtcgtgttcggccgacacctcttccgcccggaagggacccgccagcatcagccgccggtagcgttcggccttgtcgtaaagaagcgcccggaagctcttgagggcattgagcggacaggcggagacgagggccgcatggaaggcgcgatgccgctcttcccaggcggcccagccggcatcgtcgcccgcccccagatggcgctcggtcgcccggcgcagcaaatggtggctggtgacgatctccgcctcccagtcatcaccgccgcaggcgatggcaaggcgcagtgccgccccctcgatgatctgccgcgagcgggtgatgtcgacgagatccgcccggctgaccggcgccacccgaaagccgcgctgacccgagaacgagaccagcccgtcggccgccagccgcgagagcgcctcgcgcagcgggctcaaccccacgccatagcgggcacgcatactgcccaggtgcagcttggtgtcgggcttcagcgcccccgccacgatgtcctgacgaatgcgctccagcgcttccagcgacagggtcgcggcacgcgcgccatcgggcaacagggcatcctccggcaggtcgggcagggtatcggccatgggcggcctccggctgagtggcgagggggtatattcgggggatcgggtggcgggagcgtgttcttagccgatgttttgctgcgacacgatattgcgctgcaaaatcgatctgagaccatcatacatcgttctgactcgaaatttcgatttttttatgcaggatcgatgaagcgccgcgctatgatgccggcaaccggaggttcgccgcataagcggaccccacgatccctgaggaggatgacgtccatggcccgccgcttcgtcgatctgtcgatcatgctggagaacggtgtccgctcggatccgcccggcttcgagcccaagatcacctatatgaaccacgagcagacgcccgcgcagatcaccgccttcttccccgggctgaagcccgaggatctgcccgacggcgagggctgggcggtggagcaggtgaacctgatcacccataacggcacgcatctggatgcgccctatcacttcgcctcgaccatgaacaagggcgagcgggcgatcacgatcgacgaggtgccgctggactggtgcttccgcccgggcgtgaagctggatttccgccatctgcccgacggccatgtcgtcaccgccgccgaggtcgaggccgaactggcccgcatcggccacacgcttcagcccttcgacatcgtgatggtcaacacccgcgccggcagccgctacggccaggacgattatgtcgatgccggttgcggcatgggccgcgaggcgacgctctacctgctggagcgcggcgtgcgggtcaccggcaccgatgcctggagctgggacgcgcccttcacccatacccgcgagaaatatctggaaaccggtgatgccgggctgatctgggaaggccatcgcgccggccgcgacatcggctactgccatctggagaagctgcacaacctggaagccgtgccggccaccggcttcaccgtcgcctgtttccccgtgaagatccgcggcgcctcggcaggctggacccgggcggtggcgatcttcgaggactgatcccgccgccccgcccacgcccctcctccccttcttcacggatcctgccgatgaaactgctcaccttcgtgcccggcgccggcgcctttgaaaccgcgccgggcgaggcccgccgcatcggcgcgctgatggccgatggcggccgcgtgctcgacctcaccaccgcagccgccgcccgcatgggcgccgaggccggctttgccgcctcgatgctcgcgctgatcgatgccggcgccgacgggctcggccgcgcggccgagctgcttgccgaagccgaacgcggcggcgcggcggcggatgcggtggtcgcgctcgacgcgatctcgttccgcagccccctgccccggccgcgccagatgcgcgactgcctggtcttcgaaacccatctgatccaggctatggagggcggccgccgcctgctggccgggctgaagggcaccacgcccgaggcactcggcctgccgccggtgaccgtgccccaggtgtggtacgagcagccgatctattacaaggcgaaccggttcagcgtcatcggccatgaacagccggtgcgctggccaagccattcgaagctgatggattacgaactcgaactggggatcgtactcgccaaaggcggccgcgacatcccggccacgaccgcgcatgaccacatcttcggctatacgatcttcaacgacatgaccgcccgcgacacccagttcaccgaaatgcagggcagtctggggccggcgaagggcaaggatttcgacaccggcaacatcatcggtccctggatcgtgacggccgacgagatgaccgatccctacgccctcggcatgcgggtgcgcgtcaatggcgagctgcggggcgagggctccagcgcctccatgcagcaccggttcgaccggattctcgcccatatttcgcgggatgagaccctgcatgccggtgaattcatcggctcgggcacggtcggcaatggctgcggcatcgaaaccggccaactccttgatccgggtgacgtcgtcgaactggaaatcgacggcatcgggcggctccggaaccgcatcacaccacctcgggtttgatgcgcggcgtccgcgttcacgcaggaggcgccaacctcccccgggggcgcaaatcgtggaacgcggacgccttgaccgccttgcggaattccgataagacttgcgacataaaatataattacaaaaagaacacagggacccgatcctcgctgcgaccggacgctgtctcccgaaacacccggtcaacgcgcgctcatctaggggaggagtgagccgtccgtgaacacacggggtcgtgcacgcacacgcaggccgaaggtctgcgcgattgcgttgccgtgccgcatgtgggcgtggacgcttacagatgcatggctcaggacatcatcattgagacgaagggactgaccaaggagttcaagggcttcacggcggtcagcaatgtcgaccttcaggtgcggcgcggaaccatccacgccctgatcggtccgaacggggcgggcaagaccacctgcttcaacctgatcaccaagttcctgatccccacctcgggtcagattctctatgacggccaggatatcaccagcgagcagccggccgcgatcgcgcgtcggggcatggtgcggtcgttccagatttccgccgtcttcccgcatctgacggtgcgcgagaacgtgcggatcgccctgcagcacaaactcggcaactccttccatttctggcgctccgaccgggtgctgaacggcctgcacgatcgtgcggacgagctgctgtcggatgtcggcctggaaggctatggcgaggccatcaccgccgagctgccctatggccgcaaacgtgcgctcgaaatcgcgaccacgctggcgctggagcccaaggttctgctgctggacgaaccgatggcgggcatggcgcacgaagacgtgggccgcatcgccgagctgatcaagcgcgtggccaagggccggacggtgctgatggtcgagcacaacctcaaggtcgtggcgaacctctcggacaagatcaccgtgcttcagcgcggtgcgatcctggcccagggcacctatgccgaggtgtccgagaaccccgaagtcgtccaggcctatatgggaaccggtcatggctgagcccgcccgcaagatggccgccacgtcggccgcccccctcctcaccgtccgcgatctcaacgcctggtacggcgagagccacgtgctgcacggcatcaatgtcgacgtcaatccgggcgaggtggtcaccctgctcggccgcaacggcgccggcaagaccacgacgctcaaatgcatcatgggcatcgtgcgcagccgcaagggcagcatcaccttcgagggccgcgagaccatcggcatgtcctcgaaccagatcgcccgcgccggcatcgctttctgcccggaagagcgcgcgatcttctccagcctcgacgtgatcgagaacctgatgctgccgccggtgatcaaacagggcggcatgtcggtggaggaggtcttcggcctgttcccgcgcctgaaagagcgcggcagcagccagggcaccaagctttcgggtggtgagcagcagatgctcgccatcgcccgcatcctgcgcaccggcgccaatctgctgctgctcgacgagccgaccgaaggtctggcaccggtcatcgtgcagcagatcggcgagatcatccgcgccctgaaggcgaaaggcttcaccatcgttctggtggagcagaactttcatttcgcctcgacggttgcggaccggcattatgtggtcgaggaaggtcatgtggtggacatgctcaccgctgacgacatcgcgaccagccaggacaagctcaagcagtatctcggcgtctgaccggcgccggggccgggcctgtcccggcacgactctcggcgtcacgctcgtggcgtcgggccagagaaggtcgcggcggcgcgcctccggaacgtgacggacccatccagaaggtctgccggtccgatcgaggccctgtctcccgccaagagtccgcacgcggcgttcgcgcccgcgcccggccggttccaggaccgatgccggccgggccggaccggttgcacgtgacccgacctcaactgtcccgcgaacgtaatcaccgcctcaggcagaagacctcaggggaggagttttcaagccatgacgttcaagttgaccctcgcagccgtcaccgccgccgtcgtcgccgccttctcggccggcgcggcgcaggcccagatcaccgacaatgtggtgcgcatcggcgtgctgaacgaccagtcgggcatctataccgacctgtcgggccccggcggcgtggatgcggcccggatggcgatcgaggatttcggcggctccgtcgccggtgccaagatcgagctggtctcggccgatcaccagaacaagcccgatatcggctccaacatcgcgaaccagtggtatgaccgcgatggcgtcgatgcgatcttcgacgtgcccacctcgtccgtggccctggcggtgcagaacatcgccaaggaaaagggcaaggtgatgatcgaccacggcgcggccacctccgacctcaccggcaaggcctgctcgcccaccggcatccactggacctacgacacctatgcgctcgccaacggcaccggccgcgcgctggtcgaacagggcgccaagaagtggtacttcatcaccgccgactatgccttcggccacgcgctggagcgtgacacctccaacgccgtcaccgccgcgggcggcgaagtcgtgggcaccgtgcgctcgcccttcccgtcgaccgacttttcgtccttcctgctccaggctcagggctcgggcgcggacgtgatcggcctggccaatgccggcggcgacaccgtcaactcgatcaagcaggcggccgaattcggcatcacccagggcggccagaagctggcctcgctgctggtcttcctgtccgacgtgcactcgctcggccttgaagtctcgcagggcctggtgctcaccaccggcttctactgggatctgaacgacgagacccgcgccttcgccaagcggttcggcgagcgcaatggcggcaagatgccgaccatggtccaggccggcatctattcctcggtcacgcactatctgaaggcggtcgaggcgaccaagtcggatgacggcaagaccgtggtcgatcagatgaagaagaccccggtcaacgacttcttcgccaagggcggcaccatccgcgaggacggccgcatggtccacgacatgtatctgatgcagatcaagtcgccggcggagtcgaagggcccctacgactattacaagctgctcgccaccatccctggcgaccaggccttccgtccgatggacaagggcgaatgcccgctggtcacgaagtgatcagcctttgaacaaccgtcacccatcacatccgacgccgacacgaggggcacatccttcatgatggaattgatcggcattccgccgcaggtcctcttcggccagctgcttctcgggctgatcaacggcgccttctacgccatgctcagcctgggcctggcccttatcttcggcctgctcaacatcatcaacttctcccacggtgcccagtacatgatgggcgcattcgtggcgtggctggtgctgcagtacgccgggatcgggtactgggccgccctgatcatctcccccatcatcgtcggtttgttcggcgtggtgcttgaacggttgttgatccgccggctctacaacctcgatcatctttacgggctattgctcaccttcggcctcgcattgatgatcgagggcttcttccgccagctctacggcatctcgggtcagccctatgccatcccggcggcgctgcagggcggcaccaatctgggcttcatgttcctgcccacctatcgggcctggatcctgatcgcctcgcttgccgtctgcatcgcgacctgggcgatcatcgagaagacccggctcggcgcctatctgcgcgccgcgaccgagaacccgaccatggtgcaggccttcggcatcaatgtgccgctgctcatcaccctcacctacggcttcggcgtggcgctggccgccttcgccggtgtcatggccgcccctgcctaccaggtcagcccgctgatgggctccaacctcatcatcatcgtgttcgcggtggtggtcatcggcggcatgggctcgatcatgggtgcggtggtcaccggcttcggcctgggcctgctcgaaggcctgaccaaggtcttctaccccgaagcctccagcaccgtgatcttcgtggtcatggccatcgtgctcctcatcaagcctgcgggcctgttcggaaaggcggcgtgatcccatgagcgtcaataccgttcccgctgcccgcagcacccgcggccagaaggccgccggcctcaccatgatcggcgtcgcgatcgcgatcctggtcggcctcgcggcaccacacgtcgtctaccccgtcttcctgatgaaggcgttgtgcttcgcgctcttcgcctcgggcttcaacctgctgctgggctatgtcggcctgctcagcttcggccatgccgcatatttcggcttcgccgcctatatctgcggtcatgtggtcaaagtctgggggttgtcgccggaaatcggcatcctgctcggcaccctcaccggcgccgggctcggcctgatcatcggcgggctcgccatccggcgccagggcatctacttcgccatggtgacgctggccttcgcgcagatggtcttcttcctggcccttcaggcaccgttcaccggcggtgaggacggcatccagggcatcccgcgcggcatgctgttcggcctgatcagcctgcatgacgacatgaccatgtattatgtcgtcttcgccattttcctgatcggcctgctgttcatccaccgggtcatccactcgcctttcggccagacgctcaaggcgatccgcgaaaacgagcagcgcgccatctcgctcggctacgacgtcaaccgctacaagctgctggccttcgtgctgtcctcgggcatcgccgggctcgccggctcgaccaaggcgctggtctttcagatcgccacgctcaccgatgtgcactggcacgcctcgggcgaggtggtgctgatgaccctgctcggcggcgtcggcaccgtgctcggcccgactgtcggcgcgttcctggtcaccggcatccagaactatttcgcgcaggtcggcgcctgggtgaccatcatccagggcgggatcttcgtggcctgcgtgctgctgttccgtcgcggcatcgtcggcgaatacctggccttcatggagcggcggcgcagccgcaaatcctgatcgacacagccatcatcggtggccgttacgaaagccgccatacctcaggggtatggcggctttttcgcgtgatattaaccatacagcgcgcctgactcacattttggcaataaatttcaaccattgattaatggggccggtttagactcccccgatccggcgcccttcccgggccccgaggtttcccggagttccggacgatgcagaacctctcgaccggtgccaaacttggcatcctgctgttcgccgcgctgctcggcgtgacggcaaccatttatctctccctcaccaccctgcgcgagaccctctacgccgaccgccaggataagctgcaggctctggtcgaaatgggcgtatccatcgtctcggccgagatcacgcgcgctgaggccaccggcggcgatcgggcggcagcgatccggacggggctcgcgctcctggagcccgtgcgctatgacgatgccgaggaatatctgtcggccatcgacatgaccggcgtcatgctcatgaatggcaaattcccgtccgtcgtcggccgcaacatgatcggcgcaaaggacagcaatggcgtcgcctatgtggcggatgccgtcaagatcgccaccaccaccggacggggcgccttcgcctatctctggccccgccagcagggcggtgaaccggagcctaaactctccttcatccagcgcgtgcccgggaccgatatcggtgtgatcacgggtgtctataccgatgatatcgaggctgccttccaggcccaggccctgcgcctgggtggcatcgccgcggcggcggcgctggtgctggggctgctggccgtgctggtgatccgctcgaccgtaccgccgctgaaggccgtcacccgcgggctggagcgtctggcccagggcgaacggagcatcaatttgaagggagcggagcggcgcgacgagatcggtgcgatcgtccgcgccttcggcgtggtccgcgaggggctggccgccgccgacgaactgacccgccagcgcgaggccgaacaggcggcccggctggagcggagccaccgggtcgacgagctgaccggccgtttcgacgacgatgcccgccagtccctgtcggtggtgctggacgcagcccgcgccatggaacgggcggccgccgagctgaccgaggccgcggatcaggcgggccgccaggccgataccatggtcggcgccgccaaccaggccgatgccaacgtccagaccatcgccgcagcggcggaagagctgtcgacctccaccgaagacatcgcccgccgggtgacccaggccgccgacatcgccgcacgggccaccgaagaggcgcggcgcaccaccgaaatcgtgcgcggcctgtcggataccggcgaccggatcggcgaggtggtggtgctgatcgatgccattgccgaccagaccaatcttctggcgctgaacgccaccatcgaagcggcgcgggcgggcgatgccggcaagggcttcgcggtcgtcgcctcggaagtgaagaacctggcaagccagaccggccgcgccaccgaagacatctcgcgccagatcggcgccgtgcaggaagaaacccgccgggcggtcaccgccatcgacggcattgcgaagatcatcagctcgatcagcgagattgcgggcgacatcgccgccgcggtgcaggaacaaggcgccggaaccctgtccatcgcccgcagcacccaggccgccgcccaggcgacggaagccgtgaccggcagcatcgccgcggtcggcaccgccgcgaaccagaccggtgccaccgccggcacggtgcgggacgccgccggacggctcaatcgtcaggccgatgacctgaagcaggtggtcgatcgcttcctcggcgatatccgcgccgcgtgaaacccgcccttggttgaagccacgaacgccgttaccgcttttgggcggtgacggcgttttttcctttcatgcagcccctcgaatacagcatcatctttccctagacggcccgggagtgaggtttcatgttccatgaaacatctcccgatcagatcaaaggatgcggatcattccggatcgtgacatgcctgaccgacgcgctggggagcgggttgcgacgggcatgtcgggcggcggcgttcctgcagggagagcaggccgtcgcagacccgccgggaccacgcggggaccatggccgtcggccccgatccgcccagggaggatacagatgaacaccaggaacgcgatcgctgccgcggttcttgcgaccatgaccggcctcgccgcgggggcggctcaggccgagatctcggacaatgtcgtgcgcatcggcgtgctcaacgaccagtcgggcatctatgccgacgtcaccggccaggcctcggtcatcgccgcccgcatggcggtggaggattacggcggcaaggtcaagggcgtgccggtcgaggtcgtcttcgccgaccaccagaacaagccggatatcgggtccaacatcgccaaccagtggtacgaccgcgacggcgtcgacgtgatcgtcgacgtgccgacctcgtcggtgggtctggcggttcagaacatcgccaaggaaaagggcaagctgcacctgaacgccggtgccggcacctcggacctgaccagcaaggcctgctcgcccaccggcatccactacgtctacgacacctacgcgctggcgaccggcaccggttcggcgctggtcggccagggcgcgaagaagtggttcttcatcaccgccgactatgccttcggccatgcgctggagcgtgacaccaccaacgcggtgaatgccgcgggcggcgaggtggtgggcggcgtgcgtgcgcccttcccgaccaccgacttctcgtccttcctgctccaggctcaaggctcgggcgcggacgtgatcggcctggccaatgccggcggcgataccgtcaactccatcaagcaggcgtcggaattcggcatcacccagggtgggcagaagctggccggcctgctggtgttcatcaacgacatcaatgcgctcggcctgcaggtcgcgcagggtctggtggtcaccaccggctattactgggacatgaacgacgagacccgcgccttcgccaagcggttcgaggagaaggccggcaagatgcccaacatgctccaggcgggcatctattcgggcgtcacccagtatctgaaggcgatcgaggccaccggctcggatgacggcaagaccgtggccgaccagatgaaggcgaccccgatcaacgacttcttcgccaagaacggccatatccgtcccgatggccgcatggtgcacgacatgtatctggtcgaggtgaagaagcccgaggagtcgaagggcccctgggactattacaaggtgctggccaccatcccgggcgatcaggccttccgccccatggacaagggtgagtgcccgctggtcaagaagtaaaacagcccggcccctgccggactgtcctctgaatacgaaacgccgccatccggtttcggatggcggcgtttcggtgttccggcccggtcgtcgggccggaaccggatcacttgccggcgggcaccttgccgacatcggcaccgatggtgcagatcgccttgggatcgtcgatgcgcagcaccaggctctccgacaggtagaggtgatggtgaatgccgtcatgcgagccatagccggcgcgcagatcctggccgatcaccagcacgccgacacgagggtcgaccagcacaccgcctccaatcggcgccttgaagatgccgacggtgcagacgcgggagatatgctccagctgcagcacgtcgctgccgtcatagcggcggaacagcgagttgtagagtcggggcgacagggcgagcgcataggggccgcgcaaaccgctttcatccagcttgttcaccgcggcgagcacgtcctgcagtgcctgatcgatattggcccagtcgccgccctcgatctcgtggcggccgcgggcgctcaacaggccttcgaggccgaaatcggggttgccgtaatagatcatctcctcttcgcgcgcggccacggcctcggctgcatcctcgaccgggtcgaggttcagcggctggccctgatcggtggacgaggcgatgcgccgcacgctcagccggaagcccttgcgcagcatcggcaccgaaatcgcgcggctcatcacagcccccgcctcgtcggggccggggtcgcggcaatagtcgtcattgccgatctcgatcgaggtcaggccgacaccataggggccgtcgacctccagaaagcggcgaccggtcagcgcgtcgcgggcggcatcgatcgccgcctcgtcgatccggcgccagagatcggtgccgaagggggcctgggaacggttcaggtaatccatctcgtgaaactcctggcaatagacggcaagggacagacgaggccggatcagcggcgcttcttcatgcggccgatggtcaggccgtcaccgccgccaccctctccgttgccgcccttgtcgtcaccgctgccggtggcgctttcctccacctcggtgatcggaccttcggtgaacagataagtcttgatctgctcggcaaagtcgccgtcgttccggcgcagccattccagcgtcatcatggcatgctcgatttcctcgcgcatattgtgcagcaggatttcgcgcagctcgtcgtcctcgcagtcatcggcccgctggcggtaccagtccaccgcctccagctcttccatcagcgacgagatcgcatgatgaagcgccagggtgtggcggctcagcttctcgcgcggggcatgcaggacctctccggccatctgctcgtctccttcttcgtttcgtcgcgccggtcggccggcgccatctcgtccagggcagcggtccagagggccgccgcttcgtgttttcatggtcccggttgtcccgccgccacagctctcaaccgaagccgacctcaaccgaagccggcggcgattgcggtcataacggcaaagccggcaatcagtgcccagctcgcccccatctcctggccatggcgatgggtttcggggatcatctcatggctgacgacgaagatcatcgcgccagccgcgaacgccatggtccagggcagcacaccggcaccgagcccggcaagcgccacacccaggccgccgccgatgatttccagcgcgccggtgccgaaggcgaccagaagtgccgtcatgcggctggccccggtcatcatcatgcccaccgccgcgacgaagccttcgggcaggttctggatcatgatgccgatcgccagtgccacgccctggcccagatcgccgccgccctcggcccccgagccgccgagcccgacgccgaccgccagaccttcgggcagattgtggagcgcgatcgccagcaccatcagcagggccggtgccatccgccgggcgtcgatcgccgccattccaccgccatcgaccaccagaagcgcatcgccgcccgccgcgaccatggccgggctgccgggcccatgggggctgcgcagggtgtgttcgaccgcctcgtcatcctgctggacatgcagatgcggcaccacggcgtgcagggccgcgatcgccgcggcccccagcccgatggcgaccccgatgccgagggccccccagagcgcgccatagcgggcgaccgcgcttccaagcgccggcaccagcagcgacagcagggcggcggccagcatcacgcccgcggcgccgcccagcagcaggttttcccgccggatgcccggccgtcggatcaccagcacgggcagcgcgccgagaccggtcgcaaggcctgcaagcaggctgccgcccaggcccagccagaccggatctatggatgcgagatcaggtatggcgccctccgatcatcggtcctgtgtctgcccgaatcatggcccaggatatggggcacgtgcatgacggatcaaccgttgccaccgtcgcccctcgaaatcgtcacagtgggtggcggaccgccgccgccgatccgacggaaggcagccaggccggccaatccgcccagggccagcaccgcgaaacccgccgcccagcccagcgggtcgccgtcgccccctgccccgtcgagcgccagaccgaaggtgatcggcgacaggatcgcgccgccgaaccccagcagcgcatgcatggccatcgccgccccacgcaccgacgggtcactttcggcgaccgcgcccgcggtcagcgaggcactgtcggccatgaccatcaggttgtaggcggccaccaccaccagcacgagggcgagcggcgcgccggcgaccgccgcggtcacgccggcaagcaccgccgtcaccgacatcgcgaccgtgatccagcgccgccggccgagccgcatcgccatctcgttgccgaagaaactggtgaggatgcccgaggcgatgatcgcgccgcccaggctgctggcccaggcggccgcggcgccggcatggaccagaaaggccaccagccagctgcgcaggccgaacatctcccagcaatggccggcataggcgagcgtataggcgatggcccggcggttgcgcagcaccggccggaaatccggtggcatccaccaggggcgatggcggatgccggcggccggcgcgggcggcggtgttgccggcaccgcgaccagcgccagaaccagggcagccgccgccgatgccccggccgtccagaacccggcctgccagccaccagcggcggccaccagccccgccagccagaccgacagcccggcccccaacgagaagcaggcggtatagctggcgaccgcccggctggccttggggccgcggacatggtcgctcaaaatcttgaggccgggcatgtaggacccggcgaaaccggcaccggccagcgcctggaacagcccggccgacagcggcccggtggcaaaactgccgaagccgagtgtggccagcgcgatcagcgtcagcgagccgatatagacccgccgggcatcgacccggtcggtggcaccggtcagcaccggcaccgccgcgacatagcccacgaagaaggccgaggaaatccagcccgcggtgccgttgctgagcgcccagtcgtcgcgcagcagcggcaacagggccggatagcacccataggccgccatggacagcacttcgcacaggcacatcacggcgatcatgcggagggttcggggcgggggcgcgccggaaccgggctcagggggacgggacagttctgctgacacggcgttccggctctccgctgacggatgacgccgcaaaccttagcgcgtggcgacggtgcgcacacgcgcccatgctgcaaccctgacggccccggtcatgcggaaccgcgcaccacaccgcgccgccgggccagcaggcgccgggccgccagcaccaggaagccggtcaccagcccccagaaggccgaaccgatgccgaacagggtgacacccgaggccgtggcggcgaaggtcatcaccgccacctcgcggtcgtcggggttcgacagcatgcccgcgatcgacccggtgagcgggccgagcagggccacgccggtgatgatctggatggtgtcgcgcggcagccccatgaagagatcgaccagcggtgccgagaacagggccagcaggacgtagaaacccgcataggcgatgccggtgacccagcgccggcgcgggtcgggatgggcatcggggccggtgcagatcgcggcggtgatcgccgccagattgaccgcatgagctcccatcggcgccagcagcagagaggcgaggccggtgagcgtcagcaccggccgggtgggcgcggtatagccggcctgggccagcaccacgaaaccgggcaggttctgcgaaaccagcgtcaccagaaacagcggcaggcccaggctgatgatcaccgccggatcgaagaccggcatcaccggcaccaggctgccgaacaggtcgccgtcatgcggcgcggtgaaattgccacccagcaccaccgccgcgaccgccaccaccagcacgatcagcagggcgaaagtgggcgcgcgctgccgggcgaccacgaagacgatcagcaccagccccgcgagcagggcgtcgctctggaaggcgcggaacagcgacatgcagaagggcagcagcacgcccgcgagcatggcggcggcgacggctgcggggattctcgcggccagccggcccagcgccggcaccagccccaggatgatcatcatcagcgcagccgccatgaaggcgccggtcgcttcggcccagccggcatgaagggtcgaggcggcgagcagggccgcccccggtgtcgaccaggccagcaccaccggcatgcgcagccggaagctgagcagcgcaccgggcagcgcaatgccgagacagagggccgtgaccgccgaggtgatctgatcgggtgtgccgcccagggcctggccggcctggacgatcagggcgacggtgccgccgaagccgaccagggcggcgatgagggcagcggagagcgaagagagcggcaagggatggggtcccggagacggctggggagaggaccgcactttccgccatacgggccgcgggcgcaagcgctccacgcgaatgtcatgacgtttccatcgactaaaccgatggtttatcaggaccagcggggccacgcctccgacatcacgaagcctgccacggcatgcaggtcgtcgcggccgaagatcggccgcccacccagcatgtcgcggtcgagggccgcgcaggtcagggctgccgggtcgggcacgatcacgcccaggatccggtcgtcgcgcggatagagcggccagcgcgcatcgcgtcggccgggggccagcacctccagccgcggatggccggcgccggcgaagccttccacgatggcgatatccgccggcccggcaagggtgagccagcggcgcagctggtccgccggatcgggttccgaaacgccgtccggcgcggttgccggctcttcccgcaacacaccgaccaggccgccgccgcccaccacgaccgcggccgccccggcccggcgatgacggtcgctgtccttgcccggccgatccagatccggacggtgatggctgcgcttcacggtgaccacccgccggccgccggccgcaagcagcgggatcagcccctcgatcagcgtggtcttgccgctgttgccgggccccaccaggccgatgatccgcatgtcccctccccgatccggctgatccgttccgcatacccgtcgcgccgccggttggcaagtcggggtcgatccatagacccgatatagacccgaaagctcctatgagagactcggatgtgattatttaataggcacataagacacatagcccacaaattaggcatatcttcgcgtcacgccgctcaatctcgccccgcacgcgccgctccaaaagcgttgtgcagcgcaggatacagccggaatgcagggcttggcatggatcttgtagataccttggtgtcgataccaagagacccccgcctgctgccgccatctgcgagagcctgagcccatgaccgacaagatcattccgcccgcctctcccgacgcctccgccgccgcggatgcgcgccgcttccggatcagccggcgggggctgctgggggccgccgcgacgctcgccgccgcaaggctgctgctgccgggcggcgcctttgccgccgcgaccggtgtggcgcccgagaagaccgaccttgccatcggcttcattccgctgaccgattgcgcccccctggtcatcgcccatgagaagggtttcttcaagcgcgaaggcctgaaggtcaccctgtcgaaagaggcgtcctgggccaatatccgcgacaagatgaccatcggcgcgctggatgccgcccatatgctggccggcatgccgatcgccgcgaccctgggcctcggcgccattccccaggcgcaggtgaccgcgctgtcgctggacctgaacggcaatgcgatcacgctgtccaacgcgctccatgaccggatggttgcggccgacccggcggcgatggccgaacggccgatgaccgcccgggcgctgaaggcggtgatcgatgccgacaaggccgccggcaaggcgccgctcaccttcgccgcggtcttccccgtctcgtcgcatatgtacgagctgcgctactggctggcctcggccgggatcgatccggatgccgacctgcggatcatcgtcatcccgccgccgcagatggtcgccaatctgcgtgccggcaattgcgacggctattgcgtgggcgagccctggaacgaacgcgcggtcgaggccggcatcggcaaggtcgcgatcaccagcgtcgagctttgggccaatcagcccgaaaaggtgctgggtgtggccgccgactgggcggagaagaaccccgcgacccacgaggcgatgctgcgcgcggtgatcgccgccggccagtggctcgacgatccggcgaaccgggcggaggccgccgacatcatcgccggccgcgcctatgtgaatgcaccggccgaggtggtgcggatgtcgatgaccggcaccttccgctatgccgccgacgaggcaccgcgcccgctgcctgatttcaacgtcttcagccgctatgccgccaacttcccctggatcagccatgccgaatggacgctgacccagatgatccgctggggccagatcgaccggccggtcgacatcgccgccaccgcggccgcggtctacaagcccgacctctaccgcaaggtcgcggcccagatggacatcgccgcaccgaccatcgatcgcaagcccgaaggtgtcaacacctccgcctggaccctgaccgaggccacgcggccgatcgccatgggtccggatgtgttcttcgacggcacccgcttcgatccggccgacccggtcggctatatccgccagttcgcgatcaaggccccggccgttgacctgaccgcactggccgccgcccagaccaccccgcgcgccagcgccgcctgagccaggagcccgttcccatggccgacatctccctcgacggtgccgcaaagaccggcaccggcatcggacggcgcctcggccttgtggccgagcgcatcgtctggccgcttctgaccctcgccgtcgccctcggcggctggacgctgatccagcagacggtggcgaccgatctgccgggcgtcggtgaaaccctcgcccgcggtatcgagctgttttccgacccgttctacatcgccgggcccaacgaccagggcatcttctggcagctgctctattcgctgggccgggtgctggcgggcttcggtctcgcctgcctgatcggcctgccgatgggcctgctgatcggcaccagccaggcggcttcccgcgccttcaccccgttcatcgaggtgatgcgcccggtcagcccgctcgcctggctgccgatcggcctgctgctgttccgggcagtcgacccctccgcgatcttcgtgatcctgatcaccagcatctggccggtgatcctgaacaccgccgccggcgtgcgcgccgtgccggccgattacgtccaggtcggccgcgtgctgcgcctgggccggcttgccatgttccgccgcatcctgctgcccgccgccctgccctatgtgctggccggcatgcggctgtcgctcggcaccgcctggatggtgatcgtggccgccgaaatgctcaccggcggggtcggcatcggcttcttcatctgggacgagtggaacaacctctcggtccccagcatcctggtggcgatcgtcctgatcgggctggtgggcatcgccctcgacgccgccatggccgccgttcagcgccgcctttcccactgagacggcccactgagagggacgatcccgatgaccaaccgaccgcatctctcgatcgaaggcgtcgatctcgactttcgcacccgcgaaggtgtccgccccatcctgcgcggtatcgatctgaagatcgcccgtggtgaattcgtggcggtgatcggccattccggttgcggcaaatccaccctgctcaacatcgtggccgggctgatcacgcccgagcggggggcgatcctgctcgacgacaaactggtcgatgcccccggccccgaccgggcgatggtctttcagtcccatgccctgctgccctggctgacggtgcgcgagaatgtggcgctggctgtggatcaggtgcatcgccggaccatggatgccgccgcccgcgcacagctgatcgacgagcatctggcgatggtgcgcatggaccatgccgccgcgcgccggccgcacgaactgtcgggcggcatgcgccagcgggtcggcatcgcccgggccctggccatgcgcccggccgtgttgctgatggacgagcccttcggcgcgctcgacgcgctgacccgcgcccggcttcaggacgagttgatggccatccaggccgatctgtcgatgacggtcatgatggtgacccacgatgtcgacgaggctgccctgctcgccgaccgggtggtgatgatgaccgagggcccggccgcgcggatcggccggatcgtcgacatccccctcgcccgcccgcgccgccgcgcccaggtgctccgcgatcccgccttcatcgaggcgcgggtccagatgctgtccttcctgcacggcgatgccgtggaggatgccgatgcggcggcgatgctcgccgtcgccgcggaatgagcggaggccgcccgatgaacacgccccgagaccgcatcctcgtcatcggcgccggcatggccggcacccgtctggttcaggacctggtcgcgctcgcacccggcgcctgcgacatcaccctgatcggcgccgaaccccatgcgccctatgaccggatcatgctctcgcccgtgctggcgggagagaagaccgcagccgccatccgtctgctggacgacgacttcctcgatcgccatggcgtgagcttcctggccggcgacgccgtaaccggcatcgatcgcgccgcgcggcgcgtcaccaccgccgccggccggcagctggagtatgaccggctggtgctggctaccggttcccagccgatccgcctgcccctgcccggggcggcgctcaagggcgttgtcaccttccgcgacctcggcgatgtcgacaccatgctggcccagggccggcccggcgcaccggccgttgtgatcggcggcgggctgctcggccttgaagccgcggcggggcttgccgggcggggcatgaaggtgacggtggtccacctggccggccatgtgatggaacgccagctggatgccgaggccggcggcatgctggcggatgccctcgccgcccgcggcatcaccacggtcaccaccgcgaacagccgggcgatcctggacgacggcaccggccgggttgcggggctggaactcgccgacggccgggtgctgccggcggaactgctggtgatggcggtcggcatccggcccgagaccggtctcgcccgcgcggcggggctggaggtcggccgcggcatcctggtcgacgaccggctcggcacctcggatccggcgatcgccgcactcggcgaatgcgtcgaattcgacggtcagtgcttcggtctggtggcgcccctctacgatcaggcgaaggtgctggcgcgcgcattggccggccggcccggcgacggcttcgccgtccgccccaccgccacccggctcaaggtctcgggcgtcgacgtgttctcggccggcagtctgggcggcgcggatgccgaagagatcacactgcgcgatgccgcccgcggcagctatcgcaagctggtgatccgcgacgaccggctggacggcgtggtcatgtatggcgatgtcgccgacggcccctggttcttcgaaaccatgcgcaaggcggagccgctgggcgccctgcgcgaccggctgatcttcggcccggccttcgccgccggcccctcggccacgggtgccgatgccgcgaccgccgccgtggccgctcttgccgacgatgccgaaatctgcggctgcaacggcgtgtgcaagggcacgatcaccgcggcgatcgcgggccagggcctcaccagcctcgacgaggtgcgcgcccataccaaggcctccgcctcctgcgggtcgtgcagcggccaggtgaaggcgctgctcggcctgtgcctgggcggggcggcaccggcggaggcagaggatgccgatccggcgatctgcacctgcaccgacctcggccatgatgcggttcgtgcacggctcggcgatctgccggccatgaccgcgatccaggccatggcggtgctgggctggaaaacgcccgaaggctgttcgaaatgccggccggcgctcaactactacctgctttgcacccatccgggtgccggtgtcgacgacccggcctcgcgcttcgtgaacgaacgcgtgcacgccaatatccagaaggacggcaccttctcggtcgtgccgcgaatgtggggcgggttgacctcggccacggagctgcgcgccatcgccgatatcgtcgaccgctacgacatcccgaccgtgaaggtgaccggcggccagcgcatcgacctgctgggcgtgcgcaagcaggatctgccggcggtctggcgcgatctcaacgccgccggcatggtctcgggccatgcctatgccaagggcctgcgcacggtgaagacctgcgtcggctcggaatggtgccgcttcggcacgcaggattcgaccgggctcggcgtcaagctcgaacggatcacctggggcgcctggatgccgcacaagttcaagatggcggtctcgggctgcccgcggaactgtgccgaggcaacgatcaaggatttcggcgtcatctgcgtcgacagcggctacgagctggtggtgggcggcaatggcggcatccatctgcgcggcaccgacccgctcgccaaggtctcgaccgaagccgaggtgatcgagatgtgcctcgccttcatccagttctatcgcgaggacgcccgctatctggagcgcaccgcaccctggatcgagcgcatcggcctggaccgggtcaaggccgtggtggtggcggatgccgccggacgccaggccctcgccgcccggttcctggcctcccagacccatgcccagatcgacccctgggcaaccatcgccgcggcacccggcgccgagttcgccgcgatcgacgtccccgcccgccgggcggccgagtgaggaggagcgagcccatgaccatcctcgccgacatgaccgcggtccttgccgacagcgccgactggatcgattgcggcacgctcgacgacctgccgctgcgcggtgcccgggtgatccgccaccagggcggcagcatcgccctgttccggccggcagagggcccccccgccgccatcgccaatgcctgtccgcataagggcgggccgctcgcggacgggctggtccatggccgcgcggtcagctgccccctgcatggccgggtcttcagcctggatgacggccgggcggcagcccccgatcgcgactgcgttgcccgctacccggtcacggtctccgcagagggccgggtgctggtgcggttgcggccgctgagccctgcggcgcctgcgggtgccgggctgatcgccgaggcggcggaatgaccgccctgccgccaccggccgccatccgcaccacctgcgcctattgcggggtcggctgcggcgtgctggcacggccggatgggcagggcgggctgctgccggtgaccggcgacccggcccatcccgccaatcgcggccggctctgcggcaagggcgccagcctcgccgacacgctgggcggtgccgggcggctgacccgggcgcggatcgacggccggccggtaccactcgatgccgccctcgaccatgtggcggacggcttccgccgggcgcgggccgaacgcggcccgggcggcatcgccttctatctctcgggtcagatgctgaccgaggactattacgccgccaacaagctggccaagggcttcctgggcagcgccaatgtcgacaccaattcgcggctgtgcatgtcgtcgaccgtcgcaggccaggtccgcggcttcggcgaggatctggtgccgggggcttacgaggatctggatctctgcgatctggcggtgctggtcggctccaacgccgcctggtgccatccggtgctgttcggccggctgatggaggcccgcgcggcccggggcacgcggctggtggtcatcgatccccgcgccaccgataccagccgcgccgccgatctgcatctcgccatccgccccggcggcgatgtcgccctctggcagttcctgctggtggaggccgagcgccgcggcctggccgatcgcgcggccgagggcttccccgccgcgatcgaggccgcccgcaccgactgccccgacatcgccgcctgcgcggcgctgaccgatctggcccccgccgaccttgcccgccttgccgacatggtgctgacgacgccgcgctgcctgaccctgttcagccagggcgtcaaccagtcgagcgccggcaccgacaaggtgaatgcgatcctgaacctggagatcgcgctcggccgtgtcggccggccgggcgccgggccgttctcgctgaccgggcagcccaatgccatgggtgggcgcgaggtcggcgggctggccaatcagctggcggcacatctgggtttctccgacgccgaacgccggctggtcggcgaattctggcaggccaccgacatggccaccggcccggggctgaaggcagtggagctgatcgatgcgctggaggcgggaaagatcggcgcgctctggatcatcggcaccaaccccgccgtcagcctgcccgatgccggccgcttccgccgggcgctggcccgctgcccgctggtggtggtatcggattgcgtgaccggcaccgacacccaggcgctggcccatgtgctgttgccggcggccggctggtcggaaaaggacggcaccgtcaccaattccgagcgtcggatcagccggcaacgcgcggtgctgccgccgccgggcgatgcccggcccgactggtggctgatcgcagaggtggcacggcggctgggcttcagccgtgccttcgcctggcgccacccggcagagattttcgatgaacacgcccggctttcgggcgccgccgccgcccgcttcggccggcatttcgacatcgccggcctcgccggcctctcccgccagcaatatgacgcgctggagccggtgcaatggccggtgccggccggcagccgggacggaaccgcgcgggtggtgccgtcccagcgcctggtggctctccgccaccgaccgcccatggaacgccccgaacggaccggcgaactggtgctcaacaccggccggctgcgcgatcagtggcacaccatgacccgcaccggccgcaccgcccggcttgccggccatgcgcccgagccgctgctggcggtcaacccgtccgatgcacgggatgccggactcgaccagggcggttttgcccggatcaccggccggcgcggcacggcgctgctgaaggtgacgatcgatccggggcagcgccggggcgaggtctttgcccccctgcactggtccgacgccttcgccgccgaggccgccatcggccacctcgcctcccccgccaccgacccgctctcgggccagccggagctgaagcatgcggtcgtccgcctcgccccctggcggccgggctggtcgggggtgatggtcgatcgcgcgacccgcgggccgctgcgccgcggcgtgcgcctgcccgcctattgggtccgccatgcggtcgaagccggccgggcggtgatcatggccggggacgaaacgccagccggggcggaagactggcgccagcttgccacccgccttgcccgcggcttcggcgccgccatcgatgcggggccggcgatcgaactgatcgatgccgcccgcggccggctgcggctcgcctggaccggcgccgacgggcggatcgtggcggtgatcgcgcttgcccggcaccccccatgccctgcccgacaccaccgcactcgcccgtctgctcgaccccgcaaccgatcgcggtgccgccgcccccgccgccctgcgcctggcgctgctggccgatcacgatcccgatggcggagatgcccggcgtgaccccgcgatctgcgcctgcgcgggcgtgggccgaagcgccatcctcgccgcggccggcaccggccccctcgaccggagactggcccgggtgaccgagaccaccggcgcgggcggtggctgcggatcctgccgccaccagatcagatccatcctcagcgaggccacgccccatgtcgaaccagtctgacaccgctgacggccttcccctcgctctccgtctcaccggcaggcgggtaatggtcttcggcgccgggccgggggcggcggcaaagctcgccctgctcgacggcaccggtgccgagatcaggatccatgacgatgcgcccgcctgcgcagaactggcgggccgcctgatccggccgctccatcccctgcccgatcttgccggcacccggctggtggtgatcgcgcccgagatcgatgatgcgaccacagccctgatcgccgaggccgcggccgcagccggcgccctggttcacgcggtcgaccggccggcactgtccgacgtcaccctgcccgccctggtgcgacgtgggccgctgcagatcgcgatccacaccggcggccggtttccggcgctggcctcggtgctgcgccagcggctggaagcgctgctgccgcccggccttggtgccgccgtcaccgcggccggcagccggcgcggcgagatcgcccggcgtttgaccgacccggccgcccggcgccgcttctggcgcgatctggccgcccggctgctggaccatcccgagatcccgatcgatgacctgccggccgacgccatcccggtccaggcgggccgggtggatctggtcggcgccggccccggcggccccggtctgctcacccgcgatgccgcccgtgcgatcgaggcggcggatgtcgtgctctacgatgccctgatcgatcccgcgatcctggaactggcgcggcgcgaggcgcggcggatcccggtcggcaagcgctgcggcgcccatgccgtgcgccaggcggcgatatcggcgctgatggtgcggctggccggagaggggctgcatgtggtgcgactgaagggcggtgatccggcgatcttcggccggctcgacgaagaactgggggcgctcgacgcggccggcatcccggcccggatcattccgggcgtgaccgccgcagccgcggccgccgcccatctccgccggccgctgaccctgcggggggccgcacgatcggtctcgctggtggcgggccatgatctggcgggcgacctgcccggggcgatcgaggcgcttgccgcggccgacggcacgcttgcgatctatatgggccgcgaccgggcgccggcgatcgtggcggcgctgatcgccgcggggcgcgacccggcggaacccgccgccgcggtcgaatgggccgggcgcccgcaggcccgatcggtcagcgtgccgctcgccatgctgtccgatgcgttggtagggctcgacgccgacggtccggtgacgatactggtgggagaggcgatcgccgcttccgccaccgccgcccgcccggcagatgcggaagggcgcgacgccgcctgaccttccgcagcggaatgccgatgaccgacaccagatccgacgccgtcgccacccttgcccaggccctcggcatcatcggccgcggccccggccggtcgcgaccgctgacccgcagcgaggcacgcgatgccttcgcgcccctgcttgcgggcacggcactcgatgtccaggcaggggccttcctcctgctgatgcgctatcgcggcgaaacggccgaggaactggccgggctggtcgatgccgcccgcgcccatatcggtccggcgccggaaggcgcccgccggccggcgctcgactggccgagctatgccgcgggccgcacccgcggcctgccctggtatctgctcgccgcccggctgctgggcgaggccggcgtgccggtgctgatgcatggcgacaacgatcttcagaccggcggtgtcggtgccctgcaggggctttcggccctggggctgtccccggcggcggatctgtccgaggccgccgaccggctggggcgcgagggtttcgtctatctgccgctggccgggctctcgcccgatctcaagcggctgctcgatctgcgcagcgtgctggggctgcgctcgccggtgaacacgctggtccgccatctgaacccgctggatgcgcccgcgaccctgatcggggtctttcatcccaactatctcgacagccatgccgaggcctcgctgctgctggatgccgggcgctggcttggtgtcgtcaagggggcgggtggcgagggggagcgccggccgcataagccggtggatctgcgcctggtcgaacagggtacctcaaaggtcgagcactggccggccctgctggcggcggcaccggccgacagccccgacgaccccggccgcctcgccgccctctggcggggcgagggcgaggatgccgaaggcgaggcaacggtgatcggcacggcggccgtggcgctgcgcatcgccggccgtgcggcgacaccatcggatgccgatgcccttgcccgcagcctctggagcgaccggcggcgatgaggatcgacggcggcgacccgacacggatggcttggcgctatcggctggccctggggctggtcgcagcgcttgcgatcggctccttcctggtgctgacgcaggtgatcagccgtgaacgggccaccgccggcatcatcaatgtcagcggccagcaacgcttcctgtcgcaacgcggcgccctgttcgtcggccggttgacctatccggtctcggcccaggaccaccaggatgcccgccagcatctggccgaggtgatcgcccagatgcgcagcaatcacgaggcgctgctgaagggtggatcgggcatgggcgacgcgatcggcctctcgcccgcaatggcgcggctgttccacgacgagccctcggcgatcgaccggcgggtgcgggaatatctggcggcgatggaagcggtcctcaccgacccgcgcgcgccgatcccgcgcgatgcgccggccgtggcgctggtgctgcgcgaagggccgggccccctgctcgacgtgctcgaccatgccgtcgcccgcttccaggccgaaggcgaggccgccgtcgaccggctgcacgacctgcatatcgccctgctgatcgccaccctgctgaccctggcgctggaagccctgctgatcttccagccgatggccacggcggcccggcgccgtatccgcgagcttgagaacgcctccctggcgctcaaggccgcagccgagcggctggagggagaggtcgctgcccgcaccgtggaactgcaaaaggccaaagagcacgccgaacgggccaatgtcgccaaggcccgcttcctcgccaccgccggccacgacctgctgcaaccgatcgaatcgctgcgcctgctcgccggatcgatcacccgccgcaatcgcgacccggccctgtcttcgccgctcgacgacatgcgcaaggcgctctcgggtatgcgcggcctgctcggcaatctactcgacaccgcccggctcgataccggatcggtcacgccgcagcttcaggatgtcgatccggctgccctggtggatgatctcgcccgcgaattcgagccggtagccgacgacaaggggctgggcttcggcgtcgggatttcgctgccggagggcctgcggatccgcaccgatccggtgatcaccggccggatcctgcgcaatttcctgtcgaacgccgtgcgctacacccctgccggatcggtgaccctgaccgcgggcccggccgatctcgacggccggccggcggtgcgcttcaccgtggccgataccggccccgggatcgatccggccgatcaggagcggatcttcgccgagttcacccagatcgacgatgcccgccgcgaccgctcggccggggtcggtctcggcctgtcgatcgcgcggcggatggcccagatcctggaacacgagctgacgctggacagccgccccggagagggggcgcgtttcgccctgactgtgccgctcgcccccgccgcccggcgtccgctccggtcatcagaaaagccgatacccgcggacgattaattctattttacacccggccgtcgccgggtgagcctgattgacggcagaacgcctgcatagcccgatatgacccgagaatacggcctccggagaccgcctgcgcgatgtccggcaaggggagatgtgcgccgtgaccggccatcgggcagggagagatcaatcagggaggtccggacgcccatgggacagatcggtcgaccgcttcgccggaaggaagatgcccgctttctgaccggggccggtcagtatgtcgccgacgcggcggcgcagcttggtgccgcgcatatgcgcattctgcgctcgccccatggcgcggccctgatccggtcgatcgataccggcgccgcccgcgccctgcccggcgtgctcgacgtgatcaccggggcggatctggaaaagatgggcatcggcggcctgccctgcgcctggccggtcaccagccgtgacggctcggcgatgatccacccgccccatcccgtgctggcggtggaccgggtgctgcatgtcggcgacccgctggcggcggtggtggccgaaaccgaggcccaggccgatgcggcggtggaagcgatcgaggtcgactacgaccccctgccctgccagaccgatctcgccaccgctctcgaccccgaagccgcccgggtccggtcggatatcccgaccaatcgctgtttcgactgggatctgggcgacgaggccgcagtcgatgccgccctggccgccagtccgcgggtggtgacgctggacctgatccagaaccgggtgaatgccagcccgatggaaacccgcggcacgctcggcatctatgaccgcggccatggcgactatacgctctggacctccagccagaacccgcattcgatccgcgtgacgctctcggccgcgacgctcaaggtgcccgaggaaaagctccgcgtgatctcgcccgatgtcggcggcggcttcggcatgaagatctaccactattccgaagaggtgctggtgctggtggcggcaaaacgcaccggccggccggtgcgttggatcgcaagccggctggaggccttccaggccgacacctatgcccgcgaccatgtgacgacggtatcgctcggcctggaggaggacggccggttccgggcgatgaaggtgcacacgctggccaatatgggcgcctatctctccaccttcgcaccctcgatcccgaccttcttctatgccaaccccttccccggcccctatgccctgcgcgacgtctatgtccatgtcgagggcgtgttcaccaacaccacgcccgtcgatgcctatcgcggtgccggccggcccgaggcgacctatgtgatggagcggatcgtcgagacggccgcgcgggagctgggcatggatccgttcgagatccgccggatgaacgccatcccgcccgaggccatcccctaccgcacgccgtttttgtggacctatgattcgggcgatctgcctgcgctgatggatctggcccgtcaggccgccgatctggatggctatgacgcccgtcgggcagcgtcggccgcgaagggcctgcgccgcggtatgggtgtcgccttctacatggaggcctgcggcatggggccgtcgaagctgctgatcgaggccgggctcggcggcgggcagttcgaggtggcgaccgtccgggtcgggcccaccggcggcatcatggtgctgaccggcagccattcccacggccaggggcacgagaccgccttcgcccagatcgtagcggacaagaccggcatcgaccctgccctgatcgagatcgtccatggcgacaccgcgaaggtgccttatggcgtcggcacctatggctcgcgctcgctgtcggtcggcggctcggcgctggcggtgaccaccgaaaaggtggtcgccaagatgacccgcatcgccgcccatatgctgggcaccacgcccgacgaggtcgatctggccgacggcatcttccgcatgcggtcgaccaatcgcagcctgaccttcgccgaggtcgccggccgcgcctatgccccggtcgactacccgccggggatggagcccggcatcgacgagacgacctattacgacccggaagccttcaccttcccctatggctgccacatcgtcgaggtcgagatcgatgccgagaccggcaccacgaaagtcgaccgctatctggcggtggatgatttcggccggatcgtgaatcccttgatcgtcgaaggccagatccatggcggtgccgcccaggcgatcggccaggcctgcatggaagtgtgccgctacgaccccgagagcggccagctgctgaccggatcgttcatggattacgccatgccacgggcgaccgacgtgccgccggtggagctggtcgcgatggaaaccctctgcacgaccaatccgctgggtgccaagggctgcggtgaggcctcggccatcgccgggccggcggcggtgatcaatgcgatcgcagatgccctccacgacctgggcgtgcgccatgtcgacatgccggccacgcccgagcgggtctggcgggcgatcgtctcggccggcctcaaccggccatgaccgagatcaccacggcattcacgatgtcgatgaagaagccgcagaccagcggcacgatgatgaaggcccggtgcgccgcgccgtaacgctgggcgaccgcggtcatgttggcgattgcagtcgccgtcgagcccagcgtgatgccgccgaagccggccgcgatcaccaccgcttcgtaatcgcggcccatcgtccggaacaccacgaacagggtgaacaggatggtgagtgcgatctgcaccgccagcacgaccacgatgaagcccagtacgccgccgagttcccagagctgcagtcccatcagcgccatggtcaggaacaggccgagcgcgatgtccgacaccagcgccagcccctgacgcagggacggccacatgccgagaacggcccggttcagccccatcggtgccaggttgcggatcaggatgccggcgatcaggcaggtaacgaaggccggcagattgatgccggcctcgacgatcgccgcatgcagggccgtgccgagcatgatcgtcacattcagcatgaagatcgcccagagcacggcaaagtagtcgagccgcggctcgggtccgtcgctggcggcgccgatatcgagccgggcatcacctgatggtgtcacaccatggcgcgccatcaaccaggcggccatcggaccgccgatcacacaggccgcgatcaggccgacggtgttcgcggcaatgcccagttccagcgcgttgaggatgccgagatcatcgacgaaatgcggcgcccaggcgagcgtggtccccaccccgccggtcagggagatcgacccggccatcaaccccgcccgaggatccaggccgaaaatgccggcaatgcccatgccggccaggttctgcagcagcatgaacagggtggcgagcaccagcagcaccaccagcggccggccgcccttgagaagggtgcgcaggtccgaacgcaggccgatgcccgagaagaacagcaggagcaggaaatcgcgggcatccagcgcgaacccgatccggtgcccggtcgtgaagaagacgaaggcgaccaccgccgcacagagaaagccgccggccaccggttcaggaatggcatagcgcgcgagcagcggcaccttcatggtcaggatcttgccggtcaccagcaacaggatggcgatggtgaaggacaggaagctgtccacttcggtcattgcagcgatctcctgaaccggccgagagagaagacgaacagggccgagccgatggcagccagtgccaggaattgcggccagaccgtccccggcccggctccgcggaacaggatcgactgagccagtatgacgaaatgagtgttcggcgccgccagcatcaccgtctgcacgaattccggcatgctctcccgcggcgtgttgccgcccgaaaggatctggagcggcagcagcaccagcatcagcagcaggccgaattgcggcatcgatccggcaagggtggcaagaaagatgccgagcgcggtggtggcgaagagatgcagggcggcaccggccatgaacagcggcagcgacccttcgatcggcacgcccagcagcccctggacaacgaagaccagcgccacggccgaggccgccagcacgacgaggcccatcgaccagaccttgccgatcatgatctcggccggcgtcaccggcatcaccagcagatgctcgatcgtgccgtgctcccgctcgcggatcagggcagtgccggtcagtacgatcgacagcatggtgatgttgtcgatcacgctcatgatcgagccgaaccagctcttgttgagttcgggattgaagcgggccctgagcgccagatcgaccggcggtgtggccgatgcgcgatagcgctggaggaattcggtgatctcggcagtcaggatgctctggatatagccggcaccgttgaaggcctgggtcatccgggtcgcatcgacgttcagctgaatctcgggcgaacgtcccgccagcagatcggcctgaaaatccggcggcaggtcgatcgcgaaggtgtcgagcccggcatccatccgccggtccatctcctcgggcgtgatgtgctcgggcgatgcgaaatacggcggttggaaggcgctggcgatgcgtgtcgacagcggcgagacatcttcgtcgacgatcgcgatcggtgcccggttcagggtttcgggcagggcagtggccgaactgtagatcgcgagcgtgaacgcatagacgatcagcgccagcagcatcggatcgcgcagcagaccgcgcagctccttgacccccagatggaagatggtcgagagatgcatggggaacctacctcgcctgctttttcagcagcatggccgataccacggtcagcaccgggatcgcgatcaggagcggcaggaacgaggcctgcagatcctggaagtccagcgccttggagaaagtgccacgcgcgatcaggatgaaatgagtggtcggataaatttgtccgatcgctgctcccataccttccagcgacgataccggatcggtcagccccgagaactgcaccgccggcaggatggtcagcaccgtcgtaccgaagatcgccgcgatctggctgcgcatgaaggtcgagatcagcaggccgataccagtggcagccgtgacataaagcagcgccgccgccgccagcgtcaggaaactgccggtcagcggcacgccgaagacgaagaccgccagtgccgtcagcagcaggaagttcagcatggcgagagccacataaggcagctgcttgccgagcaggaattcaaagcgggtaaccggggtcacgtacatgttgacgatcgaccccagctccttttcccgcaccacactcaaggccatcagcatggccgggatcaggatcagcagcagcgggatcaccgccggcaccatcgcaaccaggctcgccacatcggggttgtagcgatagcgggtctggatggtgaagacgtcagccgcggcagtgccggcctcggcggcgcgggtcgccagccaatgtgcatgcatgccctggacatagccgcggatggtctcggcccgctgtggcatggcgccatcgaaccaggcaccgacctcgaccggccgcccgcgggcgacgtcacgaccgaaccccggcggaatctcgatcgcgagcacgatttcaccggcgcgcatacgccggtccagatcggcatagccggtgatcggcggccgttcgataaaatagcgggagccggcgatgtcccggacatagctgcggctggtcgtggtctgatcgcgatcgagcaccgcaaatgtcagatcctcgacatccatgttgatcccgtagccgatgatgaacatcagcagcacgctgcccagcagggcgagcgtcgcccggatcggatcccggcgcagttccagactctcacggcgggtgtagctgagcatccgccggggatcgaagaaccgacgctggcggggcaccaccgccgtggtcgccgcagggccggcatcggagacgaccggcgccgcggcatcgccgccccccgcccctgccgattcgagcacggcgacgaaggcctcttcgagcgtcgccgccccttgagcccgccggatctcgtccggccggtcgctgaccagcacccggccggcatgcatcagcgagatccggtcgcaacgctccgcttcgttcatgaaatgggtggagatgaagatcgtcaccccgtcacgccgcgacagctcggccaggatctgccacaacacgtcgcgcgccacgggatcgacacccgaggtcggctcgtccaggatcaggatgtcgggcccgtggatcatcgccaccgccagggacaggcgctggcgaatgcccagcggcagcgccgcgggcagggtatccatcaccgtgtccagatcgaaccgcccggccatggccctgacccgcccggggatctccgcttccggcaggcggaacagacgggcatgcagctccagattctggcgcaccgtcagttcggaatagagcgagaaagcctgcgacatgtagccgacccggcggcggatctcgatgtcgcgcggatcgacctcttcgccgaacagacgcgcacgcccctcgctcgccggtagcaggccggtcagcattttcatggtcgtggtcttgccgcacccgttggagccgagaaaaccgaagatctctccacgcgggatctggaagctgacatggtcgaccgcggtgaaatcgccgaagcgcatcgtcagcccctcggcctcgatcgccatcccgccatccgctgccgcatcgcgaggcgggatcaccacgcgctggtgaccgtgccgcgcctcttcgggcagcagcgcgatgaaggcatcgtccagggtcggcgccccggtccgggccagaagctcaaccggcgttccggtggcgagcgcccgtccgtcatccatcgccaccaggtggtcgaagcgggccgcctcttccatataggcggtggcgacgatgacgctcatccccggccggtcggcgcggatgcggtcgatgagatcccagaactgccgccgcgacagcggatccacgcccgtggtcggctcgtccagaatcagcaggtcgggatcgtggatcaaggcgcagcaaagacccagcttctgcttcatgccgcccgaaagcttgccggccggccgtttagcgaaaggggcaagcccggtactcgtcagcagatccccgatccgccgcgcccgttcggcccgatcatggccaaacagccggccgaagaaatcgacattctcgaacacgctgagcgtggcgtagagattgctgccaagaccctgtggcatataggcgatgcgcgggcaggtctcgcgacgatggcgcgcatccgccatgtcgccgcccagcacctcgacccgcccggcctgaaccgcccgcgcgcccgagacgagcgacagcaggctggacttgccgaccccgtcggggccgatcagcccgatcatgcggcccgccggcaagtcgagcgtcaccgcgtcgagcgcccgtgtcttgccataggtcagcgaaacccgatccagccggacaaccgccgtcatggtcagtgcaccagcgtgccatcgagcgtcgacggccaggcgacgtcgggggcgagtcggacataggccatgccgggcagaccggtcttgacctggcggatgtatttctggagcagatccggtgcgatgcgggccctgacccggaacatcagcttttcgcgttcgaccgcagtctcgacggtcttgggcgtgaactgggcaacgtcggagacgaaggaaatctcggccggaatcacatattgcggcgccgcgtccagcaccagccgcacctcggtgcccagcgccacccggcccgcctcagcggtgggcaggaagaaggtcatatagacatcgcccagatcgaccatgttcagcacggcgccgccggcagcgagcacctcgcccggctgagcgacacggaactggatgcgcccgtcgcgtggtgccttcaattcggcatcggcgagatcggcgcggatccgctgaagggtcgccgccgcagcctcgaccccggcctcggcgtcgatcacgcccgaggcggccgagccgatcgcagcttccgcggccgcaagctgcgcacgtgacgccgcaaccgcagcgaccgcgccctgaagccgcgcgcggtcgtcgtcgaggatctggtcggaaacgctgccacggcgcgacagcatctcggtccggccaaggcgcttggcggccgcatcacgttcggcttcgcgctgggcgatcaccgccccggcagcggtcttctccgcctcgcgctgcgtgaccaggctgcgggcggtctcgacaccgatccgtgccctgcggagctgggcctcagcctccgcctgctgtgcctccagctgatcggtatccatgcgcgccagcacctggccggcggtgacgaaatccccctcgcggaccaggacatcccggacccggcccgcgatccgtgccgcaaggtcgatctccaccgcttcgatccggccattgccggcagcgatgccgtcgggcagtccgtcgggccgaagcccggtccaggcataccagccggcggcagcgacaacagccataaccaaaacgggtatgatatgagatcgtttgatcatgaaagttgcagcctctatcgacagagatgaaattggttgcgacacccccttctcaggtcggcctcgccatcggcgagaaccggaatatcttcggagaaggcagtaccgatcagggacgatcctggcggcaacaccggccaggcaccttgacctgaatcaacaaccgttgacacggcacaggataggatccgtgctgcagcgccacaatcgaaataatggagacacccgatgtcggaaaacgctcagcgatcatccgcagccacgcgtcagcgcatcctgcgggccgcgatgatccgctttgcccggcatccttacgaagagaccaagctgcgcgacatcgcaaccgatgccgagatcgacgtcgccatggtccatcgcgctttcggatcgaaggagcagttgttcatcgaggtggtccgcgcggccgtgcaggcccgaaccacgatcgaggagcagaccgatcccccggagcaggccttcgcccgcgagattttcgacccgctgctggaccggacattcgggctggtggacccgatggacatcatggtccagtccctgtccagcgcccaggcggcgccgatcctgcgcgacttcattctggaagatgtgatcgatccgatcgcggcgcgcaccgcggatgtgcagcgcgacgcaggcaggccgccgctgacatcggaggcgatcaatgaacgcgcagcccttgccgccgcctgcatgacgggcatcgtgctgtttcgccaggtgctgaagatcgatctggtgggtgatgaccggcgcgcgcggctggaaccgctgatccgcgccgtgttgagtgcggcacttcatccggccccgtgatcggcagatgcggtgggacggcgcgccgtcgtatgctggccggatcggaagacgcgcccgaccggcgggagagacccggccgggcgacatacagggagtgccagccaccatgaccgacgccaccccccccgcccgcccccaggccgtgcccacccttcaggtcgatgacgaccgggtgcgggtaacgctgtggagcttcgcccccggcgccgagacggggtctcactgccatgatctggattatgtggtcgtgccgctggccaatggccggctgcgcatcgaaggccccgacggcgccgcccggacggtggagcggtctttcggcgcgtcctataccggcacggccggcaccgatcacaatgtgatcaatgacggcgacgagcccttcgccttcgtcgagatcgagctgcgctgatccaagggccgccgggctcagtcgccgagaccgagcccggcccggatctctgcaggcgtggcgggcaggccgcccgccgcctcgaccatctgcaccattcgtgcgaccagaccggcattgcccgtttcggtgccgaacggcgcatcctccagcccggttcggacatggccgccggccgccaccgcatgcggcagcagatcctccagatccacacacagcccggcgatcatccagggggcagccggggcagcctctccgagcagagccagatgtgcctcaagcccatagcggcggggtgggaacccccaggcgaaggcatcggagaacatgaaccggtagagcggcgtggcaaggccgggcgtctgcccggccagcagggcaccggcccgggtgaagcccggttcatagatcgcgtagctcggcaccaggcgatgggttgcggcaagcgccagcccgtggcggatctcggcttcggtgttggtgtagacgaagcttgccaacgccgccggtccgtcgcggcgatcgatgaagcacaccgtgcccggatcgatgaccgccatctcgatgaggccgcgggatgccaggaagtcgatatgggcgaaacgcgcggccgggccggcggcctgacccgtgagcgccgcaccggcaagcggaatggtgggatagaccagggcatcggtggtggcgcggataccctcgatgatccgggcataggtggcaccatcatcattctgccggcctgtctcgggatcataggcatggacatggatgatgcccgcccccgcccgggcggccgcaatgccatcggcaatgatctccgcctccgtcaccggaatacccggctgacggtcgcggccccagggaccgttcaatgcggcctcgatccagaccggccgcctgctgctggtattcatcattgcactcccgtcccgttcagtcgccgaccaagggtatcatcggtttcgcgatcatcagccacacgatccccggacagtgcggggccgccggtaaagccgacccgaggtgtcggcgtccacgacgggcacatgtacgcgatatcgccctcaccgcagcagcaaaggcatagcggcagcggccgaccgtcggtcccaccggaacccggccgtgccgagccgggttgtggccgaagcgggttgtgctggcccgtccttccggaaccagacggagttgatcatgcgcgagaccacgacacggcatccgcaggcaggcgaccgggaccagacggccccggtggtggtcatcaccggcggatcatcggggatcgggcgctgcaccgcgctgctgttcgcccggcgcggctggcgggtggggttgatcgcccgcagcgccgacggccttgccgatgcgcgcgacgacatcctgcgcgagggcggcgaggcggtggccgccgtagccgatgtttccgacgcccgcggcctggatgccgccgcctcggcgatcgaggaccgctacggccggatcgatgcctggatcaacaatgccggggtcgggttctacgcgcccttcgaagacgtggcggaagaggaattccggcgggtgaccgaggtggattatctgggggtggtcaacggcacccgcaccgccctcgcccgcatgcgcccccgcaaccagggcgtgatcgtcaatatcggctctgtggtggccctgcgcccgatgccgctgctcgccccctatgccgccgcgaaatccgccgtcgccgccttcaccgaggcggtgcggaccgagctgatccacgaccgcagccggatccatctggcgctggtgcatccgcccgccaccgacacccccttcttcgcccatgccggggcccgcctggccgagggcgtcccccgcccgacaccgccggtctacccgcccgagacggtggcagaggcgatctgggaggcggtcacccggcgcaggcggaccgcctgggtcggccgcgccacccgcgggctcggccttgtgaaccggctgatgccggggcttgccgaccagctgaccgggcggttcggccgggcggcgcaagtgacccgcaaccggcgggccgctgaccgccgcgatccggcggtgttcggccccggccggcacagccatgccgtccatggcggctgggcggagagcgccggcaatggacggcagatgcgcatggcggcgctggctgcgggcgggctggttctgggcctctggctggcggggcgccaccggcgcagccgtccggcccgcgcgtgacggagggaggaggatccgatgtcagccccccgtctcgacaccaccctgctcggtgcaatcgccggcgtgatggcaacggtggcgatgaccgccgcgatgcgccgcatgcggccgctgttgcctgaagaggaccgctaccccctgcccccgcgtgagatcgtcgacagaaccacagaccgcaccgaggacgagcaggcccggcgccgccataccctgctcgcccatttcgctttcggcgccgcgtcgggcgcggtcttcgccctgctgcgcccgcggggcgggctggcggcgggggccggctatggcgtcgccgtctgggcggccagctatctgggctggatcccggccgcccggatcctgaaaccggcaacccgccacccctggcgccgcaatctgctgatgatcgcggcacatctggtctggggcgccagcctcgccaaggggcttgaggatctggaccgggcggaaggtgagctgttcgagggcgccccccggcctcaccccgaccgcagatgacgggtccgggatcaggcccgggtggcgagccggatcatctcatccaggtcgctgccgtcaccaaaaccgaaagcatcacccggcgcgccggtcccaggtacggcatcagcgccggcaacctccggcggtggcgtccccgcggataccggcgcctgcggcacggcgccggcatccgccgaagccgtatcacccacgccctcggtcgcctgatccttgacggccgcgtcgatccgctcccggatcttcgtctcgatctttgcccggtcctcgggcgacatcgccgccaggtcttcctcggtcagtccttcatcggccaggaacatctgacggtagcgttcggccggggtcatggacatgaaatccatgaaagcccgttcggccgccgaccagccgctgtcgtcatccgacgcagtcacgcttcccgaggacgcaccggctgaagaggaaccggctgaagaggaaccggcagcttccgtggcttcatccgccgaagttgccaccttgtcttcggcctggccgatcatctgggcgtcgaacagcgtctgactggtcgcactcgccccgcctgcagccggcgccgccaatcctgccgaagacatgcggccggcagaagatgccgccccggcagattctgccgggggcaccgccagggcggcaagttgtgccgccggtccggtcaggcgggtgagctgttcagctctgccgacctggctgaaatactgggcgggaaagccgcccgcaccgcgtgcctgtacatccatggtgttacgtccccggcattacgaagcctgtcggggacgaatgttgcaatatgcatgccgaaaagagggagtggtgcggacggcgggggtcgaacccgcactccttcacggaagcggattttaagtccgctgcgtctaccggtttcgccacgtccgcgcgcgagggtaggcacattgtaacccgtgcgctgcgaacgcaccaataccgggaacggctttcactgtccagtacctccgggtgccatctcgttacccttcccggaagaggatgggaacggccatctcgcccagcaccttggaaagatcggcctcggcggcatcgagttcggcatcgtcggtgccgcgcagcaccaggctgaccgagggcttgccgccgcggaaggcggggtaggagccgatttcgacggtcggatggcggtcctgaacctcgcccaggcgctgggcgatctcgccttcggcaccgtcgaccaccagggtgacggcgcgggtgaccgccccgccttcaagcgtgggcacgacattgtccatcatcgcggccgcaatctgcggcacgccagccagcacgtggaccttgccgatccggaagccgggggcgatcgagaccggattgtcgatcagcgtcgcgccctcggccgtgttggccatacgcagccgcgcctcggtcagcttgtcgggcgggtaataggcctgaagccggcgctcggcctcaggatggcggatcagccgcacgcccatggccttggaaaccgcctcggcggtgatgtcgtcatgggtggggccgatgccgccggtggtgaagacgtaatcggccttggcctccagcgcgtggatggcgtcgacgatctcggcctcgacatcgggcaccacccgcacctcgatcacccggatgccggccggggcgagtttggtcgcgatcatccgcacattcacgtcctgggtccggcccgacaggatctcgttgccgatgaccagcaccgcggcggtgcgggagccgccccctgtggcggggctcgtgtcggcggcaatggacggggtgggggtggtctcggtcatcggacgggtcccgtgcttgaagatggcgcgtcgatctcgccggcctggatcaaccagtcgatggtctcgcgcaggatgctgtcgagcggcggcggcgcatatcccaggtcgcgcttcgcccggtcgctgtcgatcgcgaccatgtggcaggtgatccgcgccgcatcgggcgtgatggccgggcgcaggccggtcagccgcgagaccaggccgagcgtctgcgccaccgccatcagcagccggggcggcgccacccggtcggtcagccgccggcccataatgtcgcccgcccggcggatcagctcctgaaagctcgcctcgggcccgcccagaagatagttctcgccgatcatcgcacgatctgcggcggcaatcacggcatcggcgaccgcggcggcgcctgcaaaactgccgccgccgggcgggatcgccggcagccggccgcgggcggccagccggatcagcccggcccagttgtgccggtcccaggcgcccagcatatggcccgggttcaggatcaccgcatccacgccgcgggcgatcgcatcctgcaccgcctcttccgcagccgccttgctcgccacgtaacccacgggatgatcggccccgaccttggggcaatgctcgtcgacccgccggcgatcgaagccatagaccgaggccgaggagacatgaaccagccggcggacgcgggtcagcagcaccgcctcggccaccgccgcggtgcccgccacattggtctgccattgccgggccctgtcgcgcgggtcggtggaggtgtcggccgcaagatgcagatagacatcggtatcatcgggcgtctgcgccgccatggcatgggcgtcggtcagcggcgcctcgatcagctgcacgccccgggcgttcagccagccgcgcgcctctgccggggtttcggggcggatgaaggcggtgaccgcccagccgggatcctgcgtcagccgcgcgaccacgtgccggccgagcatgccgcccgccccggtcaccacggcgcgccgcggcatctgtgttcccgaaccgcgcctgttcatgctcgtccccgtcacacatccgaccgattgatggcgttcggtcgcgattatgaccgcggtcgccgcaggcttccagtccgcaggccatcgggcgaccgcttgcgccatggcaggcccgcgcctagtctgacgccatgaccgacaccctgccccggccgatggcggccctttccgataccgaccatcccggcctcgtcttcacgccgccgctggaacctgcgcgtctcgtgcggcgctacaagcgttttttggccgatatcgtctttgaggacggtacggagaccaccacccatgtcgccaaccccggcagcatggccggccttgccgagcccggctcccggatctggctgcagcgctcggccgatccgaagcgtaagctgccgttgtcctgggtgctggtcgaggtggcaggcggcgcccatgtggtcgtcgacaccggccgcgccaacgggctggttgcggatgtgatccgcgccgggctggttccgggcctcggcggcgccggcacgacgctccgccgcgaggtgcgctatggccaggcctcacgcgtcgaccttgtggtcgacccggccccgggggcgggcggcctgccggtctatgtcgaggtcaaatcggtcaccctgtcacgcaggccggggctgggggagtttcccgacgcccgcaccgcccgcggcgcccgccatctggcggaactggcggcgctggcagagagcggcgccgcccgggccatactgatctatgcggtgatgcgcggtgatgcggcgcgcgtcgacgtcgcggccgatatcgacccggcctatgccgcggcgctggatgccgcccgcgcggccggggtcggggttctggcactcggcttcgaggcaacgccccggggcatcggcttcacggggctgctgccggtcgccggttctgcaagcggcagatgaccgacgtcacgaaaacgcgcatgtcccgcgattgccggatggccgctggtgtaatatctatgcagtcaaagaagccatcgcgcagaacacccggtcgcgcagaacacccggttcggtccggcggatgacgccgggggaaagcaggaaacgatgatcaagatccacgcgcccgaggatttcgagggcatgcgcaaggcgggccgtctggccgccgacgtcctcgacttcatcactccacatgtacaaccgggagtgacaaccgaacgcctcgaccagttgtgccacgacttcatcctcgatcatggtgccatcccggcgccgttgaactaccggggcttccccaagtcgatctgcacctcggtcaaccacgtggtctgccacggcatcccgaccgatcagaaggcgctggtcgaaggcgacatcgtcaacatcgacatcaccgtcatcctggatggctggttcggcgataccagccggatgttcccggtcggcaagatctcccgcaaggccgagcggctgatcgagatcacttacgactcgatgatgctgggcatcgcggcggtgaagccgggcgccaccttcggcgatatcggccatgccatccagagcttcgtggaaaagcagaaatgctccgtggtgcgggatttctgcggccacggcatcggccgggtcttccacgaccagcccaacgtgctgcattacggccgtcgcggcgaaggcgaagagctgaagccgggcatgttcttcaccatcgagcccatggtcaatctgggccggcccgacgtgaagatcctgtcggacggctggaccgccgtcacccgcgaccgccagctctcggcccagttcgagcatacggtggcggtgacggagaccggctacgagatctttaccggctctcccctcggcctcgaccggccgccctatcgcaccgacatcgccgcctgaccacggcacccgcaggggatccacgatcgcgatgaccgaccggcgccgccccgacccgaaccagaccaccgcggcgccggtgaccggtttcgcccgcgccgccgatatgatcgcgcgtgcagcggcgcggcctgccgaagaggcaccacaggcagtgtcggccgcaccgcagccgccggttctggacgtggaatccatgccctggtggcaggaggcgggcccggtgcggacatcggcgacgggccttgatgaagcctcgggccgcgtcgcccggccggcgctgcccgaggcgcccgaaagcggaacggcgaagccccattaccacggccatcgccagcgcctgcgcgaccggctgctggagcggggcgccgatgcgctggccgattatgaactgctggaactgctgatcgccgccgccattccacgcggcgacgtgaagccgatcgccaagcgcctgcttcagaccttcggcagcctgggcgacgtgctgcatgccgagccggcccggctgaaggccgtagacggcgtcggcccggcggtgctggcgcagatcaagctggccgaggggctgaagatccgctccatgcgcgaagaggtcatcaaccggccgctgttcgcgtcatggcaggcgctgatggactatctgatggccgatctgggccatctgagggtggagcagttccgcgtgctgttcctggaccgcaagaaccggctgatcgccgacgagatccagcagcagggcaccgtcgaccatacgccggtctatgcgcgggaggtgatgaagcgggcgctggaacacgccgcctcgtcgctgattctggtccacaaccaccccacttggcctctgaaactcacgttcgatcacgcttaagcacttataggcacaggcattttctgtcttgcgcactgggggcggctcggggcatattgggggcggtttcgaggggatcgagagagcaaaataccccgtttgccgctccctcttacccgtcgaccgatcccagctcgcacccgtgcggtgatccggctggagagccgataggagatccgagtgccgagccttactgatggcgagatcaggcaagcgttgaagcgggtcgagctcaccgggaagcaggagaacctcatcgacggcgagggtcgaggtacgggccggctcgtgctcgctctgaagccgatgcccactcgtgtgacggccgattggatggcgcagcaatggcgcgacggccgccggttcaagcgaaagatcggctcctatccgtcgacatcgctggctcaggctcgcgagctgttcaagcgggatttcgccgatgcgatccagaagggccgcagcatcaagatcgccggcgacacccggccggggacggtggcggacttgtttgagggctacgtgaaggccctcaaggcggccgggaagccgtcctggaaggagacggagaagggcctgaacaaggtggccgacacgctcgggcggaaccgcccggcgcgcgagatcgagcccgaggagatcgtggaggtcatccgaccgatctacgaccgcggctcacgcgccatggccgaccacgtccggtcctacatccacgcggcctatagctggggcatgaagtcagagcacgactaccgcagcgccacaccgcggcgcttccgactcgtgtacaaccccgcgtcgggcatcccgaccgagcccaaggtgcagggcacgcgatggctcgacgaggacgagttcgttcggctctatcgctggctcgagtgccccgacgtgccggtccacccgtcctatcctcgcgctgttcagctgatcatgctgacgggccagcgcgtggaggagatcgcccgcctccatgtcgaccagtgggacgcggctgagcgcatcatcgactggtcgaagactaagaacctgcagccgcacgccgtgcctgtcccctcgatcgcggcggagctgatcgagtccatcaagccgaacgcgcacggttggttctttccgtcggcgaaagacccgtcgaagcccgtcagtcacggcacgctctacagcttcgtgtggcggcagcgggatcgaggggttatcccgttcgcgacgaaccgggacctgcgccggacttggaagacgcttgccgggaaggctggcgtaccgaaggagatccgggatcgcattcagaaccacgcgctgcaggacgtgagctccaagaactacgaccgttggaactacatgcccgagaagcgcgccggcatgaggcggtgggacaaattcgtgcgggctctactcgccaagaaggctgctcggaaatccgacaggaaagcggcgtgatcgatcgcatttggctgcactggctgggcgcaggttttctactcgcgattgcgacgccggcttctgccgatccctgcgagggcgagctgccctcccgcgcgggtcaggttttcgccggcgtcgtccgttatgtcggtgatggcgatagtctgtgcatcggaagcaacacgaatcccggggaatggatcgaggtccgtctcgcggatttcgacgcgccggagctgcaggcgtcaggcggagagttggcgaaattcgccttggcgcgggtcgcgctgcatcgccccgtgacctgcactgcagagcgcggccggagtggacgcgtcgtcgttttcgatcgggtgatcgcccgttgtcgcatcggcggggcgagcataggcgacatgctccgtgtcgtccgtgctcgcgagggaggtaggtgacgctatgcgccaacgccggggtcctacggacattcagcaaggctcatcagagaggtgtggagtcctgataacccaggggtgggttatcgcgccacctcaggttaggcccgaagctgccactgaaacatcgcataccgtgtcaccgtgaagccgtaacgagcgtaaagagccctacttgggtaggtcgacagattgccatacccacgtgggcccgatccattgaagggcgaccggccggttcgtaggttcgtggcgaaaggaccaagctctatgaccgattccgcacccgcgactgtcgtcgagtttccgaaaaaacctggcaagacgatctcgtcccacgagcgcatctggggcaagcccgtgctcacccacggctacaccgccctcccctcgatcctgatccaggcccagagtcggctcggcatcacgccgctccagttcaacattctggcgcagctcctcgactactggcgcgacccggcccgcgcgccgttcccatccaaggcggaccttgccaaccgaatcggctgcaagccgaagacgatccagaccaacatccgagcgctcgaaaaggcgggcttggtgacgcgcgagatgcggcggaccgcggccggcgattggaattccaacgtctaccacctgaccggcctcgtcgaacgggtgcagaagctggagccggagttcgccgaggcaaaggcgaagaagcgggaggcgcgcgaggctcaaaagcgggccgagacgccgaagcaccggcggggcgcgtgagcctagaaacgatttaccccgggcgcatgccgaaggcagaggcggtcccggggtgtccgtaggtatagatagatgaaaccccacccgttggcaagggttcgccggaggcggtcgtgaccgcggtcgccaagatggaggcggcgctgtcgcttgagcgcttcgctcgctatgtagcctgggccggcggcgatcggacggccgcgctggagctctatgccctaaacacccggctctcggaggcgctttacacgccgctccaggtgctggaactcgcgctccgcaaccgcatccataccgtcatggcggcagcccacggggagcgctggttcgagacggaggggctgctccaggcgccgcaccagcgcgagcaggtcgaagtagcgctcgccgatctcgccagggagggtaaagagcccctgcccggccgggtggtggccgcgctcaccttcagcttctggaccgccatggtcagtcccgcctacgaggacttgtggcgctctaccctgaacgcgatcgcgatgaaggctgccggtcggcggctcagccgcaagcagctctcccggccgttgacgccgatcaggatcttgcgcaaccgcatcgcccatcatgaaccgatcctgcattgggatctgcgcaagcaccaccggtcgatgcgggaagtgacgggatggctttctccggccgcggcagcctggtgcggcacggtagaccgtttcccttccgtcttcccaccacagggttacgatcttgcccgccccactctctcggatactgaggacgagtgagatgatgaaatcttgtgtgcaaaacgctcgcgccgatcgtgcgggctcacacgaggtggtgatctagctttttttctccctttagttcggatttgggcgagttgttcctcatggtcagcgcaaagaggccgaaacgcagcagatcgagcctggaagagcgcttcgtcttcgtaggcgacgccgtggcggccggcgaccgcgaggccctgcgttcggcgatgttcgaggtcgaggatcgaatcaccggcctcgaacgaacgctcaagctctggcgcaaaacgggcacggcggtcgatgacgaccttcgccagctctggcatcacgagatgcgccaggtgcaacgggtcatggcatatgcgggcgctcgggacgttattgtcgacgtactcgagttcgtggaggacgacgagaacttcggtgtcgtcctcgaacgcgttggccagcctcttgtcgagcgccggcgccgcgcgccgcggccgcactggctacgcaacctcggcgcgcctagaccccgcaccctgttctggcggaacctgaagcgggtggtgaccgcgctcggcatcgtccatgcccaaggcctcgtgcacggccgactgaccgcggacgcgatcatgaccgagggggcggatgagcccgactttcagctcgggggcttcgagtggagcctatggctcagcgctgatgtcgccgagcactctcacgccagagtgactcccgccaccgccgtcaaccgcgcggaaagctactccttcgccgaggactggcgcgctctcgggcttctcgctgctgagtgcctcgactcggaagtcagggcgtccggtgacatcgtgccccgagccggccttgaggtgccgatcatgctgcaggtgccggaacgcgttctcctaaagcgccttgtcgctcccggacgcatggaccacctggaggctggctcgatcgggcgcgccatcgacgatctgatcgtcaccgtggggcgctccgcgaccgcgcgcgccggcgcctttgtcctgaccttcgacgccgcagcgaggctcggcgaagccatctacgacgcttcccaaggcgagatcgcgggcgacgagtaccgtcggcagctcgattgggtccaggcggacctcgatgcgggagccacgctgctggtgccgcaagcattcgatcccggcaggtctcagctccggctcgtgaccgacaacatggtctaccgccttagagccttccgggacggcggcgtcgcgctatgggatatcgcggtggcccaaggcgccgaggtcaggggcagcaggttcagcctcggcgatgccgaggagcatgcgctgacgcaaggcgttatcgtcaccgcgaacgcgcgcgaagcgcaggagactaggggacggctgggaccggacgccctcgactggagcgggttcgccgcgcaagcgcgcgaagtcgaagtcccgagcgagaccgccgccataagacgtgcgctcatgctggtgcaggtcgtcgaagccgtcgttaaggcgcttgaggtttatccgattgaggtgctggaaagtgggcgcgccggagggcgccgcttcgtggtgcttcgggccgagccaaataacgagcgagacggcgtcgccaagaaagttggcctcctcgagagtgccaacgcgctcaggcgtttgttcgaggaggagcatcaagacgccgaggcgaagtggcgcatcagccaagcgtctagcctgggcgcgacacgggcgggcgacgttgtggcgagcttcgtcgatgtcgtcgagcaccgtgggcggcgggcctaccggttcgagatcgacgaggagctcccagacggtgatcgcttcttcctgcgcactgagcgcgacaccgggaccgagcaagtcatcggccgacggctgcgcaacatcaaggccctcgacacgcgagtggacctcgccgaaatgctcgccgacccatggcgcgttcgtcggtccagccgtgagaccttgagcgaggaggatcgcaaggaccccgctttcttggacctcgacgtgccaaagcaagaagcgctcgccggcctttgggcgacgctccccgcatacttcgttgtcggcccgccgggtgtcggcaagacgaagttagcgaccgaggtggttcgccgtcgctttgttgccgatcgctccacccgaatgctcgtgagcgcgcagggtcacgatgcactcgacaacctccagcaaaagatcaaggagagcttggcggaggcagcgctcaccgacgtcctcgtcgtgcgctcgaccaccaacgatcagcggccgacgagcgacgaggaggttcatcgcgccgggctcgactatctcgaacgactgtcgcgcagcactctcgcggcggacgcgccctcaccgatccgcgcgcgagtgacggctttgaaggaggccgccggccggctcgagacggcaaaggaaacggtggatcgcgatcaccgcgccggtctgggggctgtctcccatcttgttctcgacgccgccaacatcgtcatctcgacggcgaactcccccgatgtcgagcgcctcgtcgaggcgcgcgagcagttcgactgggtcctaattgaggaggccgcaaaggcgatcggaccggagctggtcggccccctaatgctttcgggtcgtcgccttctgatcggcgaccaccaccagctgccgccgttcgaggccgatcggctcgtgaaaatcttaagcgatcatagtctcgtcgagcgagcgttgagcatcgccgagcagatgatcggaccgctcctccgggacggcgagctcgatgagcttgaggagatcaggggcgacgccgatacattgcgcgagacgtcaagcgcagcccttcggctgctcgagcctttccggacggtagtcgacgacgacgagcggcgcgctctcaccaaccccgcccaccgccccgtcgccgctaccctgaccgagcaacgccggatggacccggcgattgccgagatcgtctccaaggccttctacaatcgccgtctcaccacagaggaaaagcgcgccaaggctgccgaaagggagccgccgccgatggtgcaccacggcgcgctacctgcctcccccgtcgtggtcgtcgacttcccgcacgtcagcgcgaccggtcgagtggaagctttcgagcaggcgcggccgcggtggcacaacccacgtgaggtggacgccgtcgtggacgtcctccggctgttgcgggctcgcgaccccgaggacccgcccagccttgcaatcctgtcgccgtacaaggcgcaggtcgagaagctccaccatcgcgtggcatcggctcgcggccgcgaactcaagcatctcgacgagttcagggcggtgcgcagcaacggcgctttcgtggggacggtcgattccttccagggcagcgaggccgacgtggtcgtcctttcgctcgttcggaacaacgcgatgacaggcgggcgggcgctcggctttcttcgggatcggcgccgcatgaacgtagcactcagccgcgcgaagtcgcagctgatcatcgtcgggagcctggcctttatgcgcgaggcggtccgaggcgtgaacccggacgccgagtctcacgacctgtcgttcctgacagagatggtagacgcgatagaggatttggcgcgccggaagcgaggcgatctgcctttggcgtcgttggtcgccccggcggagctgagggctcgccggtgagcgtcctcatcgctatcccggtgttccgtgtggcttgcaaggtcggaatcgaccgcggccgcgcgtggagcgtcatcgatgagctggtgctctgggcgatcacccgccaatcgaagtcgatcgcggcgctcgcggccgcggcggacctgccgccccaaatcatcgtcgcctcaatcgcacggctgatgcgcttccgcctcgtggaggtcacggtcggagaaggaaccgtcgcgtttcgcgccagccccttcggcttcaagtccgtgagcagcggcaacccgcttcccttctatccaaagcggatttcgcggcgagtcagctttgtcatcgagtgggcgacgggcgatttctttcccacccgccagatccggctgatgaccccgtacaggctcgaggaggcgcgtcgcgcggggacagaggtgcgggtcgtctcggtcgagggcggtgggccgtcgatgtcgcacgacgccaacctcaaccgtctgtcggacatcgctgcgcggggttgggacgagcaggtcgccttggtggacggccgaacggccatcatgcgcgacgacgagttcatggttctacgagtcatcgacgggatcccccagggccttccggaaacggcaggtccgagtctcagggggctcgtcgccgaggcggccgccctgccccgcggaacaacggaggtacccgtcacctatgcgggtccaaaggagattttcgatccgcaacctgtcgtgcacagatgcaatttcgacgacgcgaatctcatcatcggcgggtcggcccagggtcgatgcctggagcgcctgctggcggacgctcatcgacgcgtggttattcactcgacctttctggatgccgcgcggttctccgtcctgtccggcccgatcaaggccgcgtgcgcccgcggcgttagctttgacctgttgtggggggccgagaaggacgaggagacggagcggcggaacgcagcgcaggcctcccagatcgctcgcgttgttggtgaagatcgagacctgcgcgggcgcttcaaggtccatatgcgctcgaccgggtcacacgcgaagctgatactgctcgatacggcagaggacggctggatcgcgggtgtgggctcctgcaactggctgtcgtcgcccttccaagccgtcgagttgacggtcctccttcgcgatcagcgtgcggtggcagacgtcgccgtagcgctgcagaatatggttggacggcgagggctcgccgacacgatcgctacggagatgtacattacggctcgcgacctacgccgggtcccgtcgccgggaggaagtgcggaagtctcgctcgtggtgggagacgcccatgatcagttgatcagggccgcgagcggtgccgcgagcgaacggttcgtggtcggcagcaacctactcggctccacggcgcgccctggggcactcatgcagggcgaagtcgccgccggccgcgagggcgtccgagccacggttgtctacaccaagccgaccggaccgctgaagaacaggcacgctcgcgtcctcgctgaggaggctcggtcgaacggcctcgcgctcgtcaggacgagaaagatccccctgcatggcaagttcgtggcctgggacaaagacgatctcgtcgtcaccagcctaaactgggcgtcggccgctgccgaccccgatttcccgtggggcgacatcggcgtccacgtccgagcgcggggcttagctaccgaagcgctccgtaagctggaagcgatcttcccggagatgactgtcgatcctttggcggcggaatcggcatagccgactgccgtacttggctcgcatacggcgggatcatgcccccgctgcagccagcgaaagccgccagaacggcgtggccgcgccatcggcccgagtaggatgcgagctcgcccgacctccgcagacacttgcctacaggccgagctgatgtttgccggcggccaaattgggcgcgtaatcgagattgagggcggagaactcggaggcgatatccgcatttagggtcgtccccgtcgcgccggcgtaatccttcgtgttcgaggacgcgaagacgatcttggacgcgagggccgccgcgcgaagctgcgctaccgtgtcgagataagtctcgatcaccacgcagtccttcatcgaatccttgccctttttggccggcgtccgagcctgattcaggcgtagaaaggcccgcgaggcgatatccgacccctgctgcgctggcgtcgccgcggcgatccaacgattcgcgactgtccgcgcgcgcatcacatgatcgtcgaggtgatccaagttggcatgcccggagctcccgtaagcagcagcgacggcgtcaatccggcggacttgcgccttcaaccggctgagcgcttggatcgcttcctcctcgacggtcgttacgttctccctgaactcgaacgcgacctggtcggctatcaacagcaccagatcggttccgccttcggccgcggccaggagggccagagcggcctgacgctcatgcgcccggacggcatctcgggtcgggtcgcgcatgagatcgagcgccgtgcaggtgtcgaagcatagaacaggcgcgccgagcgccgaaatgcgcgcgatggcggtgccggccatcaggctacgtccgagtgcggtcgtattcgttgagaagcgcgaggccgaactcgtactcgatcgccagatcgtgcgccttgtcgtcaggccaaccttccacttccgtcaaccaccgtacgagacggtcggtgtcgaatgagccagcatctcgatgggcttggagcaggaacgcgaaccagcgcttccggtccgaagggtgcgatgatccggtggacttgttggccgtcgcggagaaccggcgcagggcgtcagcggcggccgccggtagccagtcgtttaacccttgctgggccgaggtcgtctgaatttcgaagcgggctgcggtcgcggcgggtctggcaacgcgagcgatgaagtcctgaagagccgcgttgtagcgctggtgacccaactcgccgacatcgcgaggcacgatattggtgacctcgtaagcgtcgtcacgggaccagaggacgaggcagaccgcatcgacgccatcgccaggttctcgcacgaacgcaatgagatcggcgcccgcgcccgcatgggcggccatgtcgttctctcgcttctggtcatggctccaggggggcgtcgcatgcttcacgagagcgtcacggacacttgagcgaaggtcacccgtagagcggagaacaaggtcctgaaaaactgacaggttagcttccacagcactgtctccggctttagcccgcgctcaatgagttcggctcgtaccaatctccatatggcagccctagccgatcggcatgattgcggccgtgattccccgaaccgagtgcgagaacctacacggcggcaggattagcgcacatagtctatcccatgggtttccgcgagttgcggccgcaaagttgacatgggaggtgccggggccgtcagctttcgcgagaaacgaggacctactgggaggcgttgtgctgcagccgatgagcgacatgccatcggggtggggctgcggcactgagttcgaatccttccggcgcgcctcctacgccatgaagcgatcgtctacgctcaggcgcgccgccttactcgagatcatcctgtcgccctacgccgaaacggcgccccatcgtcgacgaagatgcgaacttcgttctcgctgcagcgctatgaaatagctgccggtcttcccactgccttcgcgtttgcacgccagcctactctagcttgctcctacgccgaaagtgctgggacttgagggtcggacgaaaccaacccgaccctgcccgcgctggcccgctcacctgcttaatgcggtgcgcacgctcatcgaagtatttggtgccttggctcaatgggcacggagcaacatccatgccgccatggccaccatcatgacgttttcggtgagcgagacgaagcccagcggaaccttgctgctgccgccgacgcaggcacatttgagctgccgcttgtccacgtagaccgccttgaagacggacacggcgccgaccgtcccgatgaaggccgcgacggggatggagagccacatcaacgcgcctgcgaccatcagcacgcccgctatcagctccgcgaacgggtagatgtaggaatacggcacccagcggcgagccaggaggtcatagttcaggaacatgttcgagaagctctcgacgtcctggagcttcagcatggcgaggatacacatgctgaaggagatgaaccactccgcggctcgcaccgtcagcaactcgccgtccgcggcccagcccgtcgcaagcgccataagcgcggccacgccgaagacggccatcacgggccgatagctcacggcgttcggatcgggtacgtccatcttgaagaggcggcgcaggtcgtcatagccgccgaccctcttgccgccgatgaaggtctggggcgtggtctcgactccgtgctcggccttgaaggcgtcggcctcggcgcgcgaccggagccagcggtcatcgacgtcgaaccccttgttcttcaggagatgacgggccttgaggccgaacgggcagatgtgctccggcgtcaccattcggaagagcgttgcctttctggcctcggcagttgtcatgctcaatgatcctcccgcgatgatgagcggcagcgactccgactgcctcggtttctctgaggtttgccacggttgtaaggtcaagcccggagcgacgcgccttcggcccagccacgacggaagcacctagcccgacgcaggtttccgcaaggacgtgtacagccgagcacaatcctgaccgcacacgccgagcacgcagggataactgcgacgtctcaaatcgtcggcgtagccgcgggagtgaccgccagcatgtgttcaagaggctccagaccgtcgcggccagagcgacactcagcctcccaggcggttccccggccgggaggctgaggtgaacatcagtgatgcagcgaagcggagcggactgtccgccaagatgatccgctactacgaaagcgtgggtctgctcggcggtgtcggccgaagcgaagcgggatacagagatttcgacgcgagcgacgtcgctctgctctccttcattcgctgggcgcgcgagctaaacctgcccgtcgcgaggatcgttcagatcctcagagcgatggcccatggcgaagacgccgggccggtgctacgggcgcacgccgaagagatcacccggctcgtcagcgatctcgaggacaagcggacgacggttctggaactcgcaactggcgggtcatttcctctcacctcgggacatctggacgtgatccgctggcgggcccggagagcgcgccagcggctcgcatggctcgagccgaatgcctcggcacaggcgccgcgcggactcgaagacggaaacggctttcgcacgctgcgagcgtccctgccctgaagagcgcccccgactcccccaaggcaggccaggcgctcgagatgccgcgccagcctgccggagactcgtatggaccgacactacgccatcccactggctgaccggcgcgttgcagcggctggtgtggcgaaagtgctcgcgtcgaccgcggtggtttggatgaagacgcagggcttcagctggaacatcgaaggccgtgagagtatcgccctcggcgggttgctgagcgcccaggcgaatgagcttcggcgctccttcgtccctttgtcggcgcgcatccgcgcgctcgggctcttcgcgcccgccgggttcgctgacctgattgcgctgtcgcccatcgccgaagagcggggcgttccggtcgcgcgagagatggcgcggtgtctggaggccgaccacgcaacggtgacggggctcatccgttgcatccgccccgcgctggaggacatcgaggataacgcgacctgcctcgtgctcgaccggcgactctacgcgcacgaacgcgccgccgccgcgctcgccgccattcgccgcgagtgccccctgcagggaatgcttgccgcatccgtgcgggaggcgctggtcttagtcgagccgagcgagggaagcgacgtcgccccctgatgccgctcaaagccgggcttggcgtcggtattccgtcggcgtgacgccggccagccgccggaacacggccgcaaaatgctgcgatgaggcgaagccgcaggcgtgcgcgatcgtcgtcaccggctcgtccgtgcctgccagcatctgcttcgctcgttccaccctcagagtcatcaggtagcgatgcggcggctcgccgacggtggccttgaaggcgcgcgcgaagtgatacggcgacaagcctaccgtcgccgcgagttcgcagagcccgacgtcggaggcgagattgtccgcgagaaaggcggtcgcgcgcttggcctgccatggcgcaagaacggtcgaggcgtttcgactcgcccgatcacgcagacggagcagagcgcccgcgagctgaagcagggcgccatcggcatacagggccgcatgggaaaattcggatttcgcttcggtccaaagccggccgatgagccgggcgacctcgcaatcttgattgtaacgggtgtggagggggccgaaatcgccgtcctgcggcagcccgctttcagttcccgctagggcaagcaaactgcgatagggaatcgcgatcgcggtgagaccgtgcctgccgtccataaggatcgtggttgcgacggccggcgcgacgacgatgaactgcccttgaagctgagtgccgctgaaccgtcccgcgcccagatccattgaggcgcgaaccggcgccgtcgtgagccgggtgacgacaagctcgggcacgggggcatcagaccagtcgcctgcttgctgggtggcggcgacgagggtcgctccaacgcgcccgactcgtcgcaggtcggagacggcatgaccgtaaacatcgcgatagaacgctccaaagctgtcgtaggaccgatcagcgaaccggggtgcaggggtcatgaggcgctcccgaaaggcccagcatcggacgacgggtccagtcgttcgcgcagcctcgcgacgatctgctgaaacaggtcggggcggtcgagggcgcgggtgagaacaatggcgccttgaatcccgacgacggcctcttgggccagcgcccgagcgtcgtttccggaccaccctgctctcaccaaagcgagcgacagcgcgtcgagccagcgctcgaagtagctcttgacggagtcgccgaaccgctcgcggacttcgcccagtgcgagcgcgccgaccaggcacacccgatcgccggagcggaaataggtctcaacggcgtcgaacatcgccgcgaccgtctcgcgcggccgcgcatcctcgcgcagcggcgcgaacacgtggccctcgaaccagccatcaatctcggcgagcaccgcccgggccatctcttccttgccgcccgggaagaagtgatagaggctgcctttgccgagtcctgtcgccttcccgatgatggagaggctcgccccctcgtagccgtgctcacggaagacctcggccagagccggcagggcgtcagttcgctccgcaaccgtccttggcatcgcctaccacctcgtcttgccgcgagcgcaaggtgcgtcggccaagcccattgctgggctggtatcgaaggtggataggcggcggactgggcgtccgcaggtgagtgcgccccacgcgttgagatctcgccgcgtcgtgagcagcattgtcagcagcctccgccgttcagtcggtgggtggcggggatctctcgaggatctgtaccgcccattccgatctttaccgaacggtacaggacagtgcgtccggattcaagctcgtcaggccggcgttcattttggcaaggccgtatacagcggcgcacgaacgtgaccgcacccgcaacatcatgcgtggcagtgatgtgacgccagtcctcagcggtcgtttgatcagaacgcacttcgcgatgctgcttcacgccgtacagcccgctgacgcagatggaggcgaggcgcaagatgaagatgccgaacatgggccccgccgacacctccggatggcgtgtcgggcgcctgaatctggcctgctcagatagcggacttgcttccccggttgcgctcgaccgcgtcaagctcctccacatggtcggcggcccaccggcacaacatcgcgaccggctcgtggagccgccgcccgagctcggtcagcgtgtactcggtcttgggcggcacgacctggaatacctcccggtggacgaggccgtcgcgctcgaggccgcgcagcacctggatcagcatcttcttcgacaaaccggggatccgccgctgcatctcgccgaagcggcgcgtcccgcccgcgaggcagtagaggacgatcggcgtccatttgtcggcgatgaggttcagcacgcgccgcgccggatagcgctcgtccagcacctcgccggggccgtcgtcagtcatggtgccactccgggcctagcgcctcaggttacctttgggtgactactagcatgatcgttacctggaacatagcttggggcaacgtgctccaagtctcacggcacaggaggcccgaatgacgtcaatggctgatgccggcgtttgcagcgagggctgcaccaccgagacaaggcgcgcctcgtccgagacggggctgcccggtccgcggctcgagctgagcgtggtttccgacacgatctgtccctggtgctatgtcggcaagcggcgaatcgagcgggcgatcgaggcgctcgcggccgaaggccttggaatctcgctgcgctggctgcccttcgagctcaatccagaaatgccgacggccggcatggaccggcggacctatcgcgcggcgaagttcgggagctgggagcgcagccaggcgctcgacgcacaggtcgccgccgagggcgcgcgcgagggcatcgcgttccggcacgaccgcatcacccgtacccccaacacgcgcgcttcgcaccggctgatctggctcgccggcgaggtgggtggctccgcccttcagaaccgtgtcgtcgaggcgctcttcgcggcctatttccacgagggccgcgacatcggggacaaggtcgtgctcgcggatatcggcacgagcgccggcctggatgaggcccgcgtgctggcgcttctcgatggcgacgacgggcttgccgacgttatcgggcacgaaatggcggcgcggtcgctcggcgtcagcggcgtgccgacggtgatggtcggggatctcgtgttgttctcaggggcgcagcgcaccccgctcgtcgtgcgcgccctgcgcgagctggcgacggcgccgcagacaccagccgtcgcgcccggtgctgaggatcgggccgatgcgcggccatgaagccgacggcctgcgggtcgccatcgccggcggctcgatcggcggcctggcggctgcgaccgcgctccgctcggtcgggagcgccgtcgaggtttacgagcgcactccgcatcagatgacgagccggggcgccggcattgtcgtgcaaccctcgctgacggcgttgctcagccaggtcggcgcgccggcgctgccgatgacccgttgcacccaccgtcaatatctgtcgccggacggcgggtcgggcgcgctgagcgccatgcctcagcgcttcacctcctgggaggcgatttaccggacgctggtcgcggcgtttcccgacgaacactgccatcgcggcgtcgaggtcacgggcttcgaccaggagccgaacggcgggccggtaacggtgcggctcggcgacggccggaacgcggaggccgatcttctggtctgcgccgacggatggcgctcggcggcacgcggccgcctcctgccgcaggtcgctccgcactatgccggctacatcgcctggcgtggaaccctcgacgaaagcgacgccccggccgatctcgtcgacttcttcgacgacagcttcacgttctcggacgcccgcgccggcgggcatgcgctctgctacttcatccccggcgccgaggcgcggacgcagcccggcgagcggcggctgaactgggtctggtacgtgcatgtcgatgagggccccgagctcgacgagatcctgaccgacgacgccggcgagcgccgggctgggtccgtgccgcaggggcgggtcgccccggcggtggcggcgcgcatgcgcgaggcggctgtcggagagctgcacccgcgcttcgccaagctgatcgccgcgacgccggagccgttcgtccaggtaatcctggacttggccgtgccgcggatgctgttcgggcgcgtgtgcctcgtcggcgacgccgccttcatcgttcgcccgcacaccgccggggcgaccgctaaggccgctgacgacgcgcgggcgctcgcgctggcagcgcaggcctggcgggcggatttcgacaccgaactcgtgcgctgggaggcggatcgcctcgctggcggccaagcgatgtcgcactacggcctcgcgcttggccgccgggtggcgtgggcctgacgggagacgagcatggcaacaatcacagcggatgcacctcagcggccgggtgaagaggcggcgacgaaggtgcgcctcttcggtcgcgcggacagcgccgaggcgtacgtggtccgcgacttcctgatgcgcagcgttgtcggcttcgagtggattgagcttgcctccgacgaagactgccggcgcgagctgggtctgcctgagctcgccaatgttcgcctgccggtggtcgagctgccggatggcgcccgcctgttcgctccgacggtccgcgagatcgcggaccgcctcggatgggtgacgcagccgcgcctgcgcgagtacgacctctccatctacggcgccggacccgccgggctgtcggcggccgtctatgcggcctccgaagggttgcgcgtcgtcctgatcgagcgccacgcggtcggcggccaggcaggatcgagctcgctcatcgagaactacatgggcttcccgcgcgggatcagcggcgccgatctggccgagcgcgcccgccagcaggcggtgaagttcggctgcgagctcctcatgatgcgcgagggcatcaaggcggagttcaagaacaaacgcatctatgtcgacatggccgacggctcgaagatggtggcccgcgcgaacatctgcgcgacgggcgtcgagtggcggcgtctcggcctgccggacgagagccggttcctcggcgccggcctctactacggcgccggcgcgagcgaggcgccgatgtgccgcaacaagcacgtctacgtggtgggcggcggcaactcggcgggtcaggcggtgatgcaccttgccgaacatgccgcgcaggtcaccatgctggtgcgcggccccgacctggcgtcctcgctgtcggcctacctcatcgagcgtatccgggaagcggccaacgtcgatgtccggttcaacgtcgaggttgcaggcctcgaaggcgacaccgtgctgcgccgggtcgagctcaaggacatgggcaccgatgagagcgcatgggtcgacaccaagcggctcttcgtgtgcatcggcggggtgccgcataccgaatgggcgaaggacaccgccatcatccgggaccgccagggcttcctcgtgaccggtcccgaccttctccgcgaggtgcggccgcctgagcagtggccgctcgagcgggcgcccttcttcctcgagacgagcgtgccgggctcgttcgcggcaggcgacgtgcggcacaactccgtcaagcgggttgcctcggcggtgggtgaaggcgcgatggccgtcaccttcgcccaccgcttcctggcggaaacagcatagaggctgacgggaggcgatccgtggaactccgccagcttcgctacttcatagcggtggcggacgcaggcagcttcagcggtgcggccgcggcactcggggtcatccagccgacagtgagccaacaggttcagaagctcgaggatcgtcttcataccaacttgttcgagcgccatgcccgaggcgtgcgcctcacccatgcgggccaggagctccttcgttcagcacgccggatcatgttcgaagtagaccgcgcgctcacaagcatcagccgaattgcacggaccgaggctgggaagctgccgctcggcttctacacatccctaagctcgggtcccctgcgcgaggctctggccgccttgagggctgaggcgccggacatcacaatcgagttgtacgaaggcaatcctccagacctgctgtcggccttgcgcgagcaccgaatcgatctcgccgtcacggtgctcggagttacgtcccccgaatttcagacactgcacctatgggatgagaggctaatagccgccctcccagaggaccacgcgctggccgcggaagaaacggtaacgtggcgcgagctggccgacactcggctcgtcgtccggacgtgggagacgggcgccgtgctctacacgtttctggctgggcgaatcgcccgggacagctacctgcctgccgatcagcattttgtgtcgcgagaggtcctgctcggccttgtcggcctcggcttcgggatgacagtgctgggcgagacggccaccggtgcgcgttatccaggcgtggcctttcgtccaatcgcggagacggatgcctttgtgcccgttacggcagcttggctcgccgataacgacaaccctgtgcgcggacgtctggttgcgatgctgcgcgaccgtctgaaggaccactgcttcggatcggccaagcgtctactcgcttggttcactccgatctccacgatgctgctgggtgcgatttgacaacggtgtggtcgatcgagcgtcttggctccgccgcatgcgggcgaataccctgtcggtcgccatgaaccgcgccagcatcggcgcgacgagcttcgccggctcggccgcctggccggtctcgcgctgcaggatctcggcataggcgacgaggtcgcggtggacctgcgccggcagctcgaccgtgagccgcaccggcttctcctcgaccagcggcccgagcttcagctttgtcatcggtcagcccctgtagggttcgagcacgaggtctcgggtgacgatcacccgcacggggaagccgggccggattgtgagcgtcggctgcacgttcacctgccggcgcacgagctggtcgccggcgcggccgaccgtgtcctggccgctttcgcggatggcgcgggcgatctcgtcctcgccgtcctggccgagttcggtcgcgaccccgagcaaggttgcgaggccagcggccatgaacagccggccccagtggtagttcacgccgtcctcgagcccggcatagccggaattgtcggcgcccggctggcgctccagcacgatcgagcggccgttcgggagcagcagccggttccagacgagcagcacgcgtgactggccgaagctgacctgggcatcgtactgaccgacgagccgcgagccctgcggaatgagcagatagcggccgctcgggctgtcgtagacgttctccgtcacctgcgcgaccacctggcccggcaggtcggagcgcaagccggtgaccatcgccgccgggatgacattgccggcctggaggacgtaagggctcgccggcgcgcggacgcggtccgggctgaccgtgcggcggtcgacggcggcgttgaggaaggcgagcttccggtcctgaccgttttgcacgaacgcctcgtccgtggtgcggcgctctgcggtctgcgtcccatccccgccggcgctgccgatctgagcggagggctgggtcgcaccttccgtttgcgcgaacagccggctcacgcgcgccgcctccatttcctgcagccgccgctgctcggccggatcgacctgcggcaccggcggtgcggccgcaggcggcaccggcacgggctggccccggttctgggccgagacgatcggacggccgagatcgccgggcagcggcgggccgagctgcggcacgtccctcggcaaccccgcatagtcacgcggcaaggtcgcgagaccatcggccgtgggcttgcggtcggtgttgtagagctcggccggcgcgtcgccgtcgcgcgtctggagcgcaaagagcagcgcgccgccgatgcccaggccagccgccgcacccagtgccgtcagcaccttgcgcgacagccgcgtcacccgcggcggctcaggccgcagccgcagctcctgggctatctccttctccccgttcgggcgttcctcagtcacgacgtcggcctcccgtccgttcgcacgatacgcaccacctgctggctcttccccgatccgagccgcagctccgcggccgcgaacagccggtcgacgatcaggtagttccggtaggcgcgatagttgaccacctcggacttgccgtcggcgccgatcacgaacagcggcggcatctcgccctggacgatgccgggcgcgaactcgatgtagaccttgcgcccgtcatcgaagacgcgctgtggccgccaaggaggaggatcgccctggatctcgatcgcatagcggaagcgcacgttcgccggatcgggtggtgccggcgtggtcggcacggcggttcggggacgcgttgggtcctgcggatagaaccaggccaccgagggcatgtgcgtgcgctcgcgcgcaagcagctcgagatggtaggtgcgccggtcggtgttgatgacgaggttggtgtcgatgtcgggccgggtcggcttcacgagcacatggacgcgccaggtctcgcccgagccgctcgtggtgtcgccgatgatccagcgcgccgtgtcgccggccgcgatgggccccgtgccggtgagttgctccccgtactcgagcgcgatgtcggtcactcgtccaggcgaggcgtaaatccggtagagcgcgccggggctgtagctgtagacctggacggcgttgaagtagccctcgcggcgaggctcgatgcgagcggcgcggttcgccacggcgacccgctccaaggggtcgctcgcctcactgccgccggccggaccgccgcgggacggcgtgaccgcgggcgggcggtgcagcggccggggtcctgtgtcctgcacggtcgccgcaacgggcgtgggcagcggcggcacgctggcgtcgtagtcgatggccggcggcttgaaggtctggcaaccgccaagcgcaaaaccggaaagcaggagagccgccgtgccggctcgacggatgtgcggcggggtcattggccgagctcccgggaccagttgagggcatggacgtagacgccgagggggttcttgcgcaggcgctcggcgtcgcgcggggtctgaagcaccacggtcagaatcgcggtccagcgctcggtcgccgcgagctgtccctcctggtagcggcgttcaacccaggcgacgcggaagctgttctcggacgcgcggatgacgctggagatctcgaccgcgacctgctcgcggccgacccttgcgaaagggtcgttcgctcgtgcgaagtcgttgagcgccgccgcgccgcggtcggtcgtgaagtcgtaggccttgagccagttctggcggagcacgatcgggtccgccgggatagagcggacgttctcgatgaagcgggcgaggtgccaggcgatctgcgggtcggtcgggcggtagtccgcgaccgccggctcgacggcttgggcttggcccagccgatcgacctgcacgacccatggcgtgacggtgccgcgggcggattggaagaccagcgcggccgagaagccggcgacaagcgccagctcgcccaaggccatgagccgccagttccgcgcctgcacgcgggccgagccgatgcgctcgtcccaggcttgcgcggcgcgctgatacggggtctcgggttccggcgtcttgccgtagcggacgctcgctcgcttgaacatcctcactccttctcggacaggctgatggaggtgccgctgccgcctgcgtcgccagacttgacggcatgggcgacggcggtcgccccgtggctcatggattgctggcgccgcatgcgctgcgcccaggccggcgggccgtcgggcgagccggaggcgctcgccgtggcggccgacgcgggcgggccgccggcataggacgcgcccgcctggcccccggcgacgtagctctcgcgcatcgaggcggcggcgcggcgcagcgggctcgatgccgccatggcgccggccttggcgacgcctcccgtcccggccgccacgccaccgaggccgctctgaccgccggatcccgctcgatacgcgccgaccgcgccgccggccacggacgcgccgccacgggccgcacccgcgagcgctccggcgccgagccgggcagcggcggcgccaccgacaagcgcaccacctgcggcgagaccggtgcccaccgcggcacccgcgccgagctgtggcccgccggagatcaggccgttggcgataccgggtccgaagatgccaaggccgaggagcgacaaggctgccagcaccacggccatggcgtcctcgatcgtcggctgggcgccaccgaagccggcggtgaactcgccgaacagcgtcgagccgatgccgacgatgacggcgaggacgagcaccttgacgccagaggccacgacgttgccgagcacgcgctcggccaggaaggcggtcttgccgaacagcccgaacgggataagcacgaagccggcgagcgtggttagcttgaattcgatcagggtgatgaagagctggatcgccaggatgaagaaggagagcaggacgatcgcccaggcgaacaagaggacgacgatctggatgaagttctcgaagaagctgatgtagcccatgagcccggagatcgactccaggatcggccggccggcgtcgatcccgacctgggcgacgcggccgggctggagcagttcggccgagctgaccgagccgccggaggcctgaagtccgaggccggcgaagctctcgaagacgatgcgggcgaggttgttccagttgccgatgatgtaggcgaagacgccgacgaagatcgtcttcttgataagccgcgcgaggatgtcgtcgtccgcgccccaggcccagaacagggccgccagcgtcacgtcgatgacgatcaaggtggtagcgaggaacgccacctcgccaccgagcaggccgaagccggaatcgatgtaacgggtgaagacctcgaggaagcggtcgatgacgccggtgccgcccatggcttactcgtccttcggccggtcggccgaaggccgggattggtcgggcgacgcggcggcgccgttctggagacgggactggtccttgggccacgtgggagtgctcgggaacatctcgacaggcttacccggtgccgctggcttcccaggcgtgaggaagcgctggcggttctcggcccaaacgcgcttgcacagccagtcgtcttgggccgcgcggccgagctcggcgcagcggaggaggtccgcagccaaagggtcgtccggccggggatgcacgcggacctccttctcctccccggccggaccgccgccgagccgcaccgccgccaccgcagcggcgacgacgacgagggccacggcggcgacgcgggcgagcgtctgggggcttagacgcatcgcccgatctcagttgccgtggaacatccgcacggcggtcggctggtagccggcgccgggcgcgagaaagcggcggagctgttccctcgcttgctcctgagaggccgccagacgcgcctgctccagcgcctgcgccctgccctgggcggccatcagcgccgtcaggtcgccgagttgctgcgtctggagcgcgacgagctggttgccggcctgcgtcgcctgaagcgcgccggtcgcaccctggctggcggagaccagcgccgagagctgcgcgcgcgcggtgtcgaggttgccgaccacggtcgcctgggtcttcaacgcatcctcgaagccggcgaccgaagtccgccagcgctcgcgcgcgccgttcacgagctcggcgtcggtggcggagccgaacccgcccttgccgtagctctgctggaactgctgctcgatgttctggacgtcgtaggcgatgcgctgcgcctggccgagaagctgctgggtccgctgcacggactgctgaagctgctgcagggaggagtatggcaggctcgcgaggttgcgcgcctggttcaagatcatctgcgcttcgttctggagcgaggtgatctggttgttgatctgctgcaaggcgcgcgcggcctggatgacgttctgcgcgtaattcgacggatcgaacacggtgatggcgtgcgccggcggcgcgctcgtcatcgagctggcgaacggcagggcgaaggtgacgccggcgacgagcgccgcgcgcaggagtttaggcttggtcttcatcgtgcatgctccttggctgcggtggggaggaggtcggcgacccaggcgaggcccttgtgggcgagccaggccgcggcgaacccgtcgcggccgctctcgctgagcacccgcgcgatggcggcctggtcggtcttcgacgaggcggcgcagaaggcgagcgccacgtcggataggccgagctcgaagagccggttgccgcgtcgggactggcagtagtagtcgcgcttcggggtcgcccttgcgatgatctccacctgccgggcgttgaggccgaagcggtcgtagatggcggcgatctgtggttcgaccgcgcgctcgttgggcaggaagatccgcgtcgggcagctctccacgatcgccggcgctatggcgctgcgatcgacgtccgagagcgattgagtggcgaagacgacggcggcgttcttcttcctgagcgtcttcagccactcccggagctggccgccgaaggtcgggtcgtcgagcgcgagccaaccctcgtcgacaatgatcagcgtcgggcggccatcgagccgcccctcgacacggtggaagaggtaggcgaggacggcgggggccgcgccggtgccgatcagcccttcggtctcgaaggcctgcacgtcggcctcgcccagccgctcggcctcggcatcgagcagccggccccacggtccgccgacgcaatagggctggagcgcccgtttcaggtcattggactgcagcaggaccgacaagccggtgagggtgcgctcctcgaccggggctgacgacagcgacaccagcgccgaccagaggtgctccttgacctctggcgtgacggtcacgccctcacggccgagcacccccgcgagccagcccgccgcccatccacgctcgtcggaagagtggatctggctgaggggctgcaaggcgaccggctcggaggcgtcatcggagagcgcaccgccgaggtcgtgccaatcgccgcccatggcgagcgcggccgcgcggatgctgcccccgaagtcgaaggcgaacacctgcgcgcccgcgtagcgccggaactgcagcgccatcagcgcgagcagcacgctcttgccggcgccggtcgggccgatcaccagcgtgtggccgacatcgccgacgtggagcgagaagcggaacggcgtcgacccttccgtcttggcgaagaacagcggcgggccgctcagatgctcattccgttcccgccccgcccacaccgccgagagcgggatcatgtgggcgaggttgagcgtcgagatcggcggctggcggacattggcgtagaggtggcccggcaggctcccgagccaggcctcgatggcattgacgccctcgcggatcaccgtgaagtcgcggccctggaccaccttctcgacgaggcgcagcttctcgtccgcggtgcgggcgtcctcgtcccagacggtgaccgtggcggtgacgtagaccgcgccgacgaggtcggagccgagttcctgcagcgcctcgtcggcgtcgagcgccttgttggcggcgtcggtgtcgagcagcgtcgaggcctcgttggtcatcacctccttgaggatcgcgccgaccgactttctcttggcgaaccactgccggcgtatgcgggtcagcaccttcgtcgcgtccgtcttgtcgagacagatggcgcgggtcgaccagcggtacgaaaaggcgagccggttcaggtcgtcgaggatccccgggaaggtcgcggtcgggaaaccgacgaccgagagcgtgcgcaggtgatgaccgccgagccgcggttccaagcctccggcgagcggctcgtcggcgaggagcgcatcgaggtgcatcggcgtctccggaacgcgcacccgctggcgcttggtcgagacgcaggcgtgcaggtaggtgagcgtctcggcgtcggtgagccagcgcgcctcgggcacgaagccctcaatcaggtcgagcacgcggtcggtgcggtcgacgaagcccgtcaggtgctcgcgccagtcgagatgcgagccttggctccgaccctcgtaaagccagccttcggcgcgcgccgcgtcctcggccggcggtagccagacgaaggtgatgaagtaggaactctcgaagtgggcgccggcttcctcgaactgcgccttgcgctcggcatcgaccagcgccgacactgcatcggggaagcggctgtcgggatagcggtcggccggatggcgctgcgcctcgacgaataccgcccatccggagccgagccgccgcagcgcattgttgagtcgggccgaggccccgaccagctcggacgctgtcgccgagtccaaatccggaccacgaaaccgcgccgtgcgctggaagctcccgtccttgttgaggacaacgccgtcctcgaccagcgccccccagggcaggaagtcggggagcgcctgcggccgcttgcggtactcggcgagattcagcatggcctcagaccccgagatgcgcggggtagcgcaggtgccggcgcacgacgtcgacgaactgcgcgtcgcgcttggccgcccacaccgccgccacgtgcccgatcagccagatgacgatcccggcgatccacagccgcaggcccaggccgatcgcggcggcgagcgtgccgttagcgatcgcgaccgcccgcggcgcgccggcgagcaggatcggctcagtcagcgcccgatggacgggcgctgtgaagccgggcacgggatcggcggcggcctgcatcagacgagcgccccgccgccgaaggagaagaacgacaggaagaaggacgaggccgcgaacgcgatcgacaggccgaagacgatctgcaccagccgccggaagccgccgctggtatcgccgaaggcgagcgtcaggccggtcacgatgatgatgatcaccgcgatgatcttggccacggggccttcgatcgattccaggatcgattggagcggcgcttcccagggcatgttcgatccggcggcgtaggccggcgcggacaacgcggcgaccgccaggaacgaggcggcgccgagcaggcgatgacgaagacggggagtcatgcaaggtctcctgcgggggtgaggtcgtagtcgccggccgaggtcagcccttcgaccagcgtgagttctgagaggcggcgatcggcgccgcggcccgagagcacggcgatgacgtcgatggtctcggcaaccagcgcgcgcgggacggtgacgacggcttcctggatgagctgctcgaggcggcgcagcgcgccgagggcggagccggcgtgaatcgtcccgatgccgccgggatggccggtgccccaggccttaaggaggtcgagcgcctcactcccgcgcacctcgccgatcgggatgcggtctgggcgcaggcggagcgatgagcgcacgagatcggcgagcgagcagacgccgtccttggtgcgcaagctgacgaggttcggcgcggcgcattgcagctcgcgcgtgtcctcgatcaggaccacccggtcggatgtcttggcgacttccgccaggagcgcgttggtgagcgtggtcttgccggtggacgtgccgccggcgaccaggatgttcttgcgcgcgcccaccgccttgcgcagcacctcggcctgcccggcggacatgatgtcggcgtcgacgtagttgccgagcgtgaacaccgcgaccgcaggcttgcggatcgcgaaggtcggcgcctgaacgacgggcggcagcaggccctcgaagcgctcgcccgtctcgggcagttcggccgagacgcgcgggctgcctggatgaacctccgcgccgacatggtgagcgacgagccgcacgatgcgctcgccgtcggcggccgagagccgctcgccggtgtcggcgaggccggccgtaagccggtcgacccagagccggccgtcggggttgagcatcacctcgacaacagcgggctcctcgagccaggtggcgatcgacggcccgagcgcggtgcgcagcatcctggcgccgcgtgcgctggcttcagcacggatgatttgtgcggacacgtgcgcccccgtaacttgtggccgctcggatcgcggctcttcggaacggggacgattaagaagacgcggatctcacgccgggcaacagggaaatggaggcgtagtgccgtagcgtagaaaggcaggccgggtgcgaagccgacagtctcggaaaaagtcgtgtggagccgcccacgctttcgcgtcagggaatcggtcgcgaagctgccggcgaggccatgtgagctcggacagattcgatgtgcgctcgtgacatggagataagggacgagacgtcgtcgggggagaaagccgttgcgagggcgtgtaagccatgcgtctcgtaagaatggctgaggtgtcgtgctgcagccgcaagtcccggcacggctctgaagccggcccggtccgcggcggcgagagccttggttagactgtggcggatctcgacgcggttgcgttcatcgcttccgtcatggtgcaggacgacggccttcagcgacaattccagggcgcagcaagtcaggtgcagcacgggctccgtcatgtccgcacccgtacggccgcccgcgctggcggcgccgctcaggaattcctcggcgcgctccaggaagaccgctgaaagcgaacggtcgtcttcctgatccataggctgagttcagcttatccagcgggaagcgtcgggtcgccctcgacctctgtagagacctcgcggcggaatggcgaacccttcgccaaccgacgcccgagcgcctcgagaaaggcctcgtagcgctcgccgcccttggcgcgtgccgcttcctggtgcggctccggcaagctcggcatgacggtcagccagtggcgcacgaacagcgccagcgtctcgatcgtgatggtttgatcgcgctcgagccgctcgacggcgcgcgaaagcctgtccaggcgcgccgcgatggcggcctcctgccgttccgtctcgtccggcgtcacaaaagaggcgatcgccgcctcggcgacgagcgacagggagcggtcgcgacgctcggcataggcggcgagcgcccgcatgatctccggctcgagataaactgacagacggtgtttgcgcatgcccggctcctacagctcgatgccgtcaccggggtcgagcgcagcctgtcgcgccacggcgcggaagcggcgctgcaacgttcgagccctgaccgcctcgtcgtcgggttcgtcctcgccgtccttgtcgaatgcgaactcgcggcgcacctcggcatcctctggcgcgagcgccacctgctccggcaggtttggttcgcgccgcaggcccgcattgggctccgcctgatcttcgtcgcccgcccgctcggccgcgagcgcctgcgggggcgccgcgatcgggggtgcggcgctccaatcgtcgcgcccgggtggcggatctcctgtgaggtcggcgggtgtcggcgggcgcaggatgcggcgctgcagctgcggatcctcgaagtagcgggccttcttggcgcggatcggcggacagccggagacgagcaccagttcgtccgtcggcggcaactgcatgacctcgccgggggtgagcaatggtcgcgaggtctcctggcggctgaccatcaggtggccgagccagggcgacagccggtggccggcgtagttcttcatcgcccgcatctcggtcgcggtgccgagcgcgtcagacacacgcttggcggtgcgctcgtcgttggtgctgaaagcgacccgaacatggcagttgtcgaggatcgcattgttcggaccgtaggctttctcgatctggtttagcgactgggcgatcaagaagctcttcaggccgtagcccgccatgaacgcgagcgcgctttcgaagaagtcgagccgtcccagcgccggaaactcgtcgagcatgagcagcagccggtgccggcggcgcttgccctccagctcttccgtgagacggcggccgatctggttcaacaccaggcggaccagcggcttggtccgcgagatgtcgctcggcggcacgaccaggtagagcgtgaccgggcgatcgtcctcgacgaggtccgcgatgcgccagtcgcagcgccgcgtcacctgcgccaccaccgggtcccgatagaggcccaggaacgacatggcggtcgagagcacgccagaccgctcgttctcggacttgttcaggagctcgcgcgcggcgctggcgaccaccggatgcggactgtctccaaggtgcggcgtcgccatcatgatcttgagcgtcgactcgatcgggcgtttgggatcggagaggaaagtggcgacgccggcgagcgtcttgtctttctcggcgtagaggacgtggaggatggcgccgacaagcagcgcgtggcttgtcttctcccagtggttccggcgctcgatactcccctccgggtcgacgaggatgtcggcgatgttctggacgtcgcggacctcgcagtcgccgcggcggacctcgatcagcgggttgtaggccgcgcttgctgcgttggtcgggtcaaacaggagcacgcgcccgaaccgcgcgcgccagccagccgtgaggccccagttctcgcccttgatgtcgtggacgatggcggagcccggccaggtcaacagcgtcggtacgaccaagcccacgcccttaccgctccgggtcggggcgaagcagagcacatgctccgggccatcgtggcgaagatagtcgcggccgagccgaccgagcacggcgccgtcggggccgaggaggcccgccgcgcggacctcgcgctcgttggcccagcgcgccgaaccgtaggttgttacgtcctttgcttcgcgcgcccgccacaccgacatggcgatcgctaccgcgatcgtgacgaagccgcccgacccagcgatgatcgccccctcgacaaagatgtccggcgcgtaggcgtcgtaccaataccaccacaggaaaaatgacggcgggtgatagacgggccagccgccaagctcgaaccagggcggcccgagctgcggctggaagcccaaccgccaggccgtccactgcgtcgcgccccagacaaaggccagcgcgatcaggctgacggtgatgacctggccccaaaggatcttggtggcgtacacagccgctccccagctaacgatgatctcggagcagacagagttcgtgcggcggaccgcgcaagacccttcgagggggcgtcgcgcgaacggctaggcaatcgcgcagatgccgccccggcctcatccgatccccagcccccgcttccggccgaagctccagtcgacgcctccgcccgacagcgccacgcccgcgacctgctggccgagtcgcttctccagtggatcgctccacggtacgagctgaaaacccatgccgtcgtcgagcatcgcgaagcgaccagaggcaagggccacgcgccggcgcaccacgcccgcgacatgctcgccctcgcccgcgggctgatgggtaaggccggtctcggccgcgatccgcgccgccgccccgtcgagctcgcgccgccgaagcgtcgagagcaggtcgcgcgcgaacaccacctgccggccctgccgccgcgccaagccctcggtcgcgagatgatcggcccgccgttgcagcgcctcctccacttcccggccgaagccgctgtcggcccgcgccgccggcgcgcggcctacgagctggcggtcgagccaggtcgccccctccgctgtcacctgcgcctccaagctgaagtccgatcgcacggccaccagcagccgggggcgcttaccctcggctgcttcggtccagcgcgcctcgaccacggcgccgaccggcgcatcgctcgccgcgtccaagtcgggcagacggatgtggtgcgcgcgcccgtccacgccgtcgatcacaacgaacgccgagccggcgagttcgtcatcgagcccacgcgctgagagccgaccgagcacgggcgcccccgccgcggcgccgtcgagtacgaaggtggcggggctgcgctcgaagccctgatcccccatctctcggtgcaggcgcgcgataatgtcgccgcgaagctgcagctcgcgcaagctcgcttcggcggtgtcggggagctgccactgtgcggggccgagcggctcggcgatcccgagcgcctccagcttccgcatccgtcccaccttgagcccgtgcatctcgttgggccgttcgccgaaccggggccgaaggtcgacgacgccgttcaccgtctcgcgcgcgagctggcggtcgagcccggtccagcgctccgcctccacctcgcgctcctggccgcgccggatctcctgctcagtgcgcggccccagctcgagcgctgcccgctcggacgcgcgggcgcgtaggccctggccgatatagtcgcgcgagataacgaggttctggccgtcctcggcccgtcctcgcacgagtacatggacgtgcgggtgctcggtgttccagtgatcgaccgcgatccagtcgagctttgtcccgaggtcgcgctcggcggtcgccatcagatcgcgcgtgtaggcccgaaggtccgcgagctcaccggcgtcctccggcgagacgatgaagcggaagtggtgccggtcctcctcgcaccgcccggcgaacgccttgtgatcggcgtcgtcgctggcggcatcgaacatccggccgggcgagccatcgcgggtgacgccgtcgcgccggagatagttgaggtgcgcggtgagcggcgcgcgcttggcgccatgccgcaccacccgcgccttcacggtcaccagccgagcgtggcggccaagcccgctgcccgcccgcaggctggccgcccggccgcgtccgaacgcgctgcggccggcgcctgagcgcgagccccgttgcctaacgccgcccgccttctcggccgcggccagcgcttgcgtgatgaacggcttggtgcgcggcgcccgcgtcgagcggatgcgcccggggcggatgcgcagatcgtcgtcgcggctcatggtgcgatccggcgcgaggtgcggaattgcgagaatttccaggcgttgcggcgtttgcacaggctgcgggctcccggcgcacatcgtgccaagtgcttgttttgccgtgcctcgacccccgaccgaccgccgcgcacatcgcggcctttatcttgccatcggtcggtcggggtctccctcccagcctgcctccctgcccagcgtgcgatggactgcgacagaatgcgatgggtgcttgagcggctcatggatgcggctccggctgagatcgcggcacgaacaggccgccggagggggatgcaggctgcagttcattggcgctggcggtgcgctccgtctgcacggcggtggcggatggattggctgccggattgcgcgccgacggcgctccgagcgacgcagacctggctgtcagcgtggccatgaactgtgcttcctcagcggtgagcgcgccgcccggaacggcggccgtttgcaccgccgacggacccaggctgcccgcgcggctaacgaagatcggcgcagcgagcgggttcgtgacgcgagcgactggcgcgccggccgacatcggaaataccgcgccgccgatgaccggagcgatcatggcgacgtagttctgcgtctcccacggcagcggtcggcctcgtgtcagatagtcgtcgtagcgcccgggaccggcattgtaggcggcgagcatgccttcgaccgtgccgtagcggtcgtgcatctcccgcagatacgcagcgcctgccaggatgctctcgcgcggatcgtaggcgttcgcaccgaagccgtatcgggcacgcaactcggcccaggtctgcggcatgacctgcatcaggcccatcgcgcccttgtgcgacgtggcgctgggatccccggcgctctcgacgcgcatgacggcgcgaatccagctctccggcacgccgaagcggtgcgacgcctcggccacgaaggcggcgtaggaattgcccggcacggccctgaccggcggaggcgactcgacaacaggagcgccgggcgagacggtggacgatagcggcgagtaggcgacaggattgatcggctcggcactcgacggggcgaggccgaccaacagcatcagcgcggcggaggcgacggccgcgaacagcggcgagagcaagggcgagcgcatcctcagcgctcctcgtccgtccacacggggacggcgcgaccaataagggaagaggtcagcagcgccccgaaataccggccatcaagcgagtccggttcgttccagttgaggaggaacacctcgccgtcgcggagctggcggcagccgctccaggacggcagcacgcggcccagtcggtcgcgttcgcgcgcctgtgtccagaccacgccgtcgatgctgacggcggcaccgtcgcggcagatcgtctgacctggaagggcggcgatccgtttcagaagcggcgcgccgtagccgaggtagccgccgtcggcgagaaaggcggcaagcggctccggcggcttcaccacgacaagctcggtgagcttgggctgcccgagtggctgcaccgcgtagagccccaccggcacgctggccgaggcgttccagacgagctttggtggcggctcgatgaaggccgtgagcgccacgacggacgccgcgatatacgtcgtgacgaggaccttccatttgaactcgctcatgccgtcatctcccgtctgagcagccaggcgcgatgccgatcgcgcgcgtaagggcgcggctcttggccggcgctgatgcggttgtggacatgccgccaatggtccgggcacgcgtcctcgggcggcagcccaagcgcgtcgacggcgtcgaccgcggcgagcacggattgaaccttcggccagcccgagatgcgcagcaggacctcgccgccgggcgtcacgccagggacggtcgagcatggctcgccggggccgcaggcgcgcaggatgtcgacgcgggagacgagcgtgccgtagtcgttggacgcccagcgggcgaaggcgaagacgctgcccggcgcgaaggcgacgacgcgccggcggcggtccaggatttgttcgtgcgcgatccggccgaaccggatccagcgctcgatcttcccctcgatccagaggagctcgacgtgcgtgaggccgctcatcgcgcgctgccggcgtcgtcggggaactcgcgctcgagcagcgcgcgcagcatgtcggagacggtctggccgcgccggaacgcggtcaccttgatgcgcccgcgcagctccggcgtgacgtcgatcgtgagccgcgcggtgtaggcttcgaccgcggtgaccggcttgtccggcgcgcgaacccaggcatccggcgaggacggccgggaggcgaaggagcgcttggcgtcgcggccgctcatgacgccagcccgtcgatttcggccgccacggcggcgatctcctgcgccgcgatcagcccggccggcacctcgtggacgagccgtccggtgcgcgcggtgtctgcaaacgcgatgcgttggccgacacgactgccaagcaccggcgggtcatggtcggccagcgcctcggccgtctcgcgggcgatcaccgtgcgcgcagcgcagcggttgagcagcatgcgagcgcgcagctcggggcggaacacccgcgcctcgtcgagcaaccgaagcatctcggccgaggcccagccgtcaaacggcgacggctgcaccggcacgaggatcaggtcggcggcgagcagcgccgagcgcgcgatgccggtgacgcgcgggggcccgtcgatgacgacccgatcgtagccggcggcgatctccggcagctcgcggtgcagcgtctcgcgggcgaggccgagcacgccgaagggccgcggcaggccctcgcgggagcgctgctcggaccagtcgagcgccgagccttgcggatcggcgtcgacgacgagcacccgctttcccttgtcggcccaagcaccggcgagatgcagcgcaagcgtcgtcttcccgacgccgcccttctggttgaggagcgcgacaatcacggggcgcctcccgtgccggcgcggcgttttccaccgttgtggtcggccccaacaacaaagttagattctgagttagggaagttagagtccggccgatcggcgcgaagctctagtgaaagctgggatcccggcgagtccgcgtgcgcccgaagtcccgatagggatgcgcccgaagtcccgatatccgtgcgcccgaaatcccgatatgcgatctcgctcgtccccagcttatccacagccgcggcgagcggcatcggacgcatggcgatcagcgcccggccggtctcatcgtgctcgagggcgagcgcatagccggggagcggctggcgggcgacgatgcggcgcagatcgagcgcgaaatcggagaaccgcgcctggctggcgctcttggcgtgcaggtgtttgaggtcgaagcgccagccctccggctggcggccggcgtgcttcctggcaacgcggtagagccagcgctcgataccgccggtgagccggaagtaggccggatcgatggtgaggacgagccgccggtcgaggacgccctggtagaaccagtcggggagcacgaactccatgccctcgcaccggcccggggcggtcgtcagctcctcccactcgttgatccaggagaactgctggcggcgccactgctcgccgtggcggatcgtggtgcggatgacggtggattggagccgcgtcagcgcacctttgaggagctggtactcccggttgccggtcgcgcggccgatcgccgtgaggagctggtagggcgtgaagcggaagaagcgcgaggtgggcaggccgcgatcgagcgcctcgacgatgtgggagccggcccagatcaggatgtcggcgtcccagatggtggcgagcccgtgctcggggacggcatagacctggacctccgttccggatgctttgtagaggatgggcttcacgcgcttggccttggcgagggagaagaagggccgctccatgaggtcgcgctggtcgcgcggcggcacgtcgccggcgagcgcctcgaacgggtcgagcgtcgcccgctcgcttgcgtggaagcggctgcgcggcatcggagcagcgggcggtcagcggcgggcggcgtggccggcgtaggccggcgacacggcggcgtgccgcttggccgggcgcacctcgccgatgccgggatcggaggtggagcacttggctccctggtcggcccaggcctgcaggtcggtgatcgcgtagacgacgcggccgccgatcttgcggtaagtggggccggtgccgtaggtgcggtgcttctccaacgtgcggccactgaggccgaggaagcgcgccgcttcaggcgtcctgagatagcgcggcgggagaccggcgagcggatcgggcatgagctaacctccgtgtgctcgaaggcgacgcatggggtagcgcgtcgcatcgaggcgcacggtcgggcacgccagggccgttgctcagggtcgaagttaggagggcctaggagcgaccctgccgccgcttcagcgggcgcagcaggtcgcggtagccgccggcaatcagcttctcggcgtcgcgcagcagccggcgcacccagctccgcgcgtcgctctcggcccagtcggcgccgggctcgactccgagcatgatgcgcgcgatctcgcgccggctcatgccggctcgctggaggtcgagcgcccagagcatcaggccaaggcgcaacggatcatggcgcggccaggccagcggcgctggtggccggcgagaaaccggcgggtcggcggccagtcgccagaaccgcagcgccgcttccgtccgctcctgcccgtatccgtccggatggacgtagaagcccagcaccgtcccgagcggcgggaccgtgctgcgccggggcagccagaggcgcaaggagccggcgggcgcgccggtcgtgacgatgtggacgccgtcctcggcgatgagcagatgcttgcggccgggccagcgccagggatcgaagacaatgcggggcgcgtcagtccagggcggcggcggcgggatcaggcagacgacgtcgacgagccagtcgggtcgccagaagatcgcttcgacctcgtcagcccggagcgcagggtccggggcgaaaggtcaacccccatcgccccagcgggtcgcgcggcgccgaccagggcagccgactggacgagatcgtcgacttgggcggggagcggcgagtcgcgtcggtcggcgacgcagacgcagctgcgagcggaccggcaacctcgtcgcggaacttgggattgcggcgcaggaactcccaggcgaggccctggccgtcaaggtcgagcgagtagcggtaagcggccggaagccgccaagcctcttgggctctcattggcatctcccattcgtgtgcgcgcaaggcgcgcagtcatcccaagaggttgaaggaatgggaagattctaccagaccgggcttggccatacggccaatggttaatccggggatgcgcaaaaccgcagtgccgtatcggcggctttacggagaaccgctatgccggcgaagcccaactcccgccgtcagtggagtcgagcctctcgcagcaggtcggcgtagccgctctctgtcatccacctggcgcgcgtcaggtgcgtgtcgtaggcgcggcgcgcgcgagccggctcgcgtgcgggatcgatgcggagcacgagctggcacgcctcctcccaagtcgcggtcgggtcttccagcgagtcgagcaggcgcatgtaggtgacgacgtgcagccggtcgtagtcggtcagcgcagaaacggtcggcgcttcatcttgaatatcgggttccaattcggccttgatccgcatcgtccctcctttccgagccggcctcggccgctcattcattggagacagatctttcacgagggccggcagcggcccgcatacgccggtgacgaaagattcaccaaaacaactctcggcattcaacctgatcttcctgacggcactgcgacgcaaggagcatcagcggtgagcgcgggacagaccttatgaactataggtaataaactcaatcggcgccgctggccaaggctgaccgcatggacatgcggcggttggtcgggcggaacgtcaggagggcaaggcaggcgaaggggctcacccaggagcagctcgccgagggcgccggattctctcagaagtatgtgagcgatctggagcgagggctcgagaacccgaccgtcatcaccctgttcgagctcgcgcagcgcctcgatacgacgccggtcgcgctgatcacgccggacgaggaagcgatccgggaaaccgggaaggcgaacggtcttcggaccaaatagcgaggttgcggctgctccgcatgcagcgctacggtgttatagtgtaacatccggagatcaggcgtgagcgactcggcggctgccatcatccacgattcggatacttgggacgcgacggccgcagactatgaggcgctggccgagccgttcacgcggcagtacgccgagaaagcgctggagctggctggcggcgtgggtcccggcgagcgcgtgctcgacgtggcggccggcaccggcgcgctgacgctcgcggcggcccgcgccggggcgcgggtgctcgcgaccgacttctcgcccggcatggtcgcacggctcggggagcggctgcggagcgagggcttcgatcgcgccggctgcgaggcgcgggtgatggacggtcaggcgcttgagctgccggacggcggcttcgacgcggcgttctcgatgttcggcgtcatgctgttccctgaccaccgcaagggacttgccgagctcgcccgggtgctgcggcccggagggcgagcggccgtggccgtctggacccgtaaggaaggcgcgggtccggcgctcgtgctggtggacgcgttccggtcggcgtttccggaccgcgaggcgccgtcattcccggcgcccgggatgaggcggcttatgcacgccgacgcgctggcggaagacatgcgcgaggcgggcctgcgcgaggtgacggtcacgaccgtcactggggcgtggaccgcgccctcggccgaatgggtggcggacaacgtcgaccggctctaccgtcagttcccgctttatgccgcgctcggcgaaggcgagcgccggcaggtgcgcgaggcgatccgcgagcgcctcggccgcacgagcgcaggcgaggtgcggatcgagtccgacgcccatgtgggcgttggccaccgctgactctctctgcaagcgaccatcaagcgcgcgaacgccccgcccgggtatcgggcggggcgtcctggccctccggctcagtcgccgcggcggccgttcgggcgggaccagatgaggctgtggctcttgccgtcctcgtcctcgaagaggttggcgtagatgggggcggtgaagctcgggtcgtcgagcttgaggccgaggtagtcgcggccctcgttcgagcgcttctcccaggcggccccgatctcggcgcggccgacgaagacccggtgcgagggggcgttctcgttggtccggttctgttcggggacgatgcggacgttcttggcctgaaccgagagggtgacgatctcgccggtgaactcgttgccggacttcttgaaggtgccgatggtcgccatggtagtctcctgtttcgctgtctcgagcccgcgcccatcgcggcctcgatggcggtcgcccggccgggggcggtcgacgacgcagccttcaggcccgcagcagagcggaggacggcggcagagcgactttcttgcctcgcgaggaatgagcgaagctcaggggaagaaagtcgagcggccgccgttgcggctcaggcgaccgaggcaaagccggccctcggccagaccaggccattgaagaggcggcgtgggacgcggcacctgaacagcgcttccacaggagacgtggcgggcattggctccttgcctcaagaggtcgcagacgatcgtagcgtgatcggcggctccggcgtgcagaccggcgggtgcattccctgcaactctggactggacggaacgcctccgacgcggtccgctcgcggaactgctgccgagtcgccgcgcctgcatcaagcgctacgagggcaggagcttctctgagaccaagcgctcccaaacgtcacctcacccctatgccgatcgcgagccgaagcggaccgatcaagccgtccggtcctgccacggcaggtcagcggcacccgaaggtggccgatgctccgcccgatacccgggcgggtcgctcgcgcgcgggccgccgggtcagcagtggcgataccgggcacggccctttgcgtccctcagcggaaatcccgtgagcgcacctgaatggcagccggcgccgtgggatcggggatacagacgtcgcgcggcttcatcgtcggaagcttgggcgagcgtgggtccgggcctgctccgccgccccggatctcgtcgccgcggccgtgcggaaccgccagcccgtcgtcgccggctccgatcatcctcagcatgtcggtgaagtcgtaaagctgctcggcgatgacgtggatgacctcgccgtccttctgcacgcggccggtgcagccgatcatctcggccgagcgcactaggcgctcctcgcgctcgaagagcttcggccagacgataagctgggcgtaggccgtctcgtccttcaacgtcacgaacacgacgcctttggcgctgcccggcatctgccggaagcgcacgatcccggcgacggtgacgcgccgcccgtcgcgggcgcgcttcagcgcggccgcgggcaggatgttcatggcgtcgagctccgggcgcaggaaggcgaccggatgctggcgcagggtgaggccgagattgcggtagtcctcgaccacctcctcgccggcggtgagcggcacgagcgtcaccgccgcctcttcgatctccgggcggatgagcccgtcgcggaggtcggccaccgcgaacagcggcagcggctcgcccttcaggcccttcgcggcccaggccgtctggcgacgatcgaggtcgaaggactgaaaagcgtcggcgtcggccagccgtttcatagcggcggccgacacgccggagcgcagccacacctcctccacgctcgcgaacggtgcgggcccgcgcgcggcgacgatgcgggccgcatcggcatcgcgcaggcccttcacgagccgcatccctaaccggacggcgaagccgccggtgctgctcgggcacggctccagcgtgcagtcccagcgcgaatggttggcgtcgaccgggcgcacctcgacgccgtgccggcgcgcatcgtccacgaggtcgtcgaccgagtagaagcccatcggctgggcgttgatgatcgaggccaggaaggcgtccgggtgatggtgctttgcccagctcgacgcataggcgatgatcgcgaaggaggcgctgtgagactcggggaagccgtagctcccgaagcccttgatcatgttgaacatgccttgggcgaagtcgcgcgggtagttgttggcgaccatgccttccacgaagtcggcctcgaaatggctgaccccgcccgtgtatttgaaggtggccatgctgcgccggagctcgtccgccttcgaggcggagaagccggcgcatcggatgctgagcgccatcgcgtgttcttgaaacaagggcacgccgtgcgtccggccgagcacctcttcgagctcgggcgtgaggaaggtgtaggtctcgatcccgagccggcgccggatgaacggatgcaccatctggccctggatggggccgggccggatcagcgcgatcgagatgacaatgtcataccattcgcgcgggcgcagcttcgggagcatggcctgttgggctctcgattcgatctgaaagacgccgatcgtctcggcccggcagatcatgtcgtagacggccgcgtcctcggccgggacggtggcgagatcgtagtcgaggcccttgtggctgcgtagcagctcgaagaagcggtgcatgcagccgagcatcccgagccccaggatgtcgaccttcatcatcctcaaggcgtcgatgtcgtccttgtcccattcgatgacggcgcgcttctccatgcgcgccggctcgatcgggacgatctcgtccaggcgatcctcggtgagcacgaagccgcccggatgctgcgagaggtgccggggcacgcccatcaggtgacggtggagccgcagcgccagcttcacccggtagtcaccgaggttcaggttgacctcgcgggcgtgcttctcggtcacgccctcgctcgaccaggaccagacgagccgggtgagctggaggatgacgtcgcgcgggaagcccagcgccttgccgacgtcggccatggcgccgcgcgagcggtagcggacgacggtggaggtgagcgcagcccggtcgcgcccgtagcgctcgtagatccattggatgacttcctcgcggcgatcgctgtcgaaatcgacgtcgatgtccggcggctcggccctgttgcggctgacgaagcgctcgaagaggacattgtttctcgctgggtcgatcgacgtgatgcggaggcagaagcacaccgcgctgttggccgcgctcccccggccctggcacaggatgtcctggcttcgtgcgaaggcgacgatggagcgcaccgtgaggaagtaaggcgcgtaagcgagctcctcgatcagcgcgagctcgtggcggatctgctttgcgaccttctcggccacgccgtcgggatagcgctcggccgcgccctcccaggtgagcttctcgagcgcctgctgcggcgtgaggccggggatcaacgcctccgtcgggtactggtacttgatctcggcgagcgagaagcggcagcggtccacaacctccaacgtccgcgcgacggcctcgggatgctccttgaagagccgcgccatctccgccgggcttttcaggaagcggtcggcgtggcgctcgcgcctgtagccgagcgcgtcgaccgtgcatttctcgcgcacggccgtgaccacgtcctgcaggatgcggcgctcctcggcgtggaacagcacgtcgttcgtcacgatcgtcggcacgcgcgctcgcgccgcgaggccggcgagcgcgtggagccgcagcgcctcgtccggccggaaccgcggcgtgagcgccagatacgcccggttcccgaatgccgcccgcagccgcgagaggttcgcggccagctcgtcgccgggctcgccggccagcagcacggcgaggagccccgccccgtgctccgccacgtccgcccacgccagccggcacttgcccttcccggcccggcccttgcccagcgtcagcagccggcagagccggccataggccgcgcgatcggtgggatagacgaggagcgacgtgccgccggcgaggtcgaggcggcagccgacgacgagccggacgccggtggtcttggccgcctcatggcagcggacgatgccggcgaggctgttgcggtcagcgacgccgagcgccggcaggccgagcaaggcggcggtcgcgaacagttcctcgggactcgaggccccgcgcaggaagctgtagtgcgtcgtcacctggagctcggcataggccatcagccaaacaccccgtggatgaaccagcgcacgccggcgttgctgcgcccgtcgcggaatagccagaagcggccgccctcctcgtcctcgatccggtagtagtcgcgggtgccgcggatctcggaaggctgccgccaccattcgagatggatgcgctccgggccgtcggcgcgccggacgcgataggcgcggccgcgccagacgaagcgggccggcggatcgtccggcaggagcgccaccgtttgcacgggctcgggcgcgaacagccagaacgggcgcggcagggccggccaggcggtgtcggccgcgacgctcagcggatcgatgcggcgcaccgtccgctcgggcaggtcgctttcgacgggggccgcgccatagacccgcgcgacttgcggcaggttggcgagccggtcgaccagctcggcgaggtcgccgctcaggccggcaccctcgcccagttcggccagggcggactggcgcgccccgagcggctcggtcagcgaggcgaccagcatcatggcctccacgccccagccggggtccacctcctccagccggtcggtgaagagccgcgcgaggtggcgcgggtcgcgcgagggccgcgccgtcccaacccgcagcgcgagcgtgacgcgatcgacgcgctcgaacaggaggtcgagcgaacgcgcgccgtagccgcgccgttcgaggtcggtgcacaggtcccccgcgaggcgctcggccgccccggcaagcgcctcggcgctgccgatcggctcggcaaaggcgcaccggcggcgcggggcctcttccgggaacagcggcgtgatcgcctcgaaggcgcccccgagcgcctgatcgaggcggcggccgagctcggggccgaagcgcaaggtgagcggcgcgcgcggctcgccgtaaagctggcccacgcgcttgaagccgaagcgatggagatcgccggccacctcaggctccagccgtagcgcggcgacgggcagacgcgccagcgtctcggccgtccggcccggcgcgaccacgctgacgggctcaccgccgaagcgcgcgacggcatgcgccgcgcccggcgtgtcggcgatggccgcgcgcacggtgattccggcccgctccagcgtaccggtgattcgcgccagcatgggctcctcgcccccgaagagattcgcgcagccggtcgcatcgatgaggatgccgtccggcgggtcgggcgcggcgatcggcgaccagcgccgggcggcccacatggcgagctggcgcaagccggcggcgtccgcgtccggatcggcgtcggcgacctccagcccggcgacgagcgcgttagcgtgggcgatcgacatgcccggacggagcccggcggaacgcgcggcagcgcaggcgcccgcgaccacccggcgcgcgccgtcccgcgcggcggtgacgaacggcctaccgggcggcagcgcggtgccgttcgtccgccgaagccgatcggtcggccacgtcggaaggaacagcgagacgaccctgcacatcgcagccctccatgatccagtcggcggcctccccgccgcggcagcgggtgagctcgacccgccagcgcggccggccgactccggcgaccggcagcggcgtcgagggcagcgccgtcagccgccagcggctcgccgcagccgtcgggtcggtgacggccgccccggcccagcgcctgagcgccagcgcgacgacgccggaagcctcggcggcgagttgcaggcggcgcgcctcggtcaaggaaagcttgcggacctcgccgacgacgccggcgaggccgcggtggcgcaggccctcctccatgacgaggagcacgcttgagtcacccccgtgcgtctcggcgaacaggaggcgctcgggcttcaggccgaccgccgacagcgccggcgcgaacaggtcgcggcggctgagacaccacagcaccggcccgttgaggcgtgccaggatgccgccgacgaacaggccggcggcggcggcgtgcgtcagctcgggtccggacgggccgacctcgtgaagggcgccgagcgccaggccgccgtccggcaagcgcccgtcgatggcgggcgccccgaacggcaggacggcgcggcgggtccgccccgaacgctcgacgcgcgcgatctgcgcgcgcaagtcgtccagaacgcgggtgtgccgcggatgcgccatggtcctccaacggctgcgagccgatccatgttcctgttatgttctattgttcgccgcagagtcaatccgccgcaccgggaagctgcggattagctaagggtggcaagttgggattgcggggaagccactcggtgtctcgggaggtgcaattcaccctgcgcgagaggcaccccgacctgaccggatgggtactgccgagttcattactcaggtgaatgcaaccgcttgggcggagcggtattggtccggcgacaagcaattgacgatcgctgatacaatgccccgcttttacttcgacgttcgcgaccgtcgcagcagcacgatcgatgatgatggagtcgatatgccggatgccgaggcggcctgcgcgcaagccgccgtcgccgcggctgaaatgctcaagagcctggttccctgcgacgcgacggagttgttcgtggcggtgcgcgacgagcgtggccaaagggtgggtgaggtcacggccgaggtgcgcgtcacccagcacgcttagggatcaaggccggcgctgcgcccggtcgcggcgccgcagattactcggctggagcgggcagccgcagcggctccggagggggttgcggcggaactccgccaggcgctgagcgcgcctgtactgagaggtccgtgaacagggtcagacgcgccgccgcggtgaacccgactatcgccgctccgattacggcgaacacctgccgccacgtctcggacgggatgccgatggccgagaggccgaggatggcgtgatagccggcaacggccgccggtgcggcgaaggccaccgcgagcgccaggcgcacgacgggcgagcggatggtgctgaaaaggatttggccgccaacgagcgtggcgacacccgcgatgaggccgaccgctaaggagccgaggacgccggcgcctgtgccgtaggcccacatgccggcggtcacggcggcgaagaacggcagcgcgtagacggcgagcgtgaacagcagccagcagatgaagccgaggcccaggatggtcagcacgacggcgagaaacatggcgtcctccatgacgaatggatcatcggacgcgcttcccacctcctccacggcgcgtcggcagcaatagcagatgagaggccggcccggaatccggtttcggaagtccgggccgaccggcggatgacccgttcaggcggcgaacgggtcatattcggtcacgatcgtgtcgggatcgccgtcgaactcggctgacgggcagacgctgaagaggccgttgccggccttgaagagggtgacgcaggccatcagggtggtagcgaggtcccaggcgagctgctgggcgaggctgaggttgtcggacatcggtcggctcctgtcttcggagcggggaccgtccccgctcgacaggcgcccgatgtgtccggcggctggccgcaatcaccgcgaaggcgaagccgccgcggccgcacgcgacagcgtaagcggacccttcacgggttgatggcgtcaggccaggcgccggaccaaggatagcgcctcaaagagcggggtggccgccctccgaggagtgccgacgctcaagcaacctgctccacgcgcaggcttccggcagcaagcggccgcagcagctccctggccgggaccttgggatcgagccagcgcgtccagtcggcccggtgaagcaccacgatttgccggttgtggtagggcgcgacgtcgggaccgggctccgtggtcagcatggtgaaggcctcgccgacgtcggtgctgcgccagatgccggcgatgcagaaccagggctcgtcggccttggtgaagagccacttgtgcttccgcttggccttgcggtcctctggggccgtgaactcgtagaagccgtcggcgatgatcaggcagcggccgttcatgaactcccggccatcggacctgaagttgtagaccggctgtttgttcggccccggccagctccagcggcgctggacgaggtcggccgtcccgggctcgtcgggcgcggccctgacgatcgctccgatgtcggtgatcttgatgccgtcccgcggctccaggtttgggatgccttccgggaaacggatccggactttgatgtcgctgaagtcctgccggatcgtgtccaggtcgacgcggctgcggtagtcattgcacatgagaggcccaatattcggtgctgggttgcgtatatactgagttcgatgcgtcggcagcttagcttatggggagactggacacgaaacaggcccggcgagcctgcgccggtcattcggcggacgggcgacgacatcgagctcgtcgagctccattggggcctgaagccgaggagcccggaggatcgtccggcgatcaatatccgctcggaggggcggcatttcccgagccatcgctgccttgtgcccgcctcggagttcttcttctccacgggttccggtgcgcggcgcacccggtggaagttcagcctggcggatggcgactccttctattttgcgggcatctggtggccggcgtcggaggactggccggagtcctacgccgtcctcacgatcgcggccaatccggacgtggctccctacaacggccgacagatggccgtgatccgccgtgaggatcggatggcgtggctcgacctgacgatccccgaggaggagttgcttcgaccgctccgagctgggagtttccgggtgcagcgagagcggtagacggcgctcacgcgccgcctcccttgcggaagtcgaagagcggaatgccgagcttgcgcgccttgtcggccaggttgtccgagatgccggagcccgggaagacgacgacgccgatcggcatgacctcgaggagctggtcgttgcgcttgaagggcgccgccttctggtgcttggcccagtcgggcttgaaggcgacctgcacgaccttgcgattgtcggcccagcaggcggcgatgcgctcggcgcctttcggcgatccgccatgcaggaggaccatgccggggtgcctggcatgcacccggtcgagcgcggcccagatcgcctggtggtcgttgaagtcgagcccgccggtgaaggcaaccttcggccctgagggcagcatcacctcggtgtcggcccgcctgcgggcggcaatgaagtcgcggctgtcgatcatcgcggcggtcaggttgcgtcggttgaccatcgagccggtgtggggacgccacatcgatccggtgtgggtctcgaagaggtcggcggcctggtcgcgcatgagctcgaaggcgttgcggcgttcgatcagcgtcaggccctcggcgagcagccgttccagctcgaccgatttcacctccgagccgtcctgctcgcgctgtgagcgcttctgcgcctgctcgttgtcgtcgagctcgcgctcgatgcggtcggtcgtgcggtggaagaggttgaccgtggaccagaggaggtcgtcgaggtcgggttcgaggcgcgtgtcggcgagtgtcgagaccagggcatcgaagatgtcggccagcgcgccgcgaacgacaggctcctcggggagcggccgggggtcgggctcgtcctggaagggacgatgtccgtagagctggagttcggagagaagcgaggaggtcggggattcggcgtgtgcgggctcgtcgtcggaaaggtggtcggtcgtcatggtcgggtcctctcgtcgggtggccgcgcccatcgcggccttcgcaggcgacgaagaccgggggcggaacgggactgcaccgccgggcaaagcccgagcggccgcagcgcagcgaaggacggcgaaggccaagtttgttgtcgcgcgaggaggcgccggcacggcgccggggaagaaacttggccgcagccgttgccggcccgggccgcttccggtccgatcgccctctcagaaggccgtgggcggggctctctcccgacgctcggaccctgccgcaaccgaaccgcccgtgaccggagacgccgggcctaccgccttttcccggtctcctgccgcaatgaaggcggcgaggaagcggtccacgtccgccggggcgagctgcacccggagcgccgcggcgagcgccccggcgcccaaggtgcgcaggtcttcgttgaagtcccccagggccggcgtcagcgtcagcgcctcgatgccggccgcctccgcccgttcggtcaatcgtgccgtcgcccggtgaccggccggatcgtcgtcgcgagcgatgtagagccggcgcaacgtcgaagggagcaacaaggcggcgaggtgattggccgagagcgccgcggccattggcagctcgggcatgacctgccgcagcgacagcatcgtctcgatgccctcgccggccgccatgatgtcgagagccgtgccgaagcggacggcatgaccgagaaggtcgcccatcgctttccgctgcgtggcgaccggcgccttgtcgcgcgtggtcgggtcgagccaggtgcggtggacgccggtgagcgtgccgtcgagatcgcggaccgaggcgattagcgccggccaagtctccgtcggcccctcgtcgtcggcccggtagtagcaacgcggatggaagcggagcgcgccgacgttgcgcagatccataatgccgcgactacgcaaatacgcttctgcgagcgtgccggcgatcgactgcgagatcgcccacagccggcgtgcggcctccggcgatccttgcggtgcaggaccgacccgttgtgcctcgcgaaccgggcggggcaaggacaggaaccggcgcgcctcgtccagagtgtccttcaagctgtcgaggtcctggctgagggcgatcaggtcgaggaggtcgccatgttcgccggtggcggcatcggtccacttgcccgctgcgcccttgcccgaggtcgggcccgtcaggcgcacgaacaggctgcggcccggcgtgttgaacacgtcgccgacgagccaatagcggccctccttgcggccgttggaaagatagtggcggcacaccgcctcggcgtggtgcgcgaggcggtgggccaggtcggcggcggggctcagcatcatcggcccctcctcacgccgccgcccgcgcggcgacccgcgcgagcgggtgccggtcgagcaaggctgccaggatcgccggaccctgtgcgccggtcggcacgaacagccgcagcttccaggcgatgatctcggagacgagccccgtcgccttcagccgatcgaccatgccatcgctgaagccggcgagctcgacgcgcgtggcgttcatcacggtggcgcggcggacggtcagcccgtcggcaaggtggagcgtcgcgccgtcggcgagcaccgcggtccaggcatcgcccgccgtcatcgtgggcgcattcgagccgatcgcctgtgccacccacgctggcgacacctgacggccaatgatccgctcgccctcgtcggtctggaggcggtaaacccggcagccctcgtcgggcagccgccgccagatcggcagcagcaggccggtcacgacatacatcgtgcttgtcgtgaactccggcagctcggcgagctcggattcccaggcccgcgcgaaggcggcctcgtccgcctcctcccaggaggtcgccggcagcatggcggcggcgagcgacgtgcgctccatcgggcgcacgaggcggatgcggcgctccacctcgccatcgtcgagcacgaggctcggcgccgggacctgcacggccgcgcggtgtgacttggcgttgaccagcaaccggcagccgcgctcgcggccgcggtccagcgcctcggagagcgtcaacggttcgttccggtcgcgacgcgcgatcgtgaacacctgcgtctcggcgccggtgcccggatgcgtgtagatcgtcctccgctcggcgacggtcaggctctcggccgtgatcgtctcgacgccgcggtcgtaggttccggacgcgatcgcgccctcgatcttggcgcgcagcagcccctcgaacacctcgaacaaggtgttctgcaggtcgatggtgagcgcgagcagccgattgaggaactgcgtgatcggcggaagttcctccttcagcgagccgtcgcggtcggtgagcgaaagtccggtcgcgtcctcgaaccgcccgagcgagcaaccctcgaccttgccggcgtagagcagcatgtagagctggcgcagcgccgcccgcgcgtagacgctctccagattgtcgtcggcgcggaacagcccctggccgccggtctggcgctggccgcgggtgatcgcgcccaaggtgtcgagccgccgcgcgatggtggagaggaagcgcttctccgccttcacgtcggtcgcgatcggccggaagagcggcggctgggcctggttggtgcgattagtgcgcccgagcccctggatcgcggcgtcggccttccacccggcctcgagcaggtagtggacgcgcagccgccggttcttcgctccgagatcggcgtgatagctgcggcccgtgccgccggcgtccgagaagatcaggatgcgcttgtcgtcgtcctggaaggccgaggtctcggcgagattggccgaaccggcccggctctcgacggcgagacgcatctcaccgtccgacccgatcttgcggacgatgcgccgcgagcgtcccgtcacctcggcgacgtgctcggtcccgaagcgctgcacgatctgatcgagcgcgccctgcacgggcggcagcgcggcgagccgctcgatcatgcggtcgcggcgctcgacggcctcgcggcactggaccggctggccgtcccggaagacaggccgggacgagaggttgccctcgccgtcggtgaactcctcgaagagctgcgtcgggaaggagtgcgcgagatagtcgaggacgtactcgcgcggcgtgatgtcgacggagacgtcgccccactcctcggtcgggatctcggccaggcggcgctccatcagcgcctcgccggtcgagacgatctggacaacgcaggcgtgtccagcctcaaggtcccgctcgatcgagcggatcaaggtcggcgtcttgatcgccgtgatcaggtgattgaagaagcgctgcttggcgctctcgaaggccgagcgcgccgccgacttcgcctgccggttcagcgtgccttccgcgccggtgatgttcgccgcttccatggcggccgagaggttgttgtggatgacctcgaaggcgccggcataggcgtcgtagatgcgggtctgctcgggcgtcagctcgtgctcgaccagctcgtattcgacgccttcgtaggagagcgagcgcgccgtgtagagcccgaggctcttgaggtcgcgggcgagcacctccatcgcggcgacgccgccggcctcgatcgcctgcacgaactcaggccgcgtagcgaaggggaagtcctcgccgccccagagcccgaggcgctgggcataagccaggttgtgaacggtggtggcgcccgtcgccgagacgtagagcacgcgcgcgttcggcagcgcgtgctgaaggcgcagcccggcccggccctgctgcgagggcgcctggtcgccgcgctcgcccttgccgccggcggcgttctgcatggcgtggctctcgtcgaagacgatcactccgtcgaagtcggagcccaaccagtcgacgatctggcggacgcgcgaaaccttctcctcgcgcgcatcggaccgcagcgtggcgtaggtggtgaaaaggacgccttgctccagacggatgggcgtgccctggcggaagcgcgacagcggcgtgatgagcaatcgctcctggccgagcgccgaccagtcgcgctgcgcgtcctcgatcagcgtgtcgctcttcgagacccagagcgcgcggcggcggcccttcagccagttgtcgagaatgatgccggcgacctggcggcccttccccgcgccggtgccgtcaccgagcatgaacccgcgccggaagcggatcgcgccctctgcgtcgtccgcggcggccgagacctgatcgaaggtctcatcgaccgtccacgacccggcgagatggccggaatgcgcctcgccggcgtagatgacggtctcgagctgggcgtccgagagcaatccgtccgccacaaggccggtcggcaagtgaggccggtagctcggcttcggcggcgcgaccgaggccatcgcggccgactggaccagcggcgtcggatgcggctgcgcgcccgggatgcggatcgactggagagcgtagctctcataaagcgcctcgctgatcggccgcccctcggccggtgcccagtcgcaggtctcgtactcgagctcgacggcgtcggccgccgcgggtgcgagcggacgcgccgcaggcgcgcgcaggcgcaaagccggagatgcggccttgcggaaagccgggagtgcgcctgcccggcttggcgggaccgccgcgcggggcggaacctgctcggcgacccatccaagcaaggtggcggcgtccggcgccatgccgggcgaggccgggaaggagcaaggatcggcggccggcacgcggtcgatgacggtgagccgcgtctcggtcgtggtgccgtgccgcgcgtagacgcgcccctcgatcgccgccgtgaaccggatcgtcccgcgctcctgcagccgcacgaaggcgtcacgccaggccgggctctcgggcgagaggttcgcgccggtgatggcgacgaggcgaccgcccgcggcgagacgggccagcgcggaaacgacatggcggaacgcggcgtcggcgacgcgaccctcgacatgcgccccggccgagaagggcgggttcatcaggacgacggtcggccggatgtcactatcgagcaggtcgtggatgtgcgccgcgtcgtgacgggtgactggcgcgtccgggaacagctgatcgagcagcccggcccgggtctcggcgagctcgttgaggacgagcggcgcaccggcgagctcggcgaagacggcgaggaggccggtgccggccgagggctccagcacgaggtcgtcgggcgcgatcccggcagcgagggttgcaacgaagccgagcgcggtcggcgtcgagaactgctggagcgcctggctctcctccgagcggcgcgtctgcgacggcaacagcgccgcgaccttcgccagcatggcgagctgcgccgccgccgttcgggcgcgcatggccggaccgaacttgcggagaaagaggagctgcgcgacctcgcacgcctcgtaggcgtccttccagctccaaaagccttccgcgtcggaaccgccgaaggcggcctccatcgcagcgcgcagcgcgcgggcgtcgaccgcctcgccgcgggcaaggacgggcaagagccgctcgccggcccggaacagcgcggcggcacggtcggcgggggatgacgcaggcggaagcaacggcgcgaccggagccgccgccgacgaggagatcggggtcatgagctgagctttcggagagcgggaggggagcggccggacgcggcgctctctcgaccccgcccggctcaaccccgtcccggccgacctctccctctctgacgcccccaagagaaaaggcccgacgcggggacgcgccgggcctggaggtggacggaacggctgcgctcaggcgcgcggagcgtcgacgagccggtattcccgccgtttcacgttcgggatgcggtagagcccgccgcgttcgggatcccggaacagcacggtgcgatggctgcgccggttcttcacgacctcgagccggtcgaagctgcggccgtccgcgaaggcgaccggctcctcgaacacgatcgtctgcccgggccggggcgtcggcttggcagcgagtgcctgacgcgccgccgcgttttggcggcagcgggcacgccacttcacggcaaagggccgatcggtcggcgtcaggaggtcgaggatcgactccgggcagtcggcctcgcaaggccccatgccctcgtccatatccttgtagccgaaaatatagccctcgcggtcgcgcgggttgtagcggacgaggcatacggcggcgaaaacctcgcgctgtccgctgtccgtccggatgtgctcgatggcggcatagtagacgcgcatgccgacgagcgccgatttgagcacggtcgagcgatggtcgggacgctcataggtgaactgagcgtcgagatattggcgcgggccggaatggccctggagggactgcatgtagagccagcccatggcgtggttcctttctcatggtcgtgaaatgctaagagcccggcgcgacggccgggctcttcgagggtggttgggtgatgagaggtcaggcggcggaggccgccgtcgccgcgaacgggtcgacgtcgcggtggatcggctgggcgcggcccatccagggttcggcccggatgcagcgcacccagtcggcgaagctcgggatgaagccgagatcctcgcgcacatgctgttcgccgatcagccgcaccggcacgacgcggccggtcgagattgtgatggtcgcgccgaagaagcgctccagcatgaagatgccttcggcatggtgccggagcgcccggtggcggaagtcggccgtgatcgccttcgactcgtcgaaccactggtgcagggcgaggtagtcttcggccgtcccgccccatttcctcgccgaggagagcgcgtggtgatagcaatgtcccatcgcgccctcctcagaactcgtgctcggaatattcggtgtcgatgaagcgctcgttgtattcgagcgtgatggtccgggcggcgacgtcgaaggtgaattcgccataggcgccctcgttgtcctcccaaccgccgtgcgtctgttcgagaaatcggtaggccatctcctcgatcgccccgtggaccgggagcctctgccgctccggctcggtgccttcccacggcgccttggcgatctcgatcgcatcggcgggcagagcgacgtcgttgttgtgcgcgtcgcgcgcctcgacggactcgatctggccagagtcgccgcaaccgtcgaaggtcacgaggacgatgacgatgccggcggcttcgagcgcgccgaacagtgcggccttgttggccgggagcagctccgccgcgaggcggtcacgctcggcttcccgagcgaggtaggcggagtaatcggggctgatggtcggggcggacgcagccgcctgagtggtgtcggtcatgtgttatctccagaaatgacgaagcccggcgcgtggccgggctcgcggggttggtcggtgcggtggtggtcagtagccgaagcgccagctcggccagtcctggccgttgtcggacgcggcgagcgcctgatcgaggtaagccgggtcgccctcgacgaccttcgggtcggtgacaggcgtctcgtcgatcacgacgaccctggtcaccgtgtcgtcctccacctcgacatggaccgggacgagataggagaagacgacccgttgcggctcggccgacgcagttccccctcggcccggtcttgatggctcgtccgggtgctcaaacacgggtagatcgagcagcggttcaaggtcggcgtcgaagagcacccaagcggcgtcgctcgcatgcgcttcgcgcagcacggcgagaagcgacgcgggcaggccctcggtttctccatcctcaacgatgccggtgtgaacccagcagccgtaagagtgcggctcgacgatgaggccatgccaggggtcctcgggatcgtagcgcgagccgcctggccggccggggccggtctcggcgaggtggaggagcttggcataggtctcgggctcgagatgcagcaccgagacctcgccgtaacggcgggtatccatggaatgtctcctttggaagagaagctgccggggcgcgatgggcgcaccccggcagacgacgctcactcggcggcgatcgcgtggaccggatcggactcctcgccctgagcggacccatcctcgtcatcggtgaggaaggccggcagctcggcggcatcggcctcgggctgctcggcttcgacggactgctccggaccgccgggcgtgcgcagcggctcgggcacccagtccgtgtcggcgaggagccgttcggcctccttcgccatgtcgcccttcttcaggtggtcgatgagctgcgcggcctgctcacccttcgcctcgcgcaccgcctccaggatccggcccttggtgacgcggccgagatagttctcgaccgtcggcgtccagccggcctcggccatgtcgaggttgaccgcccgggcgagccggtcggcttggcgcatgcggcgctcgagcccgtgctgggagaggcccgcgccgccgtagcggtcgaccttctcgaacagggcgttgacgccgtagctgacgcagtgcgccagcagcgccagccggctcgcctcgtcgagcgcgtcgagccagtcccacagcgcctggtcgtcgccgaccggcatgtccgccgcccacgccttccgccgctcgtcgacggaacgggccgacgggctgtccttcaggtccgccgcttgcgccgagaagaagacgtgacggaccgacacctcgaggcacccgcccgcggtcgaggtgcggacgaaggtgtcggtgacgagcttgtgcaagagcgcggtgagcgcgacgtgcggatcgttcgcgacggcgtcgcgcagcgccagcgtgcgatgggcagtgagctccatcatcagccgctcgggcagcggcttcaggccctcgtcctcctccggctcgggctcgctcgccccgccgatggtgatgacggcgcgctgcacggcgggcgacgtgccgacatcggtgccggacgcgacggtcgcctcgtccccgtccgcgccggcggccgaaacctccggctcgacaggcgcctcgtcctcgggccgcacgaagccgcgctcgaccttcaggttgcccatgctgtcgatgctgacgaacgcgccggcgcgcgccacctcggccgcctcgaaggacggcggacggttatggaaggcatcgagcgccgcctcgatctcgccaagccgctggtcgatctcgtccggcaggtcgtcgggtgagtcggcatactcctcctcaagcgcgccgtactcctgctggagcgcgtcgtaggtcgcctgctcttcgtcggtgagcaccggccccgtcgcccgcagccgccgcagacccgcgctgtggccataggggaagtcggtcgcgacctcgatccacttccagccctcgtcggcgatcgtctgcgcttccgcctgcagcttctcgacgacgagccggtcgagcagcgccggatcctgcagccagccgccgtcgtcatgctggaacaggtcgcgcagcaccacgccgcaggcttcctcgtaggccgcgactccgacgaactgggcgcggcggtcggaggcgcgcacggcgccctcggtcagcatgcgccggacctggtagggctccttgtagggctggcgggcgagcgcctcccagacctgttcctggcgggcgtggtcgttcgtcacggtgaacgccatcaggagatcgagcgtgatcccgtcctcggcgtagaggtcgaggagcttggggctcaccgccgcgagccgcaggcgctgcttcaccaccgcgggcgtcacgaagaagcgggccgcgatgtcctcctcggactggccttgctcgcgcaaggactggaaggcgcggaactggtcgagcggatgcaggtcgacgcgccggacgttctcggccagcgaatcctcctcagccgagatgccgtcgtccgccgtcttgacgacgcacgggaccggggcggtcttggcgaggcgcttctgcttcaccagcagttcgagggcgcggtagcgccggccgccggccggcacctcgaacatgccggtctcctggccctcgccgtcgagcacgggccggacgctgaggccttgcagcagaccccgccgggcgatgtcttcggcgagctcctcgatcgagatcccggccttcacgcgccggacgttcgactgggagaggatgagcttgttgaacgggatgtcccgggacgcgctcaggacgatcttcttggcagcttgagccatggtcagtctccatgacgggccggccgagagcctctctctcggcctcccagcccgtcacgaagcccggcgcagccctcttcctctcgggagagccgcgccggagactaggaagaacagggccggcggcacgcgccgagcctgcggcgcaccgccgacagtcgggccacgtcgatgctgccgctagagccggaggaccaacgggcagtgatccgacacctctggctcgtaggtcacctcgaagcccgcgaagtcgccgatgcggtcgatgagcatgtagtcggcgaaccggccgggcttcgcgtagtgcgagctgcgcgtgctctcgaacccgaacctggttaccagctcggtgagcccggctcctttgaggatcgccagagtctcgctgtcgggttcgacgttgaagtcgccgcacacaaccctgaggtcgccggcctcggagactcggtcagagagctccagcaggcgacgggcctgcttggcccgctccggcgtgtccatcttgcccctgagatcgcgcaggccgtgcatgtgcgcgatgctgacggtcctatctcgcccgtagtcgtagacccggaccgcgtgggcgctgcgggacctcggatggtcgccgtacccatgggctgagaacgacttgtggacaaagccctgagcctgcgcgatcacgggaagcgacctgtgcacgaacgtcgcgagcccccattgcgaggggatcgagacgtcgccgtcccagaggacaccctgcgcggcggggcagaagtaggcgacgtggttgggcagcgccgacgcgacgtcccggaagaagttggcgcgctgcggcagcacgtggtcgccgtcgcgataggtcagccagtccttttccgtctcggggctgtgcacgacctcctgaagacacagaacgtcggggcgctcggagccgacatactgcacgagcgtctgatgcagcttcccgccccaaccgttcaaacacatcacctgcattcgttctgctcctgacgaaggccagctccgagcggcgcgggactttagttcgcggcccggctcggacaaaccgtggactttcgcttccgccgtggcgcggctcgccgacggtcgggtgaccgggaagcacccgacatggctaggcgcgcgacccacgcggcggaaccgatcacgcggccacccgctcgagatccacgtcgtgcgtgtgggacgcctcggcgccgggccggaaggcgagcaggaagtcggcggccttggacgcggccgacgccgcgcgcaccacggcccggttgtcctcgcgcaggacctcgagccaagagccgatatagtcgacgtggcggacggtcggcacgatgccgagcgtggcgcagcagaaggcggccgtcatctcggcgacgagctcctcctgcgcgtacttcttcgacccgaagccgccggtcatgtcacgggcgagccgtgaaccgtggccggtccagtggccgagctcgtgcagcgcggtgcggtgccagttgaccggctcgaagtaggcctcgggccggggcacctggatgtagtcgagcgccggcgagtagaacgccttgtcgccgccgagccggagatcggcgccgctcgcccggatgagcgcctcgacctcgggcaggatcaggccgtcgggcactggcggcggcgcggtgacgagatcgtcgggcaggccctcgcactggtcggtggagaagacggtgaagcgcttcaggaacgggatcgcctgggcttcctcaccggtctcgcgggcgcgctgcttctcgtcgtccggcacgaagcggtccgcgtagacgacggtggtgccgcgctcgcccttgcgcacgttgccgccgagcgcgagcgcctggcggaaggtgagccagctctggcagcagaagccgcgggccaccacggcgccccagaggatcaggacgttgatccccgaataggcccgcccggtggctgcgtttttcggcatggagagcggcgctgccacgccgcgcgacccccagggctggacccagggcagccggccggcctccagctcggcaatgagcttgtcggtgatttcctgataaaggctcgcccggtctgaaccggagcggccgcgagcggcattgcgcgccatggcggttctccatgacgggccggccgcgagcctctcccgcagccctcaaacccgtcacggcggcagccgccggcctctccctctcttcggatcgcggcagcgccttgcgctgggcgcacgcccgcctccgtaccgggccaggctccgatcggggcgttgcggggtgcccccgcagaagagggtgtggaggagaccgccccacgggctacgaccagggagaaggccttctcccctcagctcggcggtatcgggcgcgaccgtgcgaccggtatttcctatgtggtgcggccgaccggcgaatgagctaccgtcacgtatgccgatcttcataagccacagccagaaggaccgggcgttcgtcgacacgctcgcggccaatctcgtgcagaacaagcaccatatctggatggatcgctgggaattgaaggtcggcgactctctgctcgacaaagtgcaatcggcgctgaccgattcgagcgccatcctcgtcgttctgtcgaagaattcggtcgaatccgcttggtgcaaacgggagttgaacgcgggcttgatgcgtgagcttgaggaacgaaagacgcttctcatgccgtgcgtcatcgacgactgcacgattccgcttttcctgcgcgacaaggtctatgccgatttccgcgccaacccggacgaggcgctcgaacaggtgaaccgcgccttggcaggcatctcgaacccgctgcaggggcgatcggagacgcctcgcttcaacacggactggtcgctcgactggaagagcatcgacgatacccacatcatggaatggacattcgtcgatcatggccacgattggccttacgtaatcctcagccagtgcgtaattgtctgcaacgaagaagccagccggcgcttcgctcaagccatggcgcgggacgaagaagacatcttcatgcgcgacgtgctggctctgctcgtcgcctccctcccgccggacggcttgaccgtaagaatcgaggacgcgcgcgagcggggtgtttcggcccagctttcccggcccggcggagaagcctttgcggtgcgcttctcctaccgccggctgggccaggacaacggcttcgataccgtcgtctacctcgacaacaacctgaagatcgcgctggagcatatgaccaacgtgacgcgccagcctgccgggccttaaagcgcgcctttattggccgacgacgacctacccttcttccgtttcggggaagcttgcggtgccggtttgtcgagatggtcgagaaagcgcccgaccgcctcgacgagatcctcaggcgaccgcttcgggtcgttgagcaggtcgaaatccttgcgcagcgccttgggccaatggtcgtcgaactcggcgtcgagctgccgccagacctcggcggccgcgccgccggtggcgccgaccgggacgacggcccgcccgatccgccgcgcggcctcgcattcatcgagaacgccatcggcaaggacgcgctcggcgcgaccgcctttctggacgtccttctcgccagcgatgacaatgcagacgccggcctgctggacaaggccctcgcggtaacgacgcttgaaatcggcgtccttgatcccgggcggcgcctcctgcgggaacggccgcagcatcaggctcttctccagattgggcgcatcctctttcaggacgacgccgagcgccccggagatcgacgcgctgcccaccacgagcccgaacccggacactaggcgcttgctgcgctcggcgaccagccggccaatcccgcgagcgacagcctcgatgcgccggcggcgatcgagctcggccggatcgagcacgtcgggaaagctgccggaaatcatcacgctgcgacgggcgagcgtcatctcgacctcgcgcaggatgtcgtcgacctcctcgtactcgtcgatctcgacgcactgaattccatagcgctgcaggtcctcgacccagagccgatggcggatcagctccgtctcgagccgcttcttggcgttcttgccgccgccgagcgctggcttgcggacgatcgcgtaatgctcgggtccgttttccttgaaagcctcgcggatgctgccgaacaaatggccgaggttgggatcggtgaagctgaagccgaggaagaggatctgcttgctgaccaagtggccggtcagaacctgcaggaaccccggccgcatgctccggtagagctcgtagtcgtccttggcgatgacgacgtcggccgggtggtcgaccgagccgtgcatcttgtagaggacggtgtgcgcccatggcttgtcgatgccaagatcctcgttgcgtgacttgacgtcgaggagcttgcgctcgttccgccatgccgtctccggtaaggcgtcgtagttcgtcgtccagacgtgtcgcagcggtaatcgagcgaggatgcggaagggctccggcgcttccgccttgggcgggaactcctcggcaatgaggcgcgcgagctggtttcgcttcccgaccgcgcggttgacgctgtattgcgccaccgcagcgaggtcgtgctcctcctcgatgtcgaggccgagttccttcgcgatgtcacggagcagacgccgccagcccgggtagccggcgcgctgggagagcccggcgccaatgaaggcggcagcggaaccgagttccaggctcttggtccagcgttcgacgaaggtggcgcggtccatgggtctccgattatccttgcgactcggcggagccgcctggagcgactatatcggcctcgggttcagcaacggcgagtgatcatcatggcaaggcgggtcttcttcagcttccattaccagcgcgatatctggcgcatcaaccagatccgtaatttgcacgagatcgtcggctgcgccgccgcgggctttcaggacgcctccttgtgggaggaggcgaagaagaagggtgacgccgagatcaagaagatgatcgatggagccttggagcggaccacggtcacggtggtgttcatcggggccaagacggctgggcggaaattcatcaactatgagatcgaaaagtcgattgcgcgcggcaatgggttggtgggcattcaaattcatcacttgaaagacaaggacgggaatacggacacgcctggggacacgccggccttgctcacgaagcacggggtgcccgtctacagatatgtggacggcgacaagctggcggctcgaattgaggaagccgccaaaaaggccggcaaatagattgttggaacggcgaaagacctgaggcaagccgggacatggccatcctgagcgaaggggcgatccgggcgcgtgcccggcagcgtgcccagcgcgagggagtcagcgtcgacgaagcgctgcggcgcgtgtcgcgccggcaggccacgcggtacgatatctttctgtcgcagacgatccgtgacgccgaggttgtgctcggcgtctatgacctgctggtcgagatgggcttcgtcgtattctgcgactggctcgacgcgcccgaggcggaccgggcggaagtgacgccggcgaacgccgagttcatccgcagcgtgatgtcggtcagcgacaccctgctgtttctcgacaccgcgaatgccgaccagtcgctttggatgtgctgggagctcggctggttcgatggcgcgaaagggcacgtggcggtgctcccggtgctacccgagggccagggctactaccgtggtcgcgagttcctgggcctctacccgtacgtggaaatcgacgcggaaggccaccttaaggtggtgcgtccggctgccgtcaacagccagggcatgatgctgttcgagtcccccaattcgcggagcttcgaacgctggcgcgagggcacccctgccttcatgcgtccgaagatcatcgagcactggcggctctagcggacgccgcaggcacacgatcaatagcgcgccaggatggcattcatctgcgcgatctcctccctttgcgccttcacgatctcgccgcacagcgccacgatctcgggatcggtgatcgacgcctcctcgcacatcaggatcgcgcctgaatgatgggggatcatcgagcgcaggaactcctcgtcgccgacggccgcctgggtgcgcatcgcggcgaagctcgcgacgaagacgatgatcgcgacgccggcgatggcgatgttcagcgaccgcgagggaaacatcgagcccatcgagaccagcatgatcagcgccatgggcgtcaccatcatcagcgtcatgtagagattgttgatgttgaggtaaaaatgatcgagcgtcgcgatcatcgtgtacatgacgaggtacatgatcacgaagtgggccaccatctcgaaccctagcgcgccataggatcccttcgtcttgtggtccgcgtgatctttcatttccgccctccttagtggtgctggtggtgcgcgtgaacgacggcgtgacctttgccacgcgagatcagccatcgattgacgggaaacgcgacggcgccggcgatcagcagcgccaccgcgaggctcccccagaagagagggctcgcaagccccgcatccatggcgccggggatcacgagcatgatggcgttgtcgacgatctccatgatcaggatggagacggtgtcggccgcgagcgccagcttgaggacggctccaaaggccaagcccgccctgaggagcgggatcatggtgaaggcgtaaccgaagaagaaggcgaggacgacggcaagcgcaatcgtcggcgccgtcgcccaacccagggcggtgccgatcaccaggccgagcacctcgccggtggcgcagcccgacaggcagtgggcggtggccgtgaaggccagccggttcagggagatgccggcggaatgagcctgcgccccggccgcgtcagggtgcctatgggcgtgggttgaatgattgcgctccatatgacgtctcccgttgaattggccagatcggccggcggtgctgatcggtgacccgaggcgcgcaggccgtcctcgtccggggcagcgagccggccgcggtcaaaaccatgatctgatcccgaacaggaaggcccagcggccgacgtcctcgcctgcggcgcgcgcgaagtcggcggtgtcgccgaagcggcgctcgtactggacaccgacatagggcgcgaactcgcgctcgatctcgtagcgcagccgcaggcccgcctcgatcgacgacagaccggcgccgatgccaagctcgggcacatcctgcgcggcgagatcgagctcgacccgtggctgcaggataaggcggttggtgatgcgctggtcgtattcggcctcgaggcgggcagtgagatggccctcgtctgacaggaaagctgccgcgtccacctcgaaccagtagggcgcgagaccctggaggccgacgacgagatgcgcgcggtcgggcttggggcggatgtcgtagcggacgcccgcctgaaggttgaaccatgggtcgatcgcgcggctgtagagcgcctggatctcggcgctctccaccgcctcgccgaaggcgccctcgccctcggtcttgagccagaggcggttgtaatcgccgccataccaggcctcgccgtcccaggcgtagccgtcgtggccgtccaccgcccggtactccaagcggtcgaagagcaccatgtagccggtgtagccgccgtgctcggccatcagctcacccgcgcgcttcttggccatgaacgtcgggtcgaacaccgtgtcggcggcgtgctccggtccgctgaacgcttcaggtggcggcggcgcgaccggcggagcggatgccggcgcgttcccggacgtcgcgtggccagcatgcgggtcggccgcgagtgccggagccgtctcccgatgcccggcgtggtcgccgggagccggcgccggctgtggcatcgcgtggcccgcgtgcggcttcgagttcgtcggctgcgatgcgcccggcatcttgtggccggcgtgcgggtccggtgacggcggtacgggagctgccgcagcgggcgtgcaatgccccatcgcggcatgctcgggcgtgcagttcggatcgggcggcgcgggctgggccgcggcgggcgccgcatggccggagtgcggatcggcggcgggcgtgccgtggccggcgtgctgcgcgagcgcgggcgaggcgagagtcagcgcggacgccgcggcgaggatgagggccgtggtcatgcggcacctcccttgtcgtccatgggccggactttgacgacgttcatcatgccggcgtgcatgtggtagagcaggtggcagtggaacgcccagtcgccgggcgcgtccgcggtcaggtcgaagctcgccttgccgcccggcatcacgttcaccgtgtgcttgaccggatgcccatgcggcatgcctgtgaccagctcgaagaagtggccgtggatgtggatcgggtggttcatcatgctgttgttgatgaggttcacccgcacccgctcgttgcgcgcgaagcggatcggctcggcgccttcgttgagcttcctgccgtcgaagctccacatgaaccgctccatattgccggtcaggtggatgtcgacgctgcgcgtcggcggccgcttgtcatggaagggcgtgagcggcgcgagatcgtggtaggtcagcacgcgatgcggctcgttctctaggcccagcggccggtcgcccgtgcggtcaaccggcatcggcgcgatcatgtcgacgccgacgccgaccttcaccgtcggcgggacgagcgactcgtcgcgcatgtcgtggtccatgccgccggacccatggcccatcgccgcatggtcggcgccggcggaagcaggcgcgccatgccccatagccgcatggttcgttgcaccggcgttgccgtggcccatcgcgccgtggtccatcccgcccatgcccatgtccttcatgcccagcgtgggacgcgggcgtagcggcgggacgggcgcggtcatgccgaggcgcggcgcgagcgtcgcgcggcccatgccagagcggtcgatcgactccgccacgagcgtgtaggcgcggtcctcggtgggcgtgacaatcgcgtcgtaggtttcggcgaccgagatctggaactcgtcagtctcgaccggccggacgtgcgtgccgtccgcctgcacgatcgtcatcggcagtcccggtatgcggatgttgaagatcgtcatggccgacgcgttgatgaagcgcagccgcacgcgctcgccgggccggaacaggccggtccagttctcgcccggtccatggccgttgatcagataggtgtaggtcgagcccgtcacgtccgagatgtcggtcgggtccatgcgcatgcggccccacatgatccgctccgagagcggcatcctctcctcgggatcgttgtcgcgcagcagcccggccagcgtctgcttctgccggttgaagtagccgccctcgttcttgaccttcgccatcacctggtgggggtgcatgaaggtccagtcggagagcacgacgacgtgctcgcggtcgtagggcgcaggctccgcgcccgccgggtcgatgaccaatgggccgtagtgaccgacctgctcctgcaggccggagtgtgagtgataccagtaagtcccgaactgcttgatcgggaactcgtaggtgaaggtctgcttgggcaggatgccggggaagctgatccccggcacaccgtccatgtggaacggcaggatgaggccgtgccagtggatcgaggtgtcctcgtcgagggtgttctcgacgtgaatgcggacgtcctggccttcgcgcaggcggatcagcggcgcgggcagcacgccgttcatcgtgatcgcgtggcccgaacggccgccgacctcgaacaggctgtggccgacggaaagccggatgtcttcccccgtaagggtcggcgagtccggcctgagacccggcgtgccgctccgcgcccatgcggggaagaggcccgacaggccggcgccggccagcccgagcgcgccgcttttcaatagcgctcgccttgcgatgggtcggttcattgttctggttccttagtcattgctcagccccatcgggtcctcgtgagcgggaatggcggccgaagccgcagtccgccggtcactgtcaggacgatcccgggaccatcacgtcaaagggcacggtccgcacctgtccgcctcccatgaactgaagccacagcgcatagcggccggcgcgcggcggcgtcgcgtggagcgtcagctcggctgggatgggccctgcagcgccgtgcgatccatggccggcgtgcgccccgccatgtcccttcctggcctgatcggcggcggtcgcatgggcgtggacgtaggcgaggtcgtccgcgccgacgaacaccgcgtgcgccggcacgcccaggtacggctgaaggtcggtcgcgggcttgccgtccttgaggatggtcagcgccatcaagcccgcggcgcccgcgcgcagcgcccgggcgtcgagtttgacggtgtaaggaccatcgacaccttcgagcgtggcgttcggcgacgcggcaggcgccggtctgacaggccgctcgctcggagcaggattgtcggaggagacgtccaccggcacgtcgaagcggatcacctgttggccaaggccggacggcgccgcgtcggcatagacatggtagaggccgggcttcgggaagcggacctggagccggaaccgcccgtccggaccggccttctccgcgtgcgcatgcacgaaggtcgagagcgccgagtcggtggccaggacgtgaagctcctggctcagctcctcgtcgtagcggaggatcggcttgcccgtcgccttgtcgatgaaggcgacctcaagctcgcgggtcagcggctcggtcccccggacgatgaggtcgccggccgctttctcggtagcgcccggcagcgcgaaggtgcccttgatcgaggcctgtgctgcggccggagccgaagcgaggactgcggtgatcgccagcgccatcgcgccggtcacgagaggcttgcgtgtcatgtgggggctccccgttcaaccagcggcgggctcggagcggcgctcggcggggtagccggcttcctccaggaccgcgaggaggttcgattcagcggccgaactctcgacccgcacctcgcgagtcgtcggatcggtctcgatccgggccttgggatcgacgctctgcagcgccttggtgaccgacttggcgcagccgccgcaggtcatgttggggacgtggaagcgaagcatgcgactctccttgttcgttcgcttccaacccaactggggtttgccatcgtggtaaggtcaagccccgaagtcacggcatcgattagcccttgaccttcccatcgttggaagccccacatcgggtccaaagccccaatgaagggagtggaaacgatggcttccgtggttgcgcttcggcgcgagaatgatcctccggcgccctcgggcggcacgctcagcgtccgcatcgaggggatgacttgcgcctcctgcgtcgggcgcgtcgagaaggccttgaaggcgctgcccggcgtgacgcgcgccgccgtgaacctcgcgaccgaacgcgccgaggtggcgttcgccggcgagcccgatccggcagccgtggcccgcgcggtcgaggatgtcggctattcggtgggcgaggagacgaccgaactctcgatcgaggggatgacctgcgcctcgtgcgtcgggcgggtcgagaaggcgctcgtccgcgtcccgggcgtggtgagcgcctcggtcaatctcgcgaccgagaaggcccaggtccggcatctcgccggcgcggtctccacgggcgatctcgtcgcggccgtccgctcgacgggctacgaggcgcgtgcggtggcgtccgacgctccctccgaccaggaggcggagcggcgcgagcgcgagatgggctcgctgcgccgggcgctcctcatcgcggccgcgctcaccctgccggtgttcgtgctcgagatgggctcgcacctgatcccggccgtgcatgactgggtgatgaccaatatcggccaccgcgagagctggtatctccagttcgcgctaaccacgctcgtgctgttcgggccgggcctgcgcttcttccagaagggtgtgccggcgctcctgcgcggggcccccgacatgaactcgctggtcgcgctcggcaccagcgccgcctggggctactcggtggtggcgaccttcgcctccgggctgctgcccgaaggcacgcagaacgtctactacgaggccgcggccgtcatcgttacgctgatccttctcggccgctatctcgaagcgcgcgccaagggccgcacgtcggaagccatcaagcgcctcatggggctgcaggccaagaccgcccgcgtcctgcgtgacggcgaggccgttgaggtgccgctcgccgacgtgcaggccggcgacctcgtccaggtgcgtcctggcgagcgcgtgcctgtggacggcgaggtgattgagggcacgtcctacgtggacgaatcgatgatcaccggcgagcccgtgcccgtgcacaaggcggcgggcgctgaagtcgtcggcggcacgatcaacaagacgggcgctttcaccttccgtgccacgaaggtgggcgcggacaccgtgctcgcccagatcatccgcatggtcgagcaggcgcaagggtcgaagctgccgatccaggcgctggtggacaaggtcacctccgtcttcgtgccgatcgtgatgggcgtggcggcgctaaccttcgggatctggctcgtcttcgggccggcgccggcgctcaccttcgcgctggtgaacgcggtggccgtgctcatcatcgcctgcccctgcgcgatggggctcgccacgccgacctccatcatggtcggcaccgggcgcgcggccgagatgggcgtgctgttccgcaagggcgaagccttgcagacgctgcgcggtgccaaggtggtcgcgctcgacaagaccggcacgctcaccaagggccgtccggagctcaccgacttcgtcccggccccaggcttcgcgacggaggaggttctcggcctcgtcgccgccgtcgagacccgctcggagcacccgatcgccgaggcgatcgtcgaggccgcccgcaagcggggcctcaagctcggggcggtcgagagcttcgacgcggtgcccggcttcggggtcgccgcgacggtccagggccgcaaggtcgaggtcggagccgatcgctacatgaagaagctcggctacgacgtcgccgacctgctgcctgcggccaagcggctggcggtcgagggcaagagcccgctctatgcggccgtggacggcaggctcgccgcagtgatcgcggtcgcggacccgatcaagccgacgacgcccgaggcgatccaggccctgcacgcgctcggcctcaaggtcgcgatgatcaccggcgacaacgcggggaccgcgcaggccatcgccagacagctcggcatcgacgaggtcgtggccgaggtcctccccgacggcaaggtcgaggcgctcaagggtctgcggcaacggctcggcagcgtcgccttcgtgggcgacggcatcaacgacgccccggcgctcgccgaggccgacgtgggcctcgccatcggcacaggcacggacgtggcgatcgagtcggccgacgtggtgctgatgtcgggcgacctgcggggcgtccccaacgcaattgcgctctcccaggcgaccatccggaacatcaagcagaacctgttctgggccttcgcttacaacacggtgctgatccccgtggcggcgggcgcgctctaccccgcctacggcgtcctgctctcgcccgtgttcgcggccgccgcgatggcgctttccagcgtcttcgtgctcggcaacgcgcttcggctgaagggcttccggccgccgatggcggccgagacgtccgcgcctgaccgcgcgacgggccgacccgcgttggcgcccgccgaatgacggccggcccgggccgcgacgagggcccgggtcagcccaagacgaaacgcaaggaggccgacatgcccgagaccgcagataccaaggtgatcgtctacaccacgccgacctgcccggattgccgggcgctgaaagcctggctcgacgcgcgaggcgttcctttcgaggagcgcgacctgtcggaccagacggtgatggaggaagccaaggcgcgcaccggggtgcgcgtggcgcccatcacgctggtgggcgagaaggtcttctacggcaccttcccgtcgcagaagccgggcctcgccgaggcgctcggcctgtcgaaggcggcgtgagggggagcgtcgccatgaccagacgtgtcgacatccgacaggccgggctgaccattgatgtccccgagggccgcacgatcctggaggtcgcgcttgaggcgggcatcccttacccgcacggctgccgctcgggccggtgcggctcgtgcaagtcccgcctcgtgtcaggtgaggtcgatctgctcgatcatacccgctttgcgctctccgacgcggagaagacgcaaggtctgatcctcgcctgccgggcgctgccccggaccgacgccgccgtcgcctggctcggcggcgacgaggaggtcgccgatcacccgcgccggcggctgcgctgccgcgtggtggcgatcgaggacgccacccacgacatcaagcgcgtccggctcgccgtcgaggacggggcgccgctcgccttcacggccggccagtacgcccgggtgaccttcccgggcgcgccgacccgcgactattcgatggcgaactggcccggcgagccggagctggagttccacatccgtcgcgtgccgggcggcgccgcgaccgcgcgcatccacgcgctcctgaagctcggcgaccccgtgaccgtcgaggggccgttcggctcgtcctacctgcgcgagaagcatgccgggccgatcctctgcgtcgcgggcggctcgggcctcgcgccgatcaagtcgatcgtcgagaccgcgctcgcgcatggcatgcggcagccgatccacgtctatttcggggcgcgggcggagcgcgacctctatctcgccgaccacttcgaggggctggaagcgcggcaccccaacctgaccttcacgccggtcctctctgagtccccgccgcaaccgaaatggcggacggggttcgtcaccgacgcggtcgggcaggatctgcacgacctcgacggctggaaggcctatgtcgccggcccgccggcgatggtggacgcagcgatggccatcgcgaccgcgcgcggcctgcggcgtgaggacctgcatgcggacgtgttcttcacgcccgaagaagcgcccgcggcccgcgccgcgagcgcgtaacagcaatcgagacaaggagacgaaccatgaatatcgggcaagcggccaaggcctccggcgtttcggctaagatgatccgctactacgagcagaccggcctcatcccgaaggccatccgctcggacgcgggctaccgcaactacagcccgtccgacgtgcacacgctgcgcttcatccgccgggcgcgcgacctcgggttctcggtcgagcagatcgcggagctgctcgcgctgtggcgggaccgcggccgggcgagcgctgacgtgaaggcggtggcgctctcccacgtcgccggactcaaggcgaagatcgccgagctgcaggccatgacccgcacgctggagcatctggccgcaacctgccagggcgacgaccgccccgactgcccgatcatcgaggatctcgccgaggcggcccaggtggccgcgccggcgcgccccaagcgcgcggcggcgccgcggttcggcgaagccggcgggccctcggcgacgcggcgcggtgcggcggctgcgccccgccactgagctcggccggcgcccggagcaaccgggccagttgcatgcaatagaggagctgagccgtccgatgatcggaactgaccgtcgagcggttgccgtgctggctgtcgcccaagctctctatctgtccgcggccgcggtggtgttcaccttctccggcctcgccggttacatgctggccgcagacaaggcgctggcgacgctgccggtggccttgatgacggtcgccaccgcgctggcgacgattcccgcctcgctgctgatggcgcgggtcggccgacgccgcggcttccagctcggcgccttcttcggcgcggcgagcggcgcggtctcggctggcgcgatcatgctcgggagcttcgcgctgttctgcctgggcggcgccctgatgggcgtgttccagggcttcgcgatgtactatcgcttcgccgccgctgatgctgccgacccgtcgggcaaggccaaggcggtttcgtgggtgctcgccggcggggtcgcggccgcgctgatcgggccgcaggtcgcggcgtggagccgaagcgccttgcccacggcggagttcgccggctcgtatctggcggttgtcgccctgtcttttctgtcgatggtcgtgctcgccggcctgcgcatgccggcgcccggccccgccgagcggggcggcggtcgaccgctcctcgtgatcgcccgccagccggccttcgtcgtcgccgtcctcaacgccgcaatcgcctacggggtgatgagcttcgtgatgacggcctcgccgctcgcggtggtggccgatgggcacgggcccgacgcggccgcgagcgtcacccgctggcatctgctcggcatgttcgtgccctccttcgtcacggggagcctgatcgcgtgcttcggcgtcgtccgcgtgctgctggcgggtgccggcctgctgctcgcgagcgcggcgaccgcgctggccgacccggccgcgctcacccactaccacgtcgcgttgcttctgctcggggtcgggtggaacttcctcttcatcggcgggacgacgctcctcgcggagacctaccagcccgccgagcgcgccaaggtccaggcggcgaacgagttcctcgtcttcggcgcgacggcgcttgccacgctcgccgccggcggcgtccagacggggttcgggtgggtcgcggtcaactggagcgccgttccggccgtgatgatcgcggtcggcgcgactgtttggctggctgccaccgcccttaagcggaaacctcgtcccacacccgagaagccatcatgaacctgcgcgacgcacggcattgaggtcgcggcgctgagctcgctcaatgctcgcggggccggcgaacggcggcggcgatcgccagataggcgtcgcctagcgccggctcctccaaagcgccgtcgggatcgagttcgccgtctcgctgccgggcgatgagttcgaggatcgagagcagcccgtcggcgacctccagcgcgcgctccgcgcaggcctgatggaacgctgcaagcacccgcgcctcgagcatcggggtggcgcatcgatcggacatggcggagccctccttcgccggccaggcggcagctcaggccgggtgaagcgcgagccagtcgcgcatgaaggcgatctcgcgatcctgcgccgcgatgatctcctcggccaggcgcttcagctccggatcggcgcagtgctcgatcgcgatcttcgccatctcgaccgcgccctcgtggtgcgggatcatcgcccggacgaagtcgcggtcgggatcgcccgtgagctcgaccgccatggcgtggtgcatgcggtcgttagcggcgcgcagcgcctgcatggcggcttcgttcttcggcatcgtcggatctcctcatcattggatgagccgaccgtgcggcttgcaacgctggcaaggtcaagcgctcgccgccgctccattcgaaagcgatccggccacgcctcagtgcggtgcgctgcagcgatggacctcgacggtgacgtgcgccagctcgggccagtcggacacgcgggtgcggtagtgctcgggatcgcgcggctccgaagtgacgagcgcgatgatcgcggcgtgacgccccgggccgacccgccacaggtgaaggtcgctgatccgatcgccgccgcgctcaatcgctccccgcacccgttcggccaggcgtggatcggcgcccgcgtcgagcagtacggccgcggtgtcgcgcagcaggccgtaggcccagcggccgatcaccaaggcgcctacgacgccgacgaccggatccatccagacccagccgagatagcgcccgaccacgagggcgacgatggcgagaacggaggtcagcgcgtcggcgagaacatgcagataggccgcacggaggttctggtcctggtgatcatgatggtgatggtgctcgtgcgcgtggccgtggtgatgatcgtggcctccgccggccagcagccaggcgctcgccaggttgaccgcgagccccagcacagcgaccgtgatggcctccccgaaggcgatgggaaccggatcgatcagccgctcgaccgactcccagccgatcagcagcgccgtcacgccaagcgcgatggcgctggcgaacccggcgagctcgccgaccttgccggtgccgaaggtgaaccgcgcgtcgcgcgcatagcggcgggcgaaggcataggcgaaggcggtgattgcgagggccccggcgtgggttgccatatgccagccgtcagcaaggagggccatcgagccgaacagcatgcccgccgtgatttcgccgaccatcatgacagcggtcaggaggatcacccaatgcgtgcggcgggcgttgcggtcgtggtaggcgcccaggaagacgtgatcgtgctggtggtcggcgaaagtgtggccgtgcatggtctctcctttctttggattcattcggcaggcgccgggaccggcgccggttgggggtgccgccggccggccagccgccggaccacgacgtagaagaccggcgtcagcaccaggccgaagagcgtgaccccgagcatgccggcgaacaccgcgacgcccatggcctggcgcatctcggcgccggccccggtcgcggtcgcgagcggcacgacgccggcgatgaaggcgagcgacgtcatgaggatcgggcgcaggcgcagccgggccgcttcgagcacggcgctcaaggtatcgagaccatcgtcctccttggtccgggcgaactcgacgatgaggatggcgttcttggcggcgaggccgacgagcaccacgaagccgatctgggtgaagatgttgttgtcgccgcccgacagccagacgccggcgatggccgagagcagcgccatcggcgcgatcagcagcacggcgagcggcagcgaccagctattgtactgggcggccaggatcaggaaggcgagcagcaccgacaggggaaagacgaacagggcggtgttgccggcctgcttctcctgataggtgagttcggtccactcgaatgtcatgccggccggcagcgtttcgcgggcgatccgctcgatcgcgtccgtcgcctgacccgacgaataccccggcgccgggttgccgctgatgtcggccgacgggtagccgttgtagtgcatcacgcgatccggccccgagctgcgcgagatcgtgacgagcgccgcgagcgggatcatctcgccggccgcgttgcgcaccttcagccggccaatgtcctcggcctgcatccggaacggcgcgtccgcctggaccatgacgcggtaggtccgcccgaagcggttgaagtcgttggcgtagagcgagccgaggttgacctgcagcgtctcgaagatggcggtgagcggcacgccctgcgccttggccttgacgcggtcgacgtcgacctggacctgcggcgcgttgacctggaagctcgccagcatgccggtgagctcgggcgcctgggacgccttcgccatgatcgcgccttgcgccgcggcgagcgcatcgaggccgaggcccgcccggtcctcgatctgcatcttgaagccgccgatcgcgccgaggcctggcaccggcggcggcgggaagatgccgaggaagccgtcggggatctggctgaacttgcccatcaggcggcccgcgatggcgttggccgagagcgagggttcccggcgctgctcgaacgggtccagcatcgcgaacatcacagcggcgttcgggatgttgacgaagccgttgaccgacaggccggggaacgcgacgacgctctccacgccgggctcggcgagcgcgatcctcgacatctccttgacgacagcctcggtgcggtcgagcgaagcgccggtcggcaactgggcgatgccgacgaggtagtatttgtcctgcgccggcacgaagccggtcggcacgctctggaatccgagccaggtgaggccgaggagcccggcgtagagcatgagcacgagaccgctgacgcgcacggcgcggcgtaccgaccagacgtaggcgcgcgaggcgccctcgaagaagcggttgaacagccggaagaaccagccgaacaggcggtcgatgatccgcgtgaggcggtcgcgcggtgcgccgccgtgatgcggcttcagcagcacgccggccaacgcgggcgacagggtcagcgagttgaccgccgacaggatggtcgagattgcgatggtgagcgcgaactgtcggtagaactcgccctgcaggccggagaggaaggccgaggggatgaacacggccgccaacaccgaggtgatggcgacgatcggcccggtcacctcgtccatcgccttgcgggtcgcctccttgggcggctcgcccagcgcgatgtgccgctcgacgttctccaccaccacgatcgcgtcgtcgaccacgatgccgatcgagagcaccaggccgaacagcgagagcgtgttgagcgagaagccgaggaggtgcatgaccgcgaaggtgccgacgagcgacaccggcaccgccacgagcgggatgatcgaagcccgccaggtctgcaggaacagcaccacgacgagcaccacgagcgcgacggcttcgagcagcgtcaccgcgaccgcttccagcgaggcgcggacgaacaccgtcggatcgtaggcgatccgatactccaggccttcaggaaagccgcgcttgagatcgtccatggcaccgcgcacggcgttcgagacgtcgagcgcgttggccccggggctctggatgatctggagcgcgacggcgggttcgccgtcgaggaggctgcgcagcgcataggcgtcggcgccgagctcgacgcgtgcaacgtccttgagtcgcgtgacctggccgtcggccccggtcttcaccacgatgtcgccgaactgctcttcactcgagagccggcccagcgtgttcaccgaaacctggaagtcggccgaggcatagggctgctggccgaccgagccggcggccacctggacgttctgctcgcggatggcggcgaccacgtcgctcgcgctgaggccgcgcgccgccaccttcgccgggtcgagccagatccgcatcgcgtattcgccggcgccccagaccacgacgtcgccgacgccgggcaggcgggcgagcacgtcgcgcacctggaggatggcgtagttcgagacgtagagcggatcgtagcgcttgtcgggcgagaggagatgcacgaccatcagcacgtcgggcgaggtcttctgggtgacgacgccgatgcgctgcacctcttcggggagacgcgggagcgcgcgcgagacccggttctgcacctggatctgcgccatgtcgggatcggtgccctgcgcgaaggtgacggtgagcgtcatgcgcccgtcggttgccgcctgcgagcccatgtagagcatgccttcgacgccgttgatcgcctgctccagcggcgaagccaccgtctcggcgatcacctgcgggttggcgccgggatagctcgccgtcacctgaaccgtcggcggcgtcacggagggatattcgctgagcggcagccgcagcagcgcgagggcgccgccgatcagcatcagcaccgagagcacgaccgcgaagatcgggcggtcgacgaagaagcggggcaggttcatcggcgcgcctcctgggaggccacgttggccgcgtggccggacggcgccgtgccgggcgccatcgaggtcgggcgaggcgcgacctgcatgccgggacgcaccagccccttgacgatgatggtctcgccgggagcaaggccgctcgtgacgacgcgcaggccgtcgatcaccggcccgagctcgaccgggcgatactcggccttgttgtccgctcccagcaccagcacgtagcgccggccctggtcggcgccgacggcctgatcgtcgatgagcaccgtctggcgcgacgcatcggtcacgagcttcacccgcgcgaacaggcccggcgtgagccgcccgtccggattcggaacgacggcgcgggcgcgcaccgtgccggtgctgcgatcgacgcggttgccgaggaaatcgagcacgcccgcgtgcgggaagccgttatcggtcatgagactgacccggacgggcagccggaccgtggcgcggccgctgctgtcggggcgagcctttgccacgaagtcgaggtaggttgcctcgtcgatgtcgaagtagacgtggacgggatcgatggagacgatggtcgtgagcacggtcgccgcgccggcgccgccgccggcgacaagattgccttcggtcaccaaggcccgatcgacccggccggcgatcggggccgtgacacgggaataggagagatcgagccgggccgccgcgaccgcggccttcgccgcttgcacctgcgcctgccgctcgcgccgcttggccagcgcgtcgtcgtagctcttgcgggaaatcgtgccgttgggcacgagcttctccgccctctcgaagtcggcttcggcctgggcgagcagcacttcggcctggcggagctgcgcttcggccgtctcgaccgccacctggaacgggcgcgggtcgatctggaacaggagctggccctcccggaccagcccgccctccggaacgctcaccgcctcgatcgctccgcccacgcgcggccgaagctccacgctcctcgtcgcggccacgaagcctgtgaactcggcggagggtgcgatctcgcgcgtgaccacctcggccaccggaacctgcggcgccgggggcgcagcggccggttcggtgggcgcgccgcctgcatcttctccggaccaggcaagcgcgaggacgcgatcggcgtagggcgccacctcctcgcggtaggccacggcgaggccggcggcggcggtgacggcggtcgccaagaggacggctgcggctctgcgtgccatggcattcaccttcggtgcgtcgcagcgctcggactcctgagcgcggtttcagcggcgtttgtcgtgaaggtggtctttccaacgatgggaaggtcaagagcccacgcggagcccggaaacctccctcccggacgaggatcggcggcctgttgaccttgtcacgctggcaagccgcagcgttggcgctgcgactcgtcagccggaggtcagatggaactgcgtcagctccgttacttcgtggcggtggctgatgcgggcagcttcagcggggcggcggctgcgctcggggtgatccagccgaccgtcagccagcacatccagaggctcgaaagccggctgcatacaaacctgttcgagcgttacccacgcggcgttcgcctcacccatgccggccagcgcttccttcggtcggctcgccggatcatctacgagctcgatcaggcaacgggccaggccggtcgcatcgctcgcgccgaggccggtgcgctctcgattggcttctacgtctcgctgagcaccgggccgctccgcacggcgctggcggcgttccgtgctgaggcccctgaagtcgcgctcgagctccaggagggcagtccgcccgacttgctcgccgccttgcgcgagcaccgcattgatgtcgcgctaacggtgctcgaggtcgcgtccgctgagttcgcgactctgcacctttgggacgaggagctcgccgccgttctccctgaggatcacccgctggcgacccgcgaggcggtgtcatggtccgatctggcggaagcaccgctggttctccggacatgggagagcgggtcggtgctctatacctttctcgccggtcgggttgccccggatgcgtatcttgaggccgaccagcacttcgtctcgcgcgaggcgctgctttcgttggtcggcctgggttttggagccaccgtcatcggcgagtcggccaccggcgttgcccacagtggtgtcgtcttcaagcccattgccgaaccggacgccgcggtcccggttactgcggcttggctcaaggagaacgacaaccctgcgaggggccggttcgtcgccgttgttcgcgatctgtcgaagcccgcaggaaatcggcgcctcgacagatagagtagccttggatcattgctgaagcttgctgctgatcaagcctcatcggagtaggcggggcgacggagtcctcgcagcccccgttccggacgcgcctgcgtggcgcgccgggtagagcgcagctatgggccgtacgccgattcgccgccctttccagcccctttgcgctactacgatcttttctctcttcacatcggacgagctggtgccttcgttgctgagtgctggagcgtgagcggattggtcagaagcggaccggcggtgagcggctggtatcagcgcaaaccacagccggtggccatggctgacctagctccagccagacggacatggagcctttttggttcgggagtatcgaatggccgaacggaaatttctcaccgccgacgaggtggcggagcggtatcgtggcgagatctcggtcgggacattgcggaactggcgtgcgatgcgggtgggcccgggcttcgtgaagatcggcaaggcggtcctataccccgttgacgaactcgatgcttgggacgagaagaacctggtggcttgccgtgcgtcacggcgcctcaccgtgaccgacgaggatgacgcgtgatgggcacgttggagcatcaaacaccgatcccaagtgccgctaccaagttccaccttccgagccaaaattagcaataaatccagtcccttaggggttggtgatcgtgtgtcgcacaaccacccgtcgggagacccgaccccctcgcccgccgatatcgacctcacccgccgtctggtcgaagccgcgcgccatctgggcatctcggtccacgaccacatcatcatcggccggcgcagctacaagagcttcaaggccctggggctgctctgaaaggagcctcactccgccggggtaacgtcgaccgccagctgcggcaccgcccttgccggcggctcggtgggcgcacgggccgggcgttgcgccgggcgggagagttcatagacatcaacagtttcggtccggccgcgcagcatatgcgcacccaatgaccgcgaatcgactcctgccggcagcggcgccagcgccagaacggcttcagacaccagcaccggcactttcagcgtcttagccaggccttcaagccgggcggcggtgttcatcgtatcgccgatgaaggcgatctcgtgtttggcatcgcccagttcggcgaccaccacggtgccgacatgcatcacggcccggacccgcggcgcctcgccgaaacgacggatgaagtccggaccggcccgctccaccgcctccagaatgtcgaaggtgcaggtgatcgcccgggccgcctgacgcgcggcctggcgcgcgccgcagctgatgttccaggaaatgatcgcctggtcgccgacatagcggtcgatggcgccccggttgcggcgcacgggtgagcccatggtgaacaggatctggcccagataatcggtcgcccccagctcgcccagccgctcggcggtgctggtccagccggcgacatcgaccagaaggaagatgcgttcctcgcgcgtcgggcggtgatagcggccgaccagcagggccaggaatacccgcgtgccgatcaggtcgcggatccggaacagcaggccgcccacggccgacacgcccatggagaagagcagcacgtcgaagcgcagcaccagccacatcagcggcccgtgatcctgatggccggccaggatcccgaaccactggtccgccaccatcagcagcagccccatcacggcataggagacgaaggacagcgccgaccagacgagcatggtgccgccgacatagatcggtgccgcctgggcgcgcagccagcggctgaccttgggaaacagccgccccatcgcgaaggcgatcatcaccccgccgacgccggcgccatagaccatggcgatccaggtgtcgttcttgccttccaggatgccgaaggccaggccgcagagcatgccggcgagcgggaaacccagccagcccagcgcgttgcgcaggcgttgcgtggtcgcttccctcatgccccctcacctttcacccgacagcctgcccgccacaccggtgcatacggtgttgtttctggatattgggcggccgtgtcctcttgtcgacctcccgaagccatctgcttcaagacatcttcatgacggctgccgtcgtcccacactaagccacgattggccccggcgcagcagctttacgcgcaccgccgccccgccagtggtcatctgccctttgcccggcggctgccacgggctataaccctgcccgaagcggccggacggctccggttcgcgtgtgtttcgcctgcgaaggacagcccagcgatgatcccgcgctattcccgccccgagatggtccggatctgggaaccggagaacaagttccgcatctggttcgagatcgaagcccatgcctgcgacgcccaggccgagctgggggtgatccccaaagaagccgcgaaggcggtgtgggagcgcggcgccttcgacattccgcgcatcgacgagatcgagcgcgaggtgaagcacgacgtcatcgcctttctgaccagcctggccgagcatgtgggcgaggaagcccgcttcgtgcatcagggcatgacctcgtcggacgtgctggatacctgcctcgccgtgcagctgaagcaggccgccgatctgctgatcgaggatgtcgacaaggtgctggccgcgctggagcgccgggccttcgaatacaaggacacgcccaccatcggccgcagccacggcatccacgccgagccggtgacgttcggcctgaagcttgccggctatcatgccgaattccagcgcgcccgcgcccggctggtggcagcgcgtgacgagatcgcgacctgcgccatctcgggcgccgtcggcaccttcgccaatatcgacccccgggtcgaagagcatgtggccgaaaagctgggcctgaagcccgagccggtttcgacccaggtgatcccgcgcgaccgccatgcgatgttcttcgcggtgctgggcgtggtggcaagctcggtcgagcggctggcggttgaaatccgccatctgcagcggtccgaggtctacgaggcggaagagtatttctcgcccgggcagaagggctcgtcggcgatgccgcacaagcgcaacccggtgctgaccgaaaacctgaccggtctggcccgcgtggtgcgcggctatgtcaccccggcgatggagaatgtggcgctctggcacgagcgcgacatctcgcattcctcggtggagcggatgatcggccccgacgccaccatcgtgctcgatttcgcgctcaaccgcctggccggcgtggtcgacaagctggtggtctaccctgagcggatgatggccaatctggatgcgctgggcggcctggtccactcgcagcgcgtgttgctcgccctcaccaagaagggtgtcagccgcgaggatgcctatcgcctggtgcagcgcaacgccatgccggtctggcgcggcgagggccagttcatcgacctgctgaaggcagaccccgaggtcaccgcccgcctctccgacgccgagatcgaagggctgttcgatctgggctatcacatggcgcaggtcgacacgatcttccggcgggttttcgggcgggcctgatcccgaactcttatccccacaccggatatcagagaaaaccccgcggcacctgctgcggggtttttttcatgggtcacacgtcgtcctggggcgcgcggaccggcaggctcttcagaaacagcgcgaaacggtccagctcctcacgcgtcacatcggccggcaggcgcagcgcgacgttctggccaagccggatcggaaaatagacctcgaccgtctcggtcgtacgagggccgccggtgcgagtgcggacggcatagaagggctgggcgggcgctgccgcgtcagaagcggcgaccgtctgcggctcggccgcgatcgcggcggcatcgcgcttcaccagccgggtcttctggccccggcggccgatcaccagctgccagtcggtcagtgcctcgatccgcttggcggtctcgagcgcctcgcgatactccatctccagccactcggccagggcctcgatcgggatgctcttgtgaaacccgtagtcgtgcgtctcgaccaaggcttcgaaagtctggagattgaaggtgtccatgaggcggggcactcgggaaaggtaactctctctgcacacgctatcatacgggatcaaggcgtcaattctttcgatcgatccgcgagttcccgtcccgtacaggctgtgtcatcggcccgtccgccgcgccatgttatgatatgccatcatcgaccccatgcgagttctcccccgatgaccgatatccgcctcgcccttctctcggaccttcatctcgacgtcaggcgccgacggctggaacgcgccggcctggaaccggaggccgccctggcggcgatagacgatctggggcgccggacggccgatgccgcacgggatgccggggccgatctggtgattctggccggcgacatcgccaacggtaccggcgggatcgactgggccggccggaatttcggcgatctgccggtgctctatatcccgggcaatcacgaattctacggccatgaccgggcgccgctgattcgggagatgcgccgcgcggcgacggccgccggcaatctgcgcgtgctggacggcgatgcgatcgacatcgacgcccgggaccgccgggtccgcattctgggcggcacggcctggaccgactaccggctttatggtgacgaggcagccgcaaccgccatggatctggcgggccaggtgctctacgaccatcagcgcatccgcgagggcgaccggccgttcagcccggaagatgcccggggcctgcatctggatttccgggcctggctggcgcaggaactcgccgcctccgatccgtcggcgaccgtggtcgtcacccatcacgggccggcggcggcatcggtggccgaacgcttcgagggcagccccctctcccccgccttcgtctcggacatgaccgatctgatgcaggcgcatgagccggcgctctggctgcacggccacacccatcacgatgtcgattaccgggtcggccggacccgcgtggtcgcccggcaatggggctatcccgaggaagggctcagcgagggcttcgccctgctcaccatctgacgcagccccttccccagatgcagaaaacccgccagggccaggcccgggcgggttcgctgaagtcggtctcggtgccggggcgatcagccctgggcgagcaccgctgccttggcttcctcgcccaggcgctggagctggatctcgacgacatggcgcgaggtctcgacattcgcggcggcgaaatcggccagcagacgggcgatgatgtcctcatcgcccggctccttcatgtcggcatcgatcagctcgtcgccataggcggcgatgtcggtgcggccgatctgcggcccggcccaggcggcgagcagccgggcgcgcttcacgcgggccttgaaggccagttcctggtcgtgggcgaagcggttttcttcggcgcgctcgcggttgtcgaaggtgctcatcgctggactactcctgcaaaacctgatcggtggtgcggacctggcttcagccgtcatgccgcggcggctctcgccagcccgcaatccgacggccccgtcgccctttctcataccagcagcaggcggcaatgcctagcgcaaccggcccggtaccttcccaatcatatggccgctcagtcgatgatatggtagccgccatccacgaacagggtctgaccggtcatcagccgggcggcgtcggtggcgagatgcgcggtcgccgcccccacatcctcgatcgacagcagcgacgagatcggcgccttttcatgggccttggccagaagatcgtcgaacccggtcagccccgaggccgcgcgggtggccagcgggccgggcgagaccgcatggacccggatgcccttggggcccagttccgccgccagatagcgcaccgcacattccagcgccgccttgaccgggcccatgacgttgtagtggtcgaccaccatctgggcgccgaaatagctcatgcagaccagggtgccgccctgtttcatcaacggttcggccagcttcgccatgcggatgaacgaccagcaggacacgtccatcgcctgcaggaaacccgccttcgaacagtcggtcagccggccgtgcagatcctcgaccggcgcgaaggcgatcgaatggaccaggaaatcgagctggccccaatcggcctcgacctgctcgaacaccgcttccagcgccccgtcgacccgcagatccagcggcagcagcagctgggcatccacctcgcgcgccagcggctcgacatgcgggcgcgctttgtcgttcagataggtgatggccagatccgcgcccagcgcccgaaacgccttcgcgcagccccaggcgatcgaatgctcgttggcgatgccggcgatcaggcccttgcggccggcaagcggcccggggacggcagtggtggtcatctgaagcgactccgtggttgcatctgctaaacggcagtgtgcacctgcagcatgacaatcgcgagcgcagagtccgccgggcctgccggggcagtcctgcgaagctcgcgcagcgggcgaaaccgcatggccgggtcgcgtcggaagccgttgtcttggcggagcggattgtctatgtttcgcgcgcgctggaccgactcctaagtcggcccggcccgactgatttgctcatggacccgatttgctcacggacctgggctcagctcgtcgagatccgacgctcccgggtcgattcccggatgtgcggacccgtcgacggcctaccgcccgtccgaactccccggaggacgcccatgtcccgccgcaggcgcatctacgaaggcaaggccaagatcctgttcgagggtccggagcccggcaccgtgatccagtacttcaaggacgacgcgaccgccttcaacaacaagaagaagggtgtcatcaccggcaagggggtgctgaacaaccgcatctccgaatacctgatgacccggctggccgaaatcggcgtgccgacccacttcatcaagcgcctgaacatgcgtgagcagctggtgcggcaggtcgagatcatcccgatcgaggtggtggtccgcaacgtcgccgccggttcgctcgccacccgcctcggcctcgaagagggtgagcggctgccgcgctcgatcgtcgagtactactacaaggccgaccatctgaacgatccgatggtgaccgaagagcacatcaccgccttcggctgggccacgatccccgagatcgacgaaatcctgaacatgtcgatccgggtcaacgacttcctgtcgggcctgttcctcggcatcggcctcaaactggtcgacttcaagctggaatttggccgggtgttcgacgaggaccaggacatgatcatcctggccgacgagatcagccccgacaactgccggctctgggacgtcaagaccaacgagaagctcgacaaggaccggttccgccgcgatatgggccgcgtcgaggaagcctatcaggaagtcgcccgccggctcggcatcctgcccgaggatccgggtcgcgacgtggccgagaccccgaccgaggaggacgcatgatgaaggcccgcgttcacgtgaccctgaagcccggcgtgctcgacccgcagggcaaggccatcgccaacgcgctccacggcctcggctatgccgaagcgggcgaggttcgtctcggcaagtatatcgagctggacgtcgacgccgccgatgcggccaccgcccgcagccgcgtcgccgagatgtgcgagcgcctgctcgccaacaccgtggtcgagaactacgcgatcgagatcgcggactgatcccgccgccggcccgggccacccgcccgggccggcgatgtttcagcccctgccgacccgatccgaaatcagggaatccaagcccgtggatgccgccgtcatcgtctttcccggctcgaactgcgaccgcgacgtggccgtttccgtcgaggcggcgctgggccgtgcgccgcacatggtctggcaccgtgccgatgaactgcccaaggtcgatctgatcgtccttccgggcggtttttcctatggcgactatctgcgctcgggcgcgatcgccgcgaattcgccgatcatggcgcaggtgaaggccgccgccgcaaagggcacccgggtgctcgccatctgcaacggcttccagatcgccatcgaggccgggctgctgccgggcgccctgatgaccaatgccggtctgaaattcgtctgccgagacgtgctgctgaaggtggagcgcaacgacacgcccttcaccgcaggctatgagcagggcgcggtcgtgcggttcccggtcgcccatcaccagggcaattatttcgccgacgacgagacgctggcccggatcgagggcgaaggcctggtcgccttccgctatgtcgatgccggcggcaacccgaccggggcggcgaaccccaacggctcggcccgcaacattgccggcgtctacaacgaggcgcgcaatgtgatggggctgatgccgcatcccgaacgtctggccgacccggcgctgggcggcaccgacggagcccggatgttccgctcgctgctgggcggtctctcctgagccgccccggagttccagcctccgaagcccggcatggccgggccccaagtttccgagactgacgggaatcgcgaccgatgacggccgaaaccaagatcacccccgagatcgtcgccgagcacgggctgacccgcgacgaatacaagcggatccgccagatcatgggccgcgagcccaacctggtcgaactcggcatcttctcggcgatgtggagcgagcactgctcgtacaagtcgtcgaagaagtggctgaagaccctgccgaccaccgccccctgggtgatctgcggccccggcgagaatgccggtgtcgtcgatatcggcgacggccaggcgatcatcttcaagatggagagccacaaccacccgtcctatatagagccctatcagggtgcggcgacgggtgtgggcggcattctgcgcgatgtgttcaccatgggtgcgcggccgatcgcgatgatgaacgcgctgcgtttcggcgatccgtcgcatccgaagatgaagcacctgatttcgggcgtggtgtcgggcatcggcggctacggcaactgcgtcggcgtgccgacggtgggtggcgagaccgatttccacccggcctataacggcaatatcctggtcaacgccatgtgcgtgggcctggcggatgccgacaagatcttctattcggccgccgccggcatcggcaatccggtggtctatgtcggctccaagaccggccgcgacggcatccacggcgcctccatggcctcggccgagttcggcgaggatgccgagcagaagcggccgaccgtgcaggtgggcgaccccttcaccgaaaagctgctgatcgaggcttgcctggagctgatgaagtccgacgccatcgtcgccatccaggacatgggtgcggcgggcctgacctcgtcgtcgttcgagatggccgacaagggcgatgccggcatcgagctgtggctcgacaaggtgccgacccgcgaagtgggcatgacgccctacgagctgatgctgtcggaaagccaggagcgcatgctcatggtgctgaagcccggccgcgaggacgaggcccggcgggttttcgagaagtgggagctggacttcgccgtcatcggcaaggtgaccgataccggccgcatggtgctgaagttccacgatgccgtggccggcgacctgccgatcaagccgctggccaatggcagcccggaatatgaccgtccctggacgcccacgccccagcgccgcccgatcgtgctgccccgcggccgcgacgatctggacgccgtgctgccgacgctggaaaagctgatgggctcgcccgatctcgcctcccggcgctggatctgggaacagtacgaccacatggtgatgggcgacaccgtcggccgccccggcggcgatgcggcggtggtgcgcatccacggcacgcagaaggcggtggcgatcaccaccgacgtcacgccgcgctactgctatgccgacccttatcagggcggccgtcaggccatcgccgaaacctggcgcaacctgaccgccacgggtgcgaagccgctggccatcaccgactgcctgaatttcggcaaccccgaaaagcccgagatcatgggccagctggtcggctgcatccagggcatggccgaggcctgccgggcgctgaacttcccggtcgtctcgggcaatgtctcgctctacaacgaaacccagggcaccggcatcctgccgaccccggcaatcggcggcgtcggcctgatcgccgacgtctcgcgccgggccgacatcgccttcaagggccgggatcacgcgatcatcgtgatcggcgagacccgcggccatatggggcagtcactctatctgcgcgagatcctgggccgcgaggatggcgagacccccccggtgacctgtcggtggagcgccgcaacggcgatttcgtccgcaccctgatctccgaaggcctgatcgacaccgtccacgacgtctccgacggcggcctgatggtggcgctggccgagatggcgctggcctcgggcatcggtgcgaagatcgatccaccggttttccaggcaccgctcgcctgggctttcggcgaggatcagggccgctatgtgatcgccgccccggcggccgcggccgatgccgtcatcgcccaggcctgggtgaccggcgtgccggccgcccagatcggcgtgaccggcggcaccgaattgactctgaccggggccggcacgatatccttggagacgctgcgcagtgcccacgagggatggctgccggggttgatgtcgacgccggcctgatcaccggcgggaccgcgctccggcgaccccggggcgcggttcagcgacacaaagatcgcgtgtgacgggagagacgcggatgccgatggaccagaacgagatcgagcgcctgatcaaggacgccctgccggatgccgaggtgctggtcgaagacctcgccggcgacggcgatcattatgcggcgcgggtggtctcttcggccttcaagggcaagacgcgcgtgcagcagcaccagatggtctatcaggcgctgcagggccgcatgggcggcgtgctccatgcccttgccctccagacctccgcccccgccgactgaggcgggccgccggccgggccagacggccggcgtccaggaatgacagcctttaaggtccgaggatatcatgaccgaccagtccaatccggttttcgccgaaatccagtcccatatcgacgccgagcccgtggtgctgttcatgaagggcaccgccgaccggccgatgtgcggcttctccgccaaggtggttcaggtgctgaactacatgggcgtgcccttccgcgacgtgaacgtcctggcggatggcggcatccgcgagggcatcaagcagtattcgaactggccgaccatcccgcagctctatgtgaagggcgagttcgtgggcggctgcgacattgtctcggaaatgttcgagaccggtgaactcagcgaatacctgaacggccagggcatcgatgcccgccaggtcggcgtgcgctgatcctgtactgacgacgtctgacgaccgaacggcccgcctctttcatggagaggcgggccgtttcacgtccggcatccggcgtcaggcgaagccgaagaccagaccgcaaagcccggccacgagggccagccacccgcccgccaccacccgccccgcccaggccgggcgccaggcgaagaggccggcggtcagcggcgcggcaaggccggccacgcccgcgacctcgaccaggccgcggccccagccgtcggtgaagacggcaaggccggccgcaatcaggatcagcccccagccttccaggcggcgccggaccggctggcggcggatcatcgcgccgcggccatgggcctgttcgtgatggcgcggcatggccagcgccagcgcggtggcggcagaggtgccgatgatcagcagcaggagcagcgggatcatgccgcccctccctgccggctgcgcaccctgaggatcatcgccaaccggccgagcgtgagcgcggtgacgaggcaggtgagctgcatgccccagaacacccgatcgccggcggccagggcgctgagcggatcgcggccggtgacgatcacatccgcgaccggcaccgccgcccagagaagcgcggcggccgcaacggcgcgcatccagccgataccatcggaccgccaggcccccgccagcagaaaggccagccagaccagatagaaggcggccggctccagctccgcccggccggcgagatcggccggcagcaggcggttggccaggaagtggccggcgatcgcggcagtcagcccgaccacgcagccgatgttcaacgcatcgaccagccggtggccgcgcgcgcggccggccgcaccggccttaggccggcgcttcaccgaccagagcaccagcccggttgcgatcatcgccgtgcccgcaaggccggcggcgaagaacagccagcgcagcggcagcccggcgaaccgtgcgagatgcaggccgtagagcgtgtgatgggtggcggcaaccgccccgcttcggccgcggccgtcatcgatcagccggccggtggtgccgtcgaagaccagcgcgtccggcaggcgggcaagctggtcggcatcctggggggtcagggtcagccgcgccgcggtcgtgcccggccgctcgacctcgatccgcccgacccggatgtcgcggccatcggccgaccatgcagcaccggccgccgccaccaccggccccagatcggtgagcggcgcgggccccgccggtccggcaggcgccgccgccaccgcgatcccgtccagatcggcggcatagtccgcccggccgcccggatagccggtatcgaccgcccagggcatatagagcagcatcagggtgatcagcccgctccaggtgatcatcagatggaagggcagcgacatcacgcccagcaggttgtgaccgtccagccaggtccgctgggccgcggcgcgggggcggaaggtgaaggcgtccttgaaaatccgcttgtggacgatcaccccggtcacgagcgccacccccatgatcatcgcgcagatcccgaccagatagcggcccgggatccggccccaatcggtcatgatcagggtgaagtggagatagaacaggaaatcgccgccagcggtctcggggccggcctcgggtgtgccggtgacaggatccagcctccgggcgacatagccgtgcggccgaccggcggccaccttcagcaccggttcccgcccatccgagacatcgatcagccagctgaccgcatcgggcgcttcggcctgaagccatgccgccgccaggcgcgcctgggtcggctgatcgggccgcgtgatcggcgccagccggtgcatccaggtcgagatttccggccggaaatagcaggccgtgccggtcaggaagatcgcgaacagcagccagccgaccaccagcccggcccaggtatgaagccaggacatcttctgacggaagctcatcgccagccccccgccgcggcgatcaacccggccagcaccgccacctcggccagggcgcggcgggggtcgtcgacggcgaacacccggatcaccaccgccacccagaccaggaaactgcccatgctgccggccagcaccgtctcgatcaccggccccggcagcagccggacggcaagggtggcggccagcgccgccaccagatagccgcccggccccgccgccagcaggcgcaacccaacgccccgcatggcgatcaccacttgtacttcagggtccccagcaccgtgcggccctggccccaatagcactgcttgtcgacctcgcagcccgagacataggtctcgtcgaacaggttggaggcattgaccgccagctcgacgccggtgagcgccggcgacgcccggccaagatcgtagctgactgccgcgtcatacagggtgtaggacggcaccttcagggtgttggtgtcgttgccataggtgctgccgacatagcgcacgccggcccccagccccagcccctcggcgaagccagcctggaaggtgtagcgggtccagagcgccgcggtcacctcgggcaccatggtcgggcggtggtgaagatccagctcggtgctcttggtcacctcgctgtcgagccaggtgaacccggcctgaacatcccagcccgaggccaggctcgccaccgcttcgagttcaagccccttgttcgtcacctcgccgatctggcggtaccccagccccgaccccagagacttcggaacattggtctgcgtgatctggaaaaccgatgcggtgaacatggcattccaaccgggcggctgatacttcagaccggcttcgtactgggtgccgcgactgggtttgaaggccgcgccggtcggcgtggtaccgctctgcggctcgaagctctccgaatagctgagataaggggtcagccccatatcgaaggcatagccgaggccgatgcggctggtgaaagcctcatcatcctgcgacgtctcgccgggggtgcgacgatccttgacccggctgtccgcccgatcatagcgaccaccgaggttgacgatccagccgcccatccggatctggtcctgcgcatagaggccccactggttgcgtcgcgtctcaagattctgatagatcggcggctcgcccgcgaaggtggcattgccaccctggggcagcgtgatcgaactcacctgggcaaagcgccggatcgtgtcgctgtcgtggcggcggtattcgaagccggtcagcagggtgtggtccagcggccccgtggtgccgtcgatctgcacctggttgtcgaccacatagacgtccgatgactcgcgcgccgcaaaggcgttgcgatccagcgtcacgccatccgactgaagtgcccggatatagacggtcgcgaaatccagccggttggcgatatagcgggcgttctgacgaaaggtgatcgcatcgtcgaagcggtgctcgaactggtagcccagggtatagagatcccggtcccaatggccgtaatcggtgtcgccggcatagaagctgcgcggcagcttgccatagggcgcatccttcagcgtgccgacgatcggcagcatgttggaaaagccgccgtcgacatcgtcgcgctgccagctgccgagcagggtgagcgtggtgtcgtccccggcccgccaggtcagcgacggggcgatggcggtgcgctcctgatcgatgccgtcgacctggttgtcgctttccatcatcaggccggccacccggaaggccagccggccgtcctcgaccagccggccgccgatatcggcgccggcttcatggcggccgaagctgccgccgcgcagcatcacctcgttcatcgcctggtcggacggggtcttgctcacccggttgacgataccgcccggggtgttctggccgtagagcaccgaggccgggcccttcagcacctcgatccgctcgaacatatagggctcgaagccgccgaccgcgaaattggcgccgccgaccttgatgccgtccagatattcgttcgacgaggcgccataggtgccatcaccaccgaagccgcggacctggatattgtcgccgcccggcatgataccgccggcacggccgccgacgcggacaccggcggtataggccagcgcctcgccctcggtggtgacggcgcgggccgacatctggtcgcgagtgacgaccgacaccgattgcggggtttccagcagcggcgtgtcggtcttggtcgcggtcgcggtacgggtcgcgacatagccggtcacgggccccgtcgccacttcggccgttctggccgcgccgacctgaagcgggtcgagcacggtcgccccctcgcctgccaggcgctgcagcaccaccaccccgtcgggcgtgatcgacccggtaaccggcgtgcccgccagcagctgcgccagccccgccgccggcgtcatccggcccttgaggccgcggctctcaacgccgcgggtgacggcggtatcggcagagacctgcaaccccgcctgtcggccgaaggcgccgagtgcgcccgccagcggctgttccggaatgtcgaagctgacctctgccgaaagatcggccgcctcggcccgggtgatcaccataccggcaaccagccccgcgctccccacagccatggttcccggaagcgtcgcgaccgatgccgcaaccatcgctgcgacgccctgcggcaccttccggcggcgctgctgcccctggcccatccccgtctccttcatgttctgcccgatccgttatgcgagtgcttcgcattttcaggacaaacagacgcggagccgggacggattttccgcagggaccggcatttttctgagaaaaagacgtcgcttctaccacaaggggttgcgggttggtattcaggcgccgtcgaggatggtgagcagcgtccccacccggcggatccgcccgccatgggcccgcatcagcgccgaaagcgccgcctgcggatcgcgcaggtcgtaaagccccgtcacctcgcggtcggccagggcatcatccgccacgatgatcagcccgggggtataggcccgcagccgggctaccacctcgccgaccgtcgccccgtcgacgaacagccgcccgtcctgccagagcgccacggcatcgggggcgatacggcctcggatcggggcggagccatcggttgcaatctcgaccatctctcccggggagagctgcacggccgaaacaccgggaccctccacccggacggtgccgctgcggacggcgaccgtcacccggtcgtcatcgcggtcgacctcgaaccccgtaccggtgaccgtgacctgcaccccgccggcctgaaccacgaagggccggccggcatcggagaccacatcgaagaaggcctcgccgcgccgcaggatcacccgccgatggttgccgtccagctgcatatcggcggccgagagcggggccagacgcatgcggctgccatcggcgagcgtcaccagccgaagctcccccaccccggtcgcggcatccgccgtcatccgcagggccagcccgggcagcagcatcaccgcaagaccggccgcgaccgcaagaccggtaagcccggctgcccagcgcccacgccgcggccggcgggtgaccactcgcggcggcggcgccatcgctgccagcccctcaggcaccgccagccagctgcgacggacctcggcaaaggccgcggcatgggcgggatcggccgcacaccaggcccggaacgcccggccgagtgcctgatcacccggtgcggcttccagccggaccagccagtccgccgccacagccaaaaggtccgcggatggtcttgtgccggagcgggtggtcatgccccgtcctcgtcgcgcagcgccagtgtcagctgaacgaccgccccctgtaccagccggtgggcggtggtcaccgagacacccaggtgatcggcgataccctgcaggttgcagccgtccacgcggtgcatcttcaacgccacccgctcccgctccggcaggctggcgagcgccgcggccatccgccgggtctcgtcccgatccagcagcccctgatccggggccggcagttcggccggggccagccagtcggggcggtgctgcaggcggttgcgatcctcggtctggcgtctgcgggtgacatccagcgcaaggttgcggacgatgcgatagagatagcccaccggctgcgccacccgcccggccgccaccccatccgcggcgccgggggcgaagcggatataggcctcctgcacgacatcctcggcgcgcatgcgatcgcccacgatcggcgtcgcgtaatccacgagcgtcgcgcggtggtcgagaaacagtttgagcctgggatcgtcgtcgcgcacggcgcctgcatgccttccggggcggaaacccgatgcggtcgcatgctagtcggattgcgaaccggtcgcaacaacaacactctcccccacggggctccggggtgccagcaccgcagcggcgcgggcgatgcgcccggtcaggtcatcccgccgccccgccggaacatagccgatcagcgaggtggcgatgcccagatcgacggcggcgccgaactggtcgtcggcgacctctccaccggcccagagtgccgcggcaccgcggaacatgatcgccagctgttcgggcagggccccgaccgccagcggccgcatggccggatcgatgccgtcatgatcgccaagcgccaggatccacagggcccgcgatcgccggcggaattcctcgggatcgccggcgctgccgccaccggctgcgggcccgcccgccaccagcgtgccgatcagatagcgatgcacggccggccgctccagccagaccgcgcagcccgcctgccccatcatgaaggtccggtcgatggcatcgcccgcacccgcggcgctgtccgcaacatagcgatcggtgatcgcgtcgaacatgcgctgggccaggctgcgcagaatgcccgtcttgctgccgaaatggttgaacggggtcgcgaagctgacccccgcctcctcggacagcgcgcgcatcgagaaatcgggcagatccccggccagaagcagccgttccgccgcgttcaggatttcctcccgcgcgaaggcccgcttgcggtccgcaagccgcatcttgccggatgtcgcagccaccctgccctccctttcggccggtctctccatcccctgctatgcaccatggcggtgacgccggcaaggtgcgatcagatttatatatcgtgatataagaatcatattgtgattcaattcatcctcgcgccatcatgcctcctgaccggccccagcagagcgccggcataccagggaggacatgagatgaccgcagagagaccgatcctgatccgcaacgcccggcttctgaccatggccgacggcagcgacgagacgagtggtgacgttctgatcgcggacgggatgatccaggccgtcggcgggcggatcgatcatccggatgcgaagatcgtcgacgccgcaggaggcatcctgatgcccggcttcgtcgatacccaccgccatgtctggcagacccagctgcgctccgtcgcggcggactggtcgctgttcgactatttcgtccgtatgcggatgatctattcggcgttctatgcgcccgacgacgtctggttgggcaaccatatcggcgcgctggaagcgctgcatgccggtgtcaccaccatggtcgaccactgccacatcctgaacagccccgaccatgccgatgcggcgctcaaagggctgatcgatgccggcgggcggggcgtcttctgctacgggctgttcggcaatccgcgcggccatgatccgctggtggccgagattgcgccggactggcttgccgccgatatccgccggctgcgggccggcacggatttctcgggccaggaccggatcctgttcggcatggcgcccgccgaggccgaggcgacgcccctgcctcatcttctgggcgagctgcaccttgcgcgcgagcttggcgcccacagcatctctttgcatgtcgccatgggcggttacgatcagggccaccgcgtggtgcagcagctggccgatgcaggcgcgctcggccccgatctgctgttcgtgcatggcgccgccctgaccgcggctgaacagtcggcgatcgccgaagccggggccgggctgtcggtgacgcccgagaccgagatgcagatgggcatgggccatccgctggccttcatcgcgcaggcggccggcatccgcaccgggctcggcatcgacatcgtctcgaattatgccggcgacatgttccggcagatgcggctgatgcttcaggccgagcgcgcccggcgcaatgcggcactggaagcccggggcggcgcaccgcggcagatcacccccaccgcccgcgaggtgctgcggatggcgaccctcggcggtgccgaagccctgcatctggaagaccgcatcggctcgatcgcgccgggcaagcgggcggatctgatcctggtgcgcaccgacaccatcaacatgtgcccgacgatcgatgcggtggcggcgatcgtgctgaatgccgcaccgtcggatatcgacatggtcatggtcgacggccgggtcctcaagcgtgacggcgccctgaccggcatcgactggccggatctggccggccgccttcaggcatccgccatgcggatcactgccgcggcggatcgggtggatcgcgggccgatcgaggcgatggccgcgcctcttttcgccaacctgacctgaccctggacgtgacgacggcccgtccccattcggggacgggccgtcgtcatcgtctgaaccgatgccggatgatcagccgatcgccgccagaccacgggcgagatcggcttccagatcggccgggttttccagaccgatatgcaggcgcaccggcacgccgggcccggtccagccgcgcaccgtctccggggcctgcggcagagccaggctctcgaacccgccccaggacgagccgatgccgaacaggcggagcgtgtcgacgaagcggtcgaccgcgctcaggtcgatgtccgggcgcatgccgatggtcaccagcccgttggacccgctgaagtcgcggcgccaaagatcatggcggggatggctgtccagcgccgggtgcagcaccctctcaaccaggggatgaccctggaggaagcgggcgataccgagcgcgctggccgcatggatcggcaggcgcgcggcaatcgtgcgcaggccgcgcagggtcagccaggcatcatccgggctgacggtctggcccatcaccacctgcatccgccacaactcgcggcccagctcgccattggcgaccacggcaccgatcatgacgtcggaatggccgacgacatatttggtgccggcaatgaccgagatgtcggcaccgtgcagaagcggcttgtgcagcaggcccgacgcccaggtgttgtcgatcaccagcagggcgttgtggtcatgggccagcgtcgagagcgccttgacgtcgatcaggtcatagacccacgagccggggttctcggcatagatcatccgggtggccggggtgatcttcgccgccgcatcctcgaccgtgccgtcgaaataggtcgatgcgataccgcgcggctccaggaatttcgaccggatggcatggacctgcggatagaccgtgttctggatcagcacatgcgatccgggcagcaggcaggtcagcaggacatgggcgatggcagccagccctgtcgggaagagcagcgcccgctcccccccttcaagggcggcccaggcctcttccagcgcatgattggtcggcgtgccgcgggcaccatagctgaacacccggctgccatcctcacgccgcgccttgttggcgcgcatggtggcgatgtccggggcgagcacggtggaggtgcggacgaccggcgggctcaccggacgcacaccctccatcggctggctgcgacccagatggatcagccgggtctcttcagacagctcacgatccgcgctcattcacgcattcccttccttgacgtcatggccggcgccgatgatggcgaatccggcccgctcgcgatcgtcgagcttggccagcagcccggtttcccaggccagatagcggcgcgcagcctccagattgccatcatggcgatcatggacgaagaacaggaagtcgatgcaatcggcctccgacggttcgtccggagttgccacgacgttgaagcccgccgctttccagtcggcggcatcggcggtcgcaagtcccgcgaccttgcggccgagcccggcaagatcgatagcggcgcagcgcgcgatgcgcggatcggccgcgatcagcacgatgcgggcatcggcggccagatcggccacggccgcggccagccgcggacggatcgcccagcgggccccctcgacatggccctttcggaaggccatgcccgggcggaggtcgatcagcgccaccggcgcgccgccatcggcctgcatagccgcaatctcggccgggcgcagcaccaccagcgccggcagacggcccgccgcctcttcgtggccaaggccagaggcgccgatccggccccagcccgaccggccaccttccagcaccgccacatcccagcccatgcgcttcagccagttggccacgaccgccgagcggatgccggtgtcgcaggtcagcacgacgcgggcattgcgcacgcccagccactggtccgaggcctggatcagctggccgcccggcgcatgcagggcgccgggcgcatgatgcagctcgtattcctcgggcgtgcggacgtcgagaagataggtggtgcggctggcatcgcgcagccaggcgccggccacctcgggcgagatgaaggtgatgccgttgaccgcggcgaagcccaccagccagtccgcggcctcgtcattgccgtcgacggcttcgggatagagccggtcgctgccatgctccagatcgaaaccggccaggcgccagccctgggtgccgttgcgcagcgccaccaccgggttgggcacgccgacatcgcgcagcgtctgggcgccgatgatgctgcgggtccggccggcgcagttgaccacgatccgggtcttcgggtcgggtgcgatgctgcggatgcggtgcaccagctcaccattcgggcagcagatcgcgcccgggatgttcatcttgcggtattcatcgaccggacggccgtcgaccaccaccagatcctcgccgcgcgccagtgccgcctgcagctcttcggccgagatcgagggggtgtcgagttcgtgctcgaccacttcaccgaaggtcttgctgaccacgttcacgccggcgaacagctcgtagccggccgcggcccaggcggcgacgccgccatccaggaccagaacgttgcgatagccgatcgcccgggcgcgggcggcggcacgcgccgccacggtcgacaggccgtcgtcatagaccacgacccgcgcggccttgttcggcaccagccgctcgatgtccagctccagccggctatagggcagcggcacggcatagaacagatgcgaccagccgtactggccatgctcgcgcacgtcgagcagcgcgatctcgccgccgtcgtgaagcgccgccttcagatgggcggcggtgatcacgccctcggccggggtgtcgtcgaccggcgccggcggcaccgggatcgagcgggtcggcacgccgaggcccatggtcttgcaggtgccggcggccagatcgaaggtggtgcggcccgacagggtctccagcgcgcggccgtagaaatgcagatggcggatgatctgctcgccctcgatcaccaccgaatggatgtcgtcgggcagaagcgccacgccccggccggggccgacctcgatccgcccggcctcgaccagcgtcgcgtggcccggcacggtaccgtcatcggtgcgctggtaaaggcggttgacctcgaccccatccaccgcagccacgcaggcccaggtggtgtggtcgtgcggggggatcagcttgcccgggcgcatcacgttcagatagagcgcgaaaccgtgatcgctgtcctcgcggatcatgtagcgggcctgacgctcgccctcttccggcggcggaaaatccgcctcggaccagagttcggcacgggccgccagggtcttcaggcggtccagcacctgggcgagagctgcccgggtcagaccttcggcggccaggatctggcgcgcttcggccaccatcccgtcggcgagaatccggcgacgatcgatcatccgcgtattccttcttccttcccgttcagcgccctgcccgacaggcagtgcgttgcatctctgcaggctagcgctaaactcattccgaaaataacgagttatcccgcgattcccatcaggaacgcttatgattaacttcgacctcgccgcccttcgcaccctggtcgcgatcgccgatcaggagaccttcgcccgcgccggcgaaaccgtgcaccgcacccaggccgccgtcagccagcagatgcgccggctggaggatcagctcggcctggccctgttcgaacgcagcggccgcaccaaggaactgaccccctcgggccgcaagctggtcgactatgcccggcgcatgctggcgcttcaggaagagaccctggcggcgctgcatgcggtgaccaccggcggcccggtgcgtctgggatcgcccgccgacatcgccgacacggtgctgcccgagatgctgcgccgcttcgcgcgggcgaacccggccctgtcgctggtgatccatgtcggccgcagccccgacctgatggagctgctgaagaagggcgccatcgacctcaccatctccacccgcttcgacgaaagccggcgccatttcctgctccgcacctcgccggtggtctggatcgcggccaacgacttccgggtcgacccgaaccgccccctgccgctggtgctggccgacgagcccagcatcttccgcaagatcgcgctcgcggcactggagcggagcggccggacctggcacgagcggtataccgccccgggcctcgccggcatccgtgcggcggtggcggccggcctcggcatcaccgcccgcagcatcgaggcgctgacgcccgaactccgggtggtgggagaggccgacgggctgccgccgctcggcaacatccgctactacctgtatcagcgcgacgatgcggtttcagaagcggccaagaacctgttccggttgatggccgcccgcggctgagaccccggcccggatctcaggccttgcggcgccgcgtgatgcggccaccgatcagcggccatgccacaaaggcgatcgccgccaccatcagcacgcccgagatcggccgctcgaagaagatccagggcgaattgcccgaaagcgacaggctctgatagagcgaacgttcgatgaccggttccagcaccacgcccaggatcagcggcgagagcgggacatggagcttgttcatcaggtagccgaagatgccgaagcccagcgccacgaccacgccgaaggtgctgttcgcgaccgaataggcgccggcgatgcagagcagcgccaccgccgcccccagcatgccctgcgggatgcgggcgaccagccccgggatggcccgggccatggcgagacccagcgggaacatcaggacgttggccaccacgaaggccacgacgatcagataggcgatgtcggggctgtcggtgaacagcgacgggccggggcgcagaccctggatcagcagcgcgcccaggaacagcgccgaggtggagttgccggggatgccgagcgaaagcagcggcaccatcgagcttgcgaccaccgagttattggccgcctccggcgccgcaacgccttccggcaggccggtgccggcctcaggcccgaagcggcgggcgacgcggccataggccatgtagatcgccatcagcatgccggcgccgggcaggatgccgatcacattgccgatcgccgaggcctgaacccaggtcggcagcaggcgacggatcatcgaggccggcagcagcaggtcgcggaagcggacaccggcggtggccacctcggccgccttggccgaggccgggttgcggcggcgcacccaggcttcctctgccatgtcgagcaggctggcgatgccgaacaggccgatcagcatcggcaccagcggcaggccgtcatacagccagggctcgtcgaaggtgaagcgcggatagccgctctgcgggctgaaaccgatcgtggcgatcagcaggccgagcacgcaggcgatggtgctgcgcaccgcattgccggtcgccatgccgatgacggtcgacaggccgagcagcgccagcgcgaaatactccggcgggccgaagcgcagcgcctgttcggcaaggaaaggcgcacacagcagcaggaccagcgcgctggtgatgccgccgaagaccgagctgtaggtggcgatgcccagcgccagaccgccctgccccttgcgggccatggcattgccgtcgatcgccgtcaccaccgatgacgcagtgccggggatcttgagcaggatggccggaaaggagccgccgaaacaggccgagcagtagatgccgaccagcagcggaaaggcgaggtcgcccggcatggcgaaagtgatcggcaccagcaccgccagcgtgatgctgtcgttcagccccggcatggcaccgaccaccaggccgatgatcacgccgaagaccaggaagccgaagaccgcgggctctgccagatgcagcagggcgggaaggatctgatcgatcatgtgcaggggcctcccgggtcagccggtgatcgagggcaacggcacgccaagcagcacaccgaagaccagacggatcgccgcggtgaaaacgatcgcggtcaccaccagacggatcgacagcgggtcgcccagcagccgcgcgatcacgatgaacaggatgaaggccggaagctcgaagcccgcaggctcgaccgccaggatcaccagcccgatgccgagggcgatggcggccggcaggatctgctggcggagcacgaagtccgaggccttgcggccggcctgtggcacgaagagcagcagcccgcagaccgcaaggatgccggcgaaaagctcaggcgccagtgccgcgatcgaatcgtagccggatgtctcgaaaaagacgaaagccgcaagtgccagcgaagcggcaccgaggcagatctcgggcagtctgctgcccgatgctcgtggcatgacgccgtgtccctgctgaagtcggggtgcgcgggatcaccggaagtggcgatcgcccgggaaagaggtggtgcgaccggcgggccgcggggggacggggatctccgcgaagggaggggcctcggagatcccctggggggaggtggcgccgccggtcacaccgtctgggccggagattattccggcttcttcagcgtggggaggatttcctccatcaccacggcgaccttgtcgacataggtcgagaaggcatccgggccacgataggcgatcgggtagccgcccttgttcatgccttcgacgaagcggggatcggccaccaccttctcaagggccgcggccagcttgtcgaccacctcgcgcggggtctcggccggcacggccaggccgcggaaggtcgccatgtgatccagcgccggcaggccgacctcggccagcgtcggcacgtcgggcatggcgggcacgcgctcttccgacatcacgcccaggatcttgatccggccgtccttggcattgctcagcgcctcgcccatcgagacgaaggcggcatccacatgaccgcccatcacctgctggaactgcatggcggcgctctcgttgtggatgtagttgaactgcgcgccggcttccttcgcgagcaccagggccgcgatgtgatgcgaggtggaatggcccggggtcgcgatgctgaccgcacccgacttcgacgccttcaccagatcggccacattcgcaaaagccgagtccgacggcgcgatcaccacctcgggatccaggcagtacatcgccagcgtctggaacgacttgtaggtgtagggggtcttcttgacgatcgggttgttgatcaccgacgaggtataggcgagcacggtgtagccgtcgggcttcgcccgcgccacatagctctggccgacgacggcgccgccgccgggcatgttctcgacgatgatcttctggccgcccagatagtccgagccgacctcggcgatcagacggctggtgaagtcgacggcaccgccgggcgagaacggcacgatgatccgcacgttcttctcggggaactccgccttggcggcaccgccgagaccgagggccagcacgccgcccagaacggcggtcgccaggaatttcttcatctctctgccttccctgtgagcgtcccggggacggcctgatctgcatccccgcttccccgggggatgcgacgtctgccgggggtcggggagatcctatgccgttcgcagcgtcagaaaaaattcaaaaaaacacggaatcaataagctttcatgatgatttatccaccgaataccctcaggttgtgacatgtcgggagaagtttcccctgaggatacggacaataccgcgcccgatgatgcgcctcaccgtgcaatcgcatgtcgaatatccatcggccatcgagcagaaccgatacaatatggttgtattactttcatgtgtagcggaagcatacccgccccctcagacaaccgtttcatacaaccattagtaaattttctaagcttttccccaatcccttacttgacgctccggtgccgaaaccgcatcctcggtcgggacggcagggagggatgacgacacgccttgtccgtcgactgggtaaccggcttgacttgggcgggccccgtctcggacgggtgcccgccatttttcgtcaccgatacccctcatccgccccgagggtcttcctgagacacagtgtgggtcgccgccgcggcggggctctcacggccctctatgacggcaatactggcccggccggtcgccaccagtctgggcgtgccgtcttccgtcagcacgtgaacgcgcgcttccacggcggtcagccgacggcccggtttcaccacccgggcatccgccaccagccggccgccggccgcggcggccagcagcgagacgccgaaatccgccgtcatcaccccatggcccagaggcaccagcgtggcggcggcacaggcgcaggcattgtcgatcagatagccgatcaccccaccatggaacacgccgtggttctgcatcagctcgggccgggcggcgatttcgatgcggcagcggccgctgccgagggctgtgagttccgcgcccagatgcgcggtgaagccctgtgccgccacaccggcgcggacacgcttttcctggatgtcgggcaggggggcgtccggcagggcagcccaggggttgaagccatcggtggtcatcgggcgcagctctccttggtcggcggggcggcttcgtccggccgcttccgcatatggcgatcactccggccctcagattaacccgaacgggatccgccgtccggcggcatgcgcgctcccgtgcgacagaatgccgccgcgacagtctgtcgattgcatgcgcggtcacgcatccgcgatagtccgcgccatggcgcgatgcagcaaaacagcccgatcacgggcgcaccgtcggttcggttccagccccatcacgactgcggtcgtggtggctctttgtgctgggccgatgacggatctgcatgcgcaggcaggatcgtctccacattcgggacccgccctgccgcatcgccacatcccaaagctgccggccatgacgcggcccttgtcgtcgcgcatgaccagaacgacggcacccaagaaataccgtgaggtcatgagatggcttcttccatcagcgtcggcgattgccgcccgacagcatcaccatgtcgtcaggcacaagagattctgatgtcgacatcagaagaatccggccatctctcgatgcaggggcattcggaatgactgcgacgacagccgtggcgggccatgcccccgccatatccacgccggtgagcagtgccaccatcgccggctataacgaagcggtggtccgccgcttcgccatcgccaccgtgttctgggcggtgttcggctttgccgccggcacctgggtggccctgttgctggccttccccgagctgaacatggggctggaaggcagcttcggccgcctgcgcccggtgcacaccaccgcggtcgtgatcgcctttgccggcaatgcgctgttcaccacctcgttctatgttgtgcagcgcacctgccgcaccggcctctggggcggtccgcggctggcgaatttcgtgttctggggcttccaggccttcctggtcatggccatcgtgggctatgtgctgggcgttacccagagccgcgaatatgccgagccggaatggtatgccgacatctggctgaccatcgtctggctggcctatatggcgatcttcgtcggtacgctggcacgccggaaggagccgcatatctacgtcgccaactggttcttcctggcctacatcatcaccgtcgcggtgctgcatgtggtgaacaacctggcgatgccggtgtcgttcgtcggcgccaagagctattcgaacttctcgggcgtgcaggacgcgctgatccagtggtggtacggccataacatggtcggcttcctgctcaccgccggcttcatcggcgcgatgtattatttcgtgcccaagcaggcggagcggccgatctattcctaccggctgtcgatcgtccatttctgggcgctgatcttcctctatatctgggccgggccgcaccacctgcactacaccgccctgcccgactgggcgcagacgctgggtgccgctttctcgatcatgctgtggatgccgtcctggggcggcatgatcaacggcatcatgacgctgtcgggcgcctggggccgcctgcgcaccgatccgatcatgcgcttcctggtcgtggccgtggccttctatggcatggcgaccttcgaaggcccgttgatggcgctgaagccggtcaatgcgctcagccattataccgactggacggtcgggcatgtccattcgggcgccctcggctgggtcgccttcatgaccttcggcgccttctactatctggtgccgcggctctggcgccggccgctctggtcgatgcggctggtggagtggcatttctggatcgcctctctcgccatcgtgctctacatcaccgcgatgtgggtctcgggcatcgcccagggcctgatgtggcgcgcctatgacgagttcggcttcctgcgctacagcttcgccgacagcgtcgccatgctgcacccctattacgtcacccgcgcgctgggtggggtgctctatctgaccggcgggctgatgttcgccttcaacatcttcatgaccatccgccagcccgccccggcaaccctgccgggtgcgcgcgatgccgcgcctgcgcgtggcgccgcgccggctgcgggttcctgaggcggagggtcggagacatgccccgtttcaatcacgcccgcatcgaacgcagcacctcgctgctgttcatcctgacgctgatggtcatctcgatcggcggcctggtcgaaatcgtgccgctgttcaaggtggaaagcacggtcaagccggtcgaaggggtccgcccctatacgccgctggagcagatgggtcgcaacatctacacccgcgagggctgctatacctgccacagccagatgatccggccgttccgcgacgaggtggagcgctacggccattactcgatcgcggccgaaagcatgtacgaccatcccttcctctgggggtcgaagcgcaccggccccgatctcgcccgggtcggtctcaaatactccaatgaatggcaggtggcgcatctggtcgatccgcgcagcgtcgtgccggtctcgatcatgccctcttacgccgctctgctggaccgcgacctggacgtctcggaggtctcggaacatctgcgcgcgctgcgggccgtgggtgttccctacagccaggagatgatcgcccgcgccgaagccgatctcaccgcccaggcaaatggcaccgatccggaagagatgcagcgccgctatccgggcgcgaaggtcggcgactatgacggccagcccgaccggatcaccgaaatggatgcgctggtcgcctatctgcaggtgctgggcaccatggtcgacttcaccgatgtccggctggaaagcggcatcggtgccggcatcgccggctcgaaagtggagggcggacagtgatcgatgcgctgagtgcccttgtctacaagtactggctggtcgcggcggtcgtgctgttcgcgctgatcctgctgcgtaccttccggccttcatcgcgtgagcagatgaaggcgcatgccaacatccccttcctgatcaaggacgaagacgatggccgcgcctgaacgtgatgatctgaccggccgctacaccaccggccatgaatgggacggcatcaaagagctgtcgaccccgatcccgggctggtgggtcggcgtcttcctgatctcgatcgcggtcgccctgctctacatggtgctctacccgtccttcgcgtcgaccgagcgctattacgagggcgcgctgaaatacagcagcaccgaagagctgcgcaaggaggtggtggccgcccgcgcggcccaggcccccatgcgcaacgccctggtcgaaaccccgcttgaggagatcgaggccgacgacgcgctccgccgctttgccaccaccggcggccaggcggccttcaacgagaactgtgccgcctgccatggcgtgggtgccggcggccagatcggccagttcccggccctggtcgacgacgactggatctggggcggcaggatcgccgacatccgccagaccatcctctacggcatccggtcggcccatcccgacacacgccagtcgctgatgccggttttcggccagatcctgacgcccgagcagatcagccagacggccgcctatgtgaaggccctgtcggatccggccgcggatgccacgcgcagcgccatgccgggtgcccccctgttcgcggccaactgcgcctcgtgccacggggccgagggccagggcggccgtgatttcggtgcgccacggctgaacgacgcgatctggctctatggcagcagccaggaggcgatcgagcggcagatcgccaatccgcgcatgggcgtgatgccggccttcggcgaccggctggacgaatcgaccgtgcggatgatcgcggtctatgtccacacgctcgggggtggcgagaaatgaccgcaggatccggcatcacgcatgcatcggtggccgccaccgatgccgcggccgcaacggaccggccggggcgtgcagccccggccgcccgccggccgcggcgcaaaccccatctgccccagccggtgcgcggccatttccgccgcctgaagacccggctgaccgtggtcttcctgggcattctgttcctggtgccgtggatccgctgggatcgcgggcccggcctgcccgatcaggcggtgttgttcgacctgcccggccggcggctgttcgccttcggcctggaactctggccgcaggatctgccgatcgcggtggggctgatggtcgccggcgccttcggcctgttctatgccaccagcctgtcgggccgggtctggtgcggattttcctgcccgcagacggtctggaccgacatcttcggcggcgtgcgccggctggcgcaccggatcgcgaagggcaacgaagccgcgatcgggccgctgaccggcgccatgagcgccgccgtcgccatcctgaccggcctgggcttcgcccagtggttcgtcgacgccccgggcctggccggccgtttcctgggcggcggcctgcccggcgccgtctatggcgcggtcttcctgatcgcgctgttcacctatgtgctgggcgcccatgcgcgagagcgggtctgcctgcacatgtgcccctggccgcggtttcaggccgccctgctcgaccgcgacagcctggtcgtgacctatcgccggacccgcggcgagccgcgcgcccgcaagcgggtggcgctgcgtcccgagctgctggcgacgcccttgcccgcgcccgcgaccgatacgccgcaagccttcgcctttgccgccgacggatcggtcggcctggcgcccgacgcgaccatggccgcgacaccggccggccgcggcgactgcatcgattgcggccgctgtgttcaggtctgccccaccggcatcgacatccgcgacgggttgcagatgggctgcatcggttgcgggctgtgcatcgatgcctgcgatgaggtgatgacgaagatcgaccggccgaccgggctgatccggttcgatgccgaagaggccgacccgacaccgatggccccgccggcccgcatcggcttcttccggcccaaggcgatgatcttcggcggcgcgatgatcgtggcgctggcggcggtcagcttcggcgtggcgaacatcaccgacgtccaggtcgatgtcgagccgcagaacacgccgcgctatgtgctgctgtcggatggcagcgtgcgtaacgactacaccgtccgcctgtcgcaccgcctgccccggctggatggggtgaccgcctcggtcgagggcatgcccgaggcgacgctccgcttcaccagcggcgacggtggcgatgcggcggagatgacggtgggtggccagcgcagcgccgcgaaccggctgctggtgatccagccgccgctgcgtggcgaggccctgcccccggccgggccgcacccgatcgtgctggtcttccacgacacggcgacgggcgcggaactcgcccgggtcgacacccgcttctgggagccggagagatgacgtccccccgccacggctcacgacggtacaccgtcccctcggacccgccgccccggccgtcggatcgctggatcccgcgggcgatcgtgggcttcttcctggtgctgggttcggtccaggccggtttcgtgacgctggcctatgacagcttcaccggcctggtcaccgaagatccctatgccaccggcatcgaatacgaccgggtgctgaaagagcgcgagaccgaagccgccctcggctggcaggtggatgccgtcttcgagccgggcgatgccccccgcaccggccggctggtggtccaggtgaccgatgccggcgggcagccgctcgatgatgtggtcgtccagggcgaggcggagcataccggccggatcccgcagctcctgcccgtcagcttcacccccgccgggtccgacaggctggtcggcacgctcgacttccccaatggcggcaactggttcatccgcctgaaggtcacgcagggggatgagggggtgcgacgtctcgtcgaattgccggtgatccgctgaccggctatctctccccttgcccgcttctgctctccccttgcccgcttctctctccccttgatcgtcgaaccgatcgacgtccgacatcttccggagtttctgccatgtccatgacgacctctcctgccggcggcatctcgggtggccgaccggccgtgtggcccctgatcgtcgccatcatcgccgccgcggcgatcggcggcatggtcgccggagccgaagtggccgtcgttgccgggctgggcgccctgatcgtgtcgctgctgccgcggatcatcatgatcgccggccgcggcggtctcggtgccttcgcgattgccgggcgcgcgatgtacaccgcgggccggatcggcggcatcgccatcgccctacccggcctgttcgtcaccagcctggtctggctgatcatcggcctgccggcggcgctggcccgcgcggcccatgcccgggccggcaccaccggcgtccagcccgcccccctgccgaccctgccggatcttgctgttgcgggccggatgggccgccgggcgaagaccggtgccgtcagcttcctgaagggcatggtctcggagcgcggcctgccgctgctgctcgccaatcttctgctggcgctggtgatcggctgcgtgctgctgggcatgggcgtggcgctctacgccgccctgatcgcggtgccggtgatgatcgccaccatgatgctggtcgcggtcgacggcagcgacgaacccgaggtgccgtcctccgccgacgcccagcactgaccccgcccgcccccgcggagagccctatcatggcggtgtccgaactcacctttgccggcggcgccctgatgggtttcgccggcagtctgcattgcgcgggcatgtgcggcagcatcgccgccgggctgatgttctctttcgacggcgagggcggcacgcgcggccgcatcaaggcgctggctgccgcccatgccggccgggtgctggcctatgccaccgccggtctggtggtgggggcgatcggcacctcggtctatgccggcctcgaccgtgccggcggctatgaaatcgcccggctgatcggtgccgccaccctggtctgggtcggtctgtcggtggccgggctggtgccctccctcgcccgcctcgatcgcctggccatgccgctcaccgccggcatcgcccgggtgctgcgcccggccggcataggcggcggtatcgcggccggccccggcggggccttcgtctcaggcgtcgcctggggctgcgtgccctgcggcatggtctatggtgcgctgttctacgccatgatgaccggcagccccgaaggcgggctttcggtgatggcggggttcggcctcggcaccgtgccggccgtcgccgccacggcccttggctttgccgggctgcgccgctccgccgccctgcccggcctgcgtacggccgcgggcctcgccatcgccgcgctgggcctgctctcggccgccatcccctcggtcggcgccgcggtgctctgcctgccgtaaccgccgccggctccgtcactgcaaaacaagacaccccgccggtcgcccggcggggtgtcttgtatctggtgcctgagaacccgaaagctctccggacccggcaggatcagcgcgagtagtactcgatgatctgcttcggatccatctggaccggatagggaacttcggccagctgcggcatgcgattataggtcgcggtcagcttgtcgaagtcgacgtcgatgtactccggcacttcacgctcgcggcgctgggtagcctcgagcacgaaggtgagctgacgcgacttctcgcgcacgctcacgacgtcacccggcttcaggcggtaggaggggatggtcacgcggcggccgttgaccgcgacatggccatgattgatgaactgacgcgcggcgaagaccgtcgcgacgaagttcgcacgatagacgacggcgtcgagacggctttcgagcagaccgatcaggttctcggtcgactcacccttgcgacgggtggcctcgtcgacgacgcgacggaactgcttctcggtcaggttgccgtagtaacccttcagctgctgcttggcagcgagctgcagaccgtagtcggaaggcttgcggcgacgctgaccgtgctggccggggccatacgaacgtgcattcaccgggctcttggccgtgccccagagattcacgccgagccgccggctgatcttgtgcttggcctggatacgcttggtcatttgagagcgaaccgttcggtaacggggtagaccgcagtagaggatcggcactgaatacaggcgctccccccggatgtcaaagagaatcgcccggatttccgcgggtttcgggcccggcacgcacggccaccggccaggcacccgcagcgaccggcgccgggatcggccggatgccgaaagcggcctcgatcgccccgttctgcagcaccgcctgggacgtgtccagcgccagcagccgccccttcgccagcaccgccacccggtcggcatgggccagggccagccccagatcatgcagcaccacgaccacggtcatggcgccgcgcagcccctcgaacagctgcatcaatgacagagcgtgaccaatgtcgagcgccgccgccggctcgtcggcaagcagggcaccggccggcgcggccagtgcccaggcgaccgccgctcgcgcccgctcaccacccgagagatcatccagccgccggtccagcagctcccccagatcgagggcgggatccggcgccgccgggcgcccggcctgccaccaccctgccccgcgcgcagcccccagccggaccagatcgcgcaccgtcaggttccagtggctgcggaagccctggggcagatgggcgatcctggccgccacgccccgccggccgagcccggccaccggccgcccgtcgatcagcgcccggccggcatcgggtatgagcgcgccggtgagcgtgcgcagcgccgtggtcttgcccgagccgttcggcccgaccagagccagcagttcccccggccggacatcgaacgacagatcatccagcaccacccgcccgcccaggcggagcgtcacatggtcgagggcgaggcccgccgcactcatcgcacacctccgcgtgcccggccaagcagcagcagaaagaccggagccccggccagcgccgtcaacagaccgagcggcagatcggccggcggcagcagggatcgggcgaggccgtcgaagatcgcgaccagcgcccccccggcaagggcggaggccggcagcagcagatgatgcgtggggccgaccaggcggcgggccagatgcggcaccatcagccccacgaaccccaccagcccgccccagcccaccgcgatcgcggtgatggcggcgccggcaagcacggcaagctcggtgaagcggcggacattcaggcccatggcaccggccgcctcgtcacccagccccagccggtcgaggccgggggcgagcacgagggcgaggatcagggcgccgagcgtcgccagccagagcaggccgagccctgccatgtcgggcgtgtggatgccgcccatggtccagctcatcaccacctgcagattgaccgtgtcgtcggaaagcgccagcagcatcagcccgcgcaccgcaccgagtgcggccgcaaccgccacgccggccagcagcacgccggtgacgtcggcgatgccggcggcgcgtgcggccgcgatcaccacccaggtggccccccaggcgccggcgatggccagcaccggcagcgccagaccgggcgccaccggcagcggcaccaggagcgcgatcgcggcaccgacggcggcaccgggggccgtgcccagaagccagggctccgccagcgggttgcggaacacgccctgaaagatcgcccccgccagccccagacaggccccgaccgccactgccgccagcacccgcggcagccgccaggccagcagcagccgggtgaaggggctgtcctcgccacgcagcagcgccgccagatcggcgatccgcgccggctcggtccccagccagagccccgccaggatcgcgaccagcagcaaggcgatcagggcagcgaaggccctctgcgtcgtcatttatcaccctccgcaggcatgagacaggcgccgcctgcggcaaaggcatcgggatgaagcagccgggccagcatctccgccccctccaccacccgtggccccgggatcagcagcagcgcgcgggtgaccgcgtcgacccggccggcgcgcaccgcgcggattccgtcccagcccggccgctgcatcagggccggcacccgctcgggcgggcccgcgatcaggatcctgtcggggtcggcccgcccgaccgcctctcccgacacccgccccagccggtcgcggcctgcgaagacgctgacaccgcccgccgcgcgcaggatgtcgccggtataggtggcgtcgcggatggtgaaggcggcgccacgctcgtcactgccggtctccatatagaccggcacgggtggccgccccttcaggcatgcgccgagatgcgcgatccgggcgcccatggcgtcggcgaccgcggccgcggccgcctcacgcccggtggcgtgtcccagcagccggatattggccaggatgtcgtccagccggtcatgggtcagcaccagcgccggaatgccgatccggcccaacggatcgaccagccctgccgcggcctggcgcgccggggtcatcaccaccagatcggcatcgagccgcgcgatcgcctccaccgaaaatcccagccggccgccgatgcgggcggtgcgggcgaccagatccggcggccagcgcgtccaggcctcgatcgccacgatgtcgggcccggcgccgatcgcagccagcatttcgacattgctggagaagatcgcgacgatccggcgtggcggcgccggaatcgtcacggcgcggccgagcgcatcggtcacctgtcgcggccagccctcttccgccgccgcaggaagcgcggcgatgcaggtgaacaggatcagcagaagaccgaatacccgcgccatcagaagcgataggtcaggccgacataggccgcccgccccgcctggctgttgccggtgccgccgccattcgacgacaccggatcgcccagcgagggcacggtgtcggtggcgatgaacagcggatgatcattgacgtcgaacaggttgtcgacgccggcgaacagcgtcagtttctcggtcacgaaccagtcgccgcgcaggttcatcagccagctcgatcccttgcgatggacatagcggctgtcgggctccgcccctgccaccagactttcttcggtatcgtaatagagcgggccgcggaacacagccgtggtggtcaggctccacaccccgggctggccggtggtgatgccgagcgccgcctgggtttcgtgcatgcgctgcagcttgtcggtataggggccggagagggccgcatcggcccccttgtcgcgcatctcgaaattccacacgcccgaaccgcgcgcgatcagcgtccagccgtcccagcccaggcggcgggcgatgtcataggccgcctgcagctccagcccgcggatcaccgcatcgcccacggaattggcataggtccgctcatccggcccggtggtgacggtggtgatccggtcggtgatggtgttctggaacagcgccagatccaggaacagcggcccatcggcatgggcggcgccgatttcgtattgcaggctgcgttcgggatcgaggttcgggttgccgaaggtgcggccgccgccgacggcggtgaagtctgccgcaagctcggtgccggtcggcgcgcggaagccggtggcgacgccggccctgagggtcaccgtcggccaggccgcccaggcggcgccgacactccaggtgacatcgtcccagctttcagtgcgttccaccagcagcggctggttgggggtggccctggtcgaaacccggccataggtccagcgggcgccggcgcgcagggtcagcgcgtcgtcgaaggcccggtgcacgccctcgccatagacgccgaaatcctcggtatcctggttgatgtcatagggtggcacctgagaggtggccccgcccgagaccgactggcggaagcggtcgctgcgcagtttcgcggtctcggcatcgatcccaaacaacaggtcggtatcgtcccccaccgccagccgcggcgccagcttcagacccagaacgtcgagctggcggcggttgtcatcaaccgaaaaaccggccgtcccgttccgctgccgctccgatccccaatgaaagctgtcgacgtcacgcacggcataggcctgggccgaaagcccgagcccgccaccgaatgtcgtgtcccaggcaagatcgagcgaggcgttgcgccggtcgtcaacattgtccacatcccactgcgagccgcggaagccggcgtcgtagacaccgtcggtgcggagcgtcaggtcgatgcgcccgaccgtctcgttctcgaagccaagcgccgcaagcccgccgccgcgtttccaggccgtgttgacgagttgcccctcgggggtgtggtaatcatcggaaacgccgccgccgatgccgacgtagtggtcgaaaccggccgtgctgcccgcattggcggcatggccgcgggcaaggccgaaggatccggcacgggcggtgatttcgctgcccggatcctcggtggcaccgctgcgggtgaccagattgaccacgccgccgatcgcctgggcgccatagatcaccgaggccgggccccggatgatctcgatccggtccagatcgtcgggtgagagcttggagagattggcggtgccggcgcggcggccgttcatcagcaccgtcacctggctgcgccagtcgcggccctggccgtcggtcgcgccgccgcggatgttgaacgaggtctggcccgggctccagtcgctgaagaagccgaccgcgttttcggccagcagatcggtcaccgaccgggcggacgaccggcggatggtggcggtgtcgatcacctgcacggtgccggcggcacgggcgcggggctcgtcgcgcccctgggcggtgatcagcatccggtcgagttcggtggcatcctcggcccgggccgccttggggtcggcgatatcgggaagaagggcaacggagcacgagagggccagcacgccgaaggcgggccggcgcagaagggagaagcgcatgggctgatgatccggattggaggtcttgtgattggccgcgtcgtcggtcagtcgtgccagacgaaaacggcggagagtttgggcgcgcgggcgatgacgccttcctctgccggcatgagggcgagatcgagatggcggtccagccgccgttccaggtcgtcgaccacatgaccgcggcggtggagatgatcgagcatatgggcgcgggccgcggcgcgatcgggaaagagggcctggaacgtccagggcaccagatgcaccatgtcgggtgccagatcgcttccaagttcatcgagcgccagccggtcgcccggggtgatgtcctcaccatgaagatgggtcggtaggaaacccgccagacaccagctccgcggccccgcctgggccggcacgatccaggcgagcctgcggccgagcggccgggtccgggcatgcagggcgcgagccgcaccgatcggccccggaatattggcgcagagcaccagatcggcaggggctgccggatcgaagggggtgagatcctgccagacgccgtcgcggatatcgatcgagaggtcggggcgcgcctctgcgaccccggcgagccggccgcgcatatgggcattgggctcgatcgcacaccatcgcccgccgcgggcgatgaccgcctggccgagcagaccggagccggcaccgatatcgatcaggctgcgcgggcgcccgccataaaggccgcgcagcgcatcacccagattgcgggcatagtccgatcgggcaagctgatcggcgaagaaggcggcatcggcatcggcccacggggccggtgacgggagcgggggcggaccggcggcagcagctccgggcgtggcggacatcttgggcctcacctgcgtggcacgtcaccgcaggccggacccgaagcggctggacgccgttccggatcgccatcgatacaccccgaccgatgggcacgcgcgtgaccacgaatgacggcaggtctcctggctcacgggtcatcgccggtccgtcgccttcccggcagtcccggtaccggggccaccagtggcgtcgctgacggccggctcgccgtctacagttgcgggggcagccggggcatgatgcggatcaccgcctgtaccccgttcccttttgatccccaacggggaaccgtcgcgggcgacagtagtggagctgcccgtcaccggtcaagcagccccgtcgccctgatattgatacgatataacataacattattgaatgacgcaatgccccgacgccggcaccgccgggacattgttcagatgaagagatcgtcggcccccgcaaagcgtacgcccgccgccgtcatctcggcgcgtgcgcggccaagcgaaccgccggtgtcgatggcgcggcaggcatcttccaccagcaccacctcgaaaccggcggcgcgggcgtcgagcgccgtccaggccacgcagaaatcggtggcgaggccgcagacgaagacgcgtttgacgctgcgcgaccgcagatagccgtcaagcccggtggcgctgcgccggtcggcagcgaggaaggccgaatagctgtcgaccgcggcatcgtcgcccttgcggacgatcagccgggcatggggcagatccagatcgtcatggagtgccgcgccccgggtgccctgcacgcaatggtcgggccagagcacctggctgccataggcgagctccgtggtctcgaacggcgccttgccggcatggctggaggcgaaggaggcatggccggccgggtgccagtcctgggtcagcaccacctcggtgaacagccgtccgatccggttgaccaccggcacgatctcgtcaccgccggcgaccgccagcgcgccgccgggcatgaaatcatactgtggatcaaccacgatcagtgcatcaccggcgccggggcgcaggcgcagggcctcggcgcgcgcctcggcttcggcatgacgacggcgtgagcgccggggtcttgctgcctctgcgggagacgccgcagaatcggtctcgtccagcgcctcgcggcggcggcgataggacgggaaggcggcaagttcctcgtcgcgtgcgccacggatcatcagcccgtgcaggaagccgcgcagcgagcggacctcctgcccggtcagatccgcgcgcaggaacatggcctgcagattgcgcagcatggtcggccgcatctgccggttgcgcaccacccccgaccagtcgagtgcctggcccagatgctccaggaaggcatcgatctcctgcttgctcgcccggccatagcggccgagatcgagttgcaccggcacggtctcgtcgcgcgcggtgaaccattcataggagaccagcgccaccgcctgggcaagattgagcgaggcgaaggcagggttgagcggcacggtcagaatcagatcggcgagcgccacatcgtcattctcaagccccgtccgctcgggcccgaacaggattccgacccggccgccggcctcgacatgaccgcgcatgcgcgccgcagccgcgccgggcgtcgccaccggcttcaccatgtcacgcggccgcgcggtggaggccaccacgaaatccagatcggcgaccgcatccgccaccgtcgcatagacccgggcagtgtcgagcaccgcatcggcacccgaggccagcacccgcgcgcgttcgctcggccactcgcagcgcggtgccaccagacgcatgtcggtcaggccgaaattcagcatcgaccgtgcggccgagccgatattgtcggcaatctgggtgttcaccaggatgatggcggcctggttgccgacggcaccttcaatgccacgggtggcggccgctttgggcggccgctgctcggactgatcggtcatgcgctcatatatcttgttgctgcgaaggtggccggccgccggacgacgtatcctcaggcgacactgttggccgccgcgacctctgccgccgcctgcaccgacacgccggcacggtacagccgccaggtgatgccgtcggccagcgcctcgtaagaggcattgacgacgttagccgagacgccaaccgtcgaccagtggtcgccggcggtatcggcgctttcgatcaccacccgggtcaccgcatcggtgccggtgccatccggggccgacatgatgcggaccttataatcgaccagccgcatgtcgcgcaccggctgataggtctgggcgatcgcccggcggagcgcggtgtcgagcgcgttgaccgggccgttgccctctgccaccgccatcaccggcaccccgcccaccgagatcttgatcgtcgcttccgacagggtcaccaactcgccacgggcattgtagcgacgctcgtcgatcacccggaaggacagcaggcggaaatattccggcacctcgcccagggcgcgacgcgcgagcagttccaggctggcctcggcgccgtcataggcatagcccatatgctcgttggccttcacctgctccagcagggtgggcaggcgcggatccgacgggtcgacctcgataccgatctcggcgagccgcgccagcagattggcccggccggcctggtccgagaccaggacatggcgctgattgccgacctgttccgggcggatatgctcataggcgcgcggatccttgagcaccgcgctcgcatgcagcccgcccttatgggcaaaggcggcggcaccgacatagggcgcatggatgttcggcgcgcggttcatccgctcgtcgaaggcgcggctgacgctggtcagatgggcgagcccggcctcgtcgacaccggtcgtgtagcccatcttcagcatcagggtcggcagcagggtcaccagattggcattgccgcagcgctcccccagaccgttcagcgtgccctggatctggcgcaccccggcacggaccgccgccaggctgttggcgaccgcattgccggtatcgtcatggcaatggatgcccagccggtcgccgggcacgatcgtcgccacatgggagacgatttcctcgatctcatgcggcagcgtaccaccattggtgtcgcagagcaccacccagcgggcaccggcctgatacgccgccttgacgcaggccagcgcataatcgggattggccttgtagccgtcgaagaaatgctcggcatcgaacatcgcctcggccttgacccgtgcggcatggccgatgctgtcggacaccatgcgcaggttttcgtcgagatcgacgcccagcgctacggtcgcctggaaatcccagctcttgcccaccagacacaccgcctggaccggcgcgttcagcaccgcagacaatccgggatcgttctcggccgaacgccccgaccgccgggtcatgccgaaggccgagatccgcgcccgctgcatccgcggcagatcgccgaagaaggcgtcgtcggtctggttggccccgggccagccgccttcaatatagtcgatgcccagccggtccagttcacgcgcaatcgcggccttgtcggccgccgtgaaatcaacgccacgggtctgcgcgccatcgcgcagcgtgctgtcgtagagatagatgcgctcaccggacatggggatcgtattctccgtcgatcggctgttccgggacatgtttagcacccggaaccggccgatgcgaaacgtaaatacgcaggccttgtctgcgcagcctgtcgcggtcaggctttgaacagatccgtcgcggcaacaacattccgcgaattgggaaaggcggtctcctcaatgtccttggcgggcgtctgcagaaaatccgccaggacacccttgatcagagatcgcacatccgtaaccggcatcaagtcacgattctgataaagtgcgcgttctgcaagcccgggccattcaccatagacctgcccaccatttacgcgcccgccggcaagaaacgcgaagcctccggtcccgtgatcagtgccgccacttccattcacgcgcactgtgcgcccaaactcagagatacccaacacgacagtctgcctccaggcagatgctcccaatgtttcgcgcaactgcttcaagccgttggcaaaaacattggcggctgtaaacatgcggccgtccaccgtgccctgactgctatgtgtatcccagccaccagcattaacaatagcaatactcgccccatcgcggcgagcaagtatctcggcgactgagttaaaggcccggatcagcggatgtccatatacctgaacagaaccaatgcgacctgcttctcgtatctcgtccccaaaagaggcaaatgccgggtcattctcatagatcttggccaaacgttccacaacgtccaagccaggaactttgacatcaggcggcgggagattgacgatgcggggcgcaccaaggaggacagtagggataccaccgctcacggtagcagccgtcagctcctccccatgcgctttcatgatccggccgagccagccactgctgacttttgtcggatcatccagaccgctctccaatatagactgcccatcaaagtgcgaccggtcccggtattgtgaagatacagccggcaccaacaggagatcgccatccttgtaccaagaatggatcggctcgagagccggggtcagcccataaaaatcatccaaagacaacaaccggtcgcgcggaaaggcgagcgtggttctcatgtcagtgtaagcaggatcacctacaggggccagcaaaccaagcgcatccacggcaccacgcatgatcacgacgacaagacgccgacgctctcccgcagcctccgcagaagcgtgtctgttccaaaaaccaatccggaagctcgcactagcaccagcgaaagccagggtccgcttgatgaacaaccgccgagacagtgtcatgcattccctcacatcagcgcagacagaaatgtggtgacgcagcgatcaggccatacgcatccttcagtgtgggcgctcctcggatggttgcaaggacgtcaatcgaagcgttgcggaagtatatgctgagtgcggtatcaagatcatcacgacagttcaaggcttcatacatgcgtgcggccagtcccgcgcgtagcaccatattgcccggcgaaaaccagacatcacgatcgtcgggccagcctttcggtgacctcgctgcatgaacgccgtgcccgagtgcctgagatgcggaccggacttccacagccgcttcgcgtgtcgacaatccgaacagattcaagaatgcgatgccccagtcttccggcagcagaaccttctgcccctggggctgccaacttgatggatgatcaagtagaacatccatcatcgcatcgatgcgcccatccctggcgagatagaccgccgtcatctcctgcacaacatcgtccggcggctgatcagaaataaaatatttcgccagctttcgcgaaataaatcgagcggtagaaggatgccccgcgagaaaatcgagaagatcatccatctccttctgcccattttcttgaaattcccgcgccaatatgatcttggttcccggctcatggcgactgtccaagaacatcatgtccagagggcgattccgatcatagtattttatgtaccatccggtcagcatctgagctgcggcagcaacgtctgactgcttatatccgccagacacgcccagtgtatgcagctccaggagttctcgccccaagttttcgttgattcccagcccatttttctgccccatttgagaattcggacctatggagctgttattattcaaatagatatgcatcaaggggtggtgcatgactgcacccaagagggtccggaagggcccggtcacatgtgggcgtatggcctcgttctcgtatagatcggtcagaccgaggagagatggctgcgtttgagaaactgtaaaatgctcaaaaaaagaaatggacaagccgctctctcagtggcgtctcagtctggagagcggtcataatgcgggcatcccgtatcctgtcggaatactggacaaatgtctggtatgagtctctctctggggccatacgtttttcttccggggtcggaaagcgtatggcccagcgtgccttaagatcaggtatgagtgtaaccggaggacgtggctgcatatccgacgacaattgcctgcgaagccacgccctgggcgcttccccgacctgctctggcagatcaggacggtatcccatcccgaaacgggtcatggcaagatatgcatcatctgagatcatgcagcgatcctgttgcagccgctgatggagggatcaactccatttggagcatcacgttcgacccgacggacgcgaggctcttgagttgcgagcactttcgcccgtccagatggcccgatcaggtggcattacctgatcgggccccgctccagaaccggagtttcagaataccctcttcatagaggctccaccgagtggcgttcgtgtgtcaatcctcggcaagcactccaacttcctcaaccgcgcttccagcgcgtgccgtccggcccgtcctccagcaccaccccgcgtgccttcagatcgtcgcggatccggtcggcggtggcgaagtcgcggttgcggcgcgcggccaggcgttcgttgatcagatgctcgatctcggcctcgtcggggccggtctcgccgcccgaggcggggccgccgcggaaccaggcttcggggtcgagccgcagcaggccaagggcatgccccgctcccaggatctgcgccttcagccgggcccgttcggcccgatcggtggtgcggttcgcctcccccaccagctcgtgcagatgcatcagcgcaagcggggtgttgaggtcgtcttcaagcgccgcacgcaccgcgtcgggatagacgcggcaatcgccgtcaggctcgatctcgtccatcagccgcagggtgttgtagaagcggtcgagcgtctgcttcgcccgctccatgccctcctgcgtccagtccagcggccggcggtaatgggtctggagcatcagcaggcgcaccgcctcgcccggcacatggcccagcagatcgcggacggtgaagaagttgccgagcgatttcgacatcttctcgccgtcgacattgatgaagccgttatgcatccagtagcgcacgaacagcgcgccgtcatgggcgcactggctctgggcgatctcgttctcgtgatgcgggaagatcaggtcctggccgccgccatggatgtcgaaggtctcacccagatgggcctcggccatggccgagcattcgatatgccagcccggacggccgcgaccccaggggctggaccagccgggctgatcatcggcgctgggcttccagagcacgaagtcggccgcatcgcgcttgtagggcgcaacctccacccgggcccccgccaccatctcttcccggtcgcggcgcgacagcccgccgtaatcgggcatcgacggcacgctgaacagcacatggccctcggcctcgtaggcatgatccttggccatcagccggcggatcatgtcgatcatctgcgggatgtgctcggtcgcgcgcggctcgatcgacggcggcagcgcgttcagctcgcccatgtcctcgtggaacatcagcgcagtgcgggcggtcagggtctcgatcgcctcgccgctttccttcgcccgcacgatgatcttgtcgtcgacatcggtgatgttgcggacataggtgacacgcggatagctcgccttcagcaggcggtagagggtatcgaacaccaccaccggccgggcattgccgatatgggcgcggtcatagaccgtggggccgcagacatacatccggatatggtccggatcgatcggctcgaaagcttccttggcacgggtacgggtgttgtagacggaaagcgccatgatggctcgtcctcgggcaggcaatcaaagacgggcgaacggcggaggcgccggccggttgaatggggtggcctcgggcatcaggcaccaggcatcaggcatcctggccggaaagccgggccgcggcgcgcgcggcgccgatcatcggtagcagctttttcagctccggtccatgctcggccgcggtcagcgccaggcgcagcggcctgaaaagcccccgccccttcacccccgtcaggccctgaatcccgcgggtccaggcgctccaggtggtctcgtcccagggctccggcggcaaggtgtcgcgggctgcggccagcaccgcctgcgatgtctcgtcgacctcgatcaccggcgtcacggggcccgccaccacctgccaccaacggcccgcctcggcgatccgctcgatattgcccgagacggcatcccagaacggggccaccagctcatcgggcacgcccagcccgacaagcggcgcgcgcacgccctcggcatccagacgccggatctgccgggcattcagctggaccagatcggccgggtcgaaacgggcggccgcccggccgaagcggctgatgtcgaagctcgccaccagctcgtccaggcctgcgaccggttcgatcgcatccgaggtgccgagccgggcgaggaaggccgccaccgcaagcggctccatgccgtcctcgcgcagttccgccaccgcaagcgagccgacgcgcttggaaagcccggcaccgccggcatccagcagccaggccagatggccgaaatgcggttccgcggcccccagcgcatggaacagctggatctgcgccgccgtgttggtgatgtggtcctcgccgcggatcacatgggtgacgccggtctcggcgtcgtcgaccacggtggcgagcgtataggtggaggcgccgtcggcgcggatcagcaccgggtcggacagcgatccggcatgaacgtcgatccggccgcggaccagatcctcccacgacgtctcgcggtcatccagccggaagcgccagtgcggccggtggccttcggcttccagcgccgcacgatcggcatcggaaagggccagcgccgcacggtcatagaccggcggccggccggcggccagctgggccgcacggcgcgccgacagctcttccggggtctcgtaacagggatagagccggccgcaggcgaccaggcgttcgaaagcggcggcatggcgatcggcgcgttcggtctggcggaagctctcgtcggccggaatgcccagccagtcgagatcggccagaacgcccgccacatagtcctcgcggctgcgctcccggtcggtatcatcgatccggagttgcatcaccccgccatgggcgcgggcatagagccagttcaccagcgcggtgcgggcattgccgacatggagacgtccggtcggagacggcgcgaagcgggtcttgacggtcatatgggccgatactcggtggaaccagggcagatggccgcgccggtccgcagccgcggcgccgacagggcggcgaccgggcctcaggcccggtcgcggaagcggttggtgatcggatagcgccggtcgcgcccgaaggcacggccggtgatcttcacacccgggggcgattggcgacgcttgtattcagccacgtagagcaggcgggcgatgcggtcgacctcgtcgcgatcctggccctgctccaccagcacccggtgcggcagctccttctcgaccaggccttccagaatggcgtccagccgttcatagggcggcaggctgtcctcgtccttctggtcctcgcgcagctcggccgatggcggcttggcgatcacccgctcgggcatcaccggcccgtcggggccaagcgcgccttccggcttctgggcattgcgccagcgcgacagctcgaagaccgtcatcttgtagacgtccttcagcaccgaatagccgccgcacatgtcgccataaagcgtggcatagccgaccgacatctcggacttgttgccggtggtcagcaccatgtcgccgaacttgttgctcatcgccatcaggatgacgccacggatgcgcgactggatgttctcttccgtcacatccgggccgcgattgccgaagaccggcgccagcatggtcgagaaggcctgcacggccggctcgatcgggatctcgtccagccgcacgccgcaaagttcggcacaaagcgccgcatcgtccaggctgtcgcggctggtatagcgggacggcatcatcaccgcgcggacccgatccgcccccagcgcgtccaccgccaccgccagcgacagggcactgtcgatgccgcccgacaggcccagcaccacgcccgggaagccgttcttgttcacgtaatcggccaggcccagcatcatcgccgagtagaccgcctccagcacctcgggctcgggcgacagcgggccagcctcggccaccacctcgcccgcctcggtccggcggatatgggcaggcgtggtaccgctgatccaggccggcgcctgaaccttcagcgcgccgtcgcggtcgagcacgaaagaggcaccgtcgaagaccagctcgtcctggccgccgaccagattgacataggcgagcggcaggccggtttcgtgcacccgcgccaccgcatgggccagacgctggtcgcgcttgtcgacctcataggggctgccgttgatcaccagcaggaattcggccccgctttcggccaggcattcggccgaatccggccgccacatatcctcgcagaccatcagcccgacccgccagccgcggatcaccaccggcccggccggcggcgccagatcgaagaccctgagttcgtcgaacacgccgtaattgggcagcgcatgcttgcgcaccacgccggtgacgtggccgccatccagaacataggcagcattgtagagcttgccgccctcggcatggggggcgcccacgatcagcgccggcccgccgtcggcggtcgcggccgccagcatgtcgagcgcggatgccaccgcgcgcatcagcgccggcttgcgcaccagatcctcgggcggatagccgatcagcgacagctcgccggtgacgcagagatcggcgccctgctccgccgcctgttgccgtgcctccagcagctgccgggcattgccctcgacatcgccgacgacggggttgatctgggccagggccagggtcagaagctgggtcatgtcggtccggatcctgtcggaaagcacggcacggagggccgtcagcggcggggccgccgcgacggcagcaggaattcgcgcccgaccttcacgctctcgcgcccgtcatacgagacgatgtccgcggtcgcgtaggtctcgctccacttctcgggcaggaaagagccggtgccgaccacgtcgatcggggcttcgacgctgcccatcacccggcacttctcgggcccgaagccgctggaagcgacgatgcgcaccttgtcgaacccggcatcgtccagggcgttccgcatctggaagatcgccgccgccgaaacgccggggccgagcagccatttcagctcggtctcgctgcgatagcgacggatcgcgtcggggcggttgcgctccagcgccgcataagacagcgccggatccagcccttccaggaagcggccaccatgggtgtcgagccgcaccgacagcttgccggccgccgccatctcggggaagcggcggcagacggccagcgcatcggtgatctcggcgccgtaatagtcgaccagcacggtcagcgcatcgcccgggaaggtgtcgacgaacatctccgcggcccgaagcgtggagccggcatagccgatcagcgcatggggcatggtgccgaagccatgggcattgccgaaatgcaccgcggtcgcatcggtcgcattgccgatgaagcccaccgccccttccgcctgggccgcagccgagccgacgctcgccgcataggccatcatctcggccatttcggcaccggcgcaatggcgggcatccatggcgaggaaggccgcgcgcggcagggcgaccgccatgctccaggcgttataggcggcgacacagggggcgcccaaacgctggagatacaccgtctccagctccaccagcgccgacatcgggccggtgatgtacatcagcggctcgcccgcccccacccacgagccttcctcgtggcagggttcgatcacgatctccaccccgcgcagccgggccatcgcctcgatccagtcgatggcgagtttcagcgtcgccagcaccgggcggcgcatgaacacggcataggtcacgctgcgatcgccgaaacgctcgacgatgcgccgcgtgcgcttgaagtagacatcggtataggcggcgacgaagtcgttggtggcagacatgcgcagcctcggcagttccgtggtgccggcggacggggcgtccgcggatgagctgtcggcagaagagctgtcggcagaggatgttcgggggccagcggaaggaatgacggcggccccggtctccggggccgccgcatcggtccgacccttgggggtcgcggatacggatgtcaccgtgcagcacccgccgccgcggccggcgcctggggcaggcccaggcgttcacggcgcagggcatcggcgatctggaaggccagttccaggctctgttcggcattcagccgcgggtcgcaatgggtgtggtagcggtcggccaggccatactggtcgatggcgcgcaggccgccgacgcattcggtgacgtcctggccggtcatctcgaaatgcacgccgccggcatggctgccttcggcctgatggacggcgaagaagttccgcacctcggccagcacccggtcgaccgagcgggtcttgtagccggtctcggtcttcatggtgttgccatgcatcggatcgcaggaccataccaccttgcggccctcgccttcgaccttgcggaccagggccggcagcttgtcggccaccttgtccgcccccatgcgcacgatcacggtcagccggccgggctcgttggcggggttgagcgcgtcgatcaggcgcagcagctcgtccggatccattgacgggccggccttgacgccgatcgggttggcgatgcccgacatgaactggacatgggcgccgtccagctggcgggtccggtcgccgatccacagcatgtgggccgaacaggcgtaccagtcgcccgaggtgctgtcgacacgggtcagcgactgctcgtagcccagcagcagcgcctcgtggctggtgaagaaatcggtctgccgcagctgcggcgcggtttccgaattcaccccgcaggcggccatgaagtcgagcgcatccgagatccgctcggccgttgcgcggtagcgctcggcctgttcagagccgccgacgaaggccaggttccacttgtgcaccaggttgaggtcggcgaagccgccctgggcaaaggcccggagcaggttcagcgtcgccgccgactggttgtagacccggatcagccggtcgggatcgggcttgcgcgccgcggcatcgaactcgatgccgttgaccatgtcgccgcgataagacggcaacgcaacgccgtcgcggttctcgaaatcctcggagcgcggcttggcgaactggccggccatgcggcccaccttcaccaccggcatgccggcgccataggtcagcacgaccgccatctgcagcagcacgcggaacgtgtcgcggatgttgttggggctgaactcggcgaagctctcggcgcagtcaccgccctggagcaggaaggccttgccttcggcgacgcgcgccagatgcgccttcaggcgccgcgcctcaccggcaaagaccagcggcggatagcccgcaagctcggcctcgacgcgcgcgagatgcgccgggtcgtcgtaggtcggctgctgcttgatgggcagcgcgcgccaggcttgcggggtccaggtggcaggcatcgggtctcggtcctcgcgggcgtcgggatcggcgggccgatctggtcggacggctttacgtggtgcgttgggcgggacgtgagctggtcacggagagggcacggccggcaccggatgccggccggagagacaaagagcgacggcaaggccaccccgtggaccggatcggctccggttcccgggcggttgccggtttcgaacctataccgccgcccccggtggttttcaaacaaaacgcggaccggaagatgatgcaacaccgccgcacggccgatcagtgacggatgtaatatccggcaagccgactttgtgcatcgcaacaaatacctgcgggttcagcctctctgccgtctcaatccttcaccggactgcgcatggtgacgaattcctcggccgcactcgggtgcagcgcgatcgtctcgtcgaactgcttcttggtggcgccgcaggtgatcgcgaccgccagcgactggatgatttcggccgcatcgtcgccgaccatatgggcgccgagcacgcggtcgctggcgccatcgaccaccagcttcatcagcacccgggtctcgcggccggtcagcgtgtgcttcatcggccggaagcgcgcccgatagatccggatcgaggcatacatccgccgcgctgcctcttcggtcaggccgacggtgcccacctggggggtgcagaacacggcggtcggcagggtgtcgtagcgcagccggtaggtgttgtcgttatagagccgctccgccagcgagcgcgcctcggcgatcgcaaccggggtcagctggaagcggtcggtcacgtcgcccaccgccaggatcgaacggagctgggtctcgtagcgatcattcaccacgatcgcgccgttctcgcgggtgtgcacccccacctcttcaagtccgaggccggcggtgttgggcacgcggccggtcgcgaacatcacccggtcggcctccagcacctcacccgaggtgagggtgacggcgaaaccgtcggccaggcgatcgatacgcaccggctcgacaccggtgcggaagccgatgccccgcccttgcatctcgccttcgacagccgtgcggatgtcggcgtcgaagccgcgcagaatccggtcgccgcgcagcaccagcgtcgtctgcgtgccgagcgtggagaagatcgaggcgaattccgtggcgatatagccgccgccgatgatcaccagccgcccgggccgctcggtcagatccagcgcctcgtcggaggtgatgacgtgctcgatgcccgggatcttcggcaggtaggcgtggccgccggtggcgatcaggatccgctcggcggtgacggtacgaccgtcgacctccacctcgtgcgggccggtaacccggccgtggccgcgcagcacggtcacgcccgaattggccagcatcgtctcgtagatgccttccagccgctccagctcgcggttcttggtgcggatcagcgcgccccagtcgtggttggcgccctcgatcgtccagccgaagccgcgggcatcctcgatctcgtcgcggaaatgcgcaccatagaccaggagctttttggggacgcagcccctcagcacgcaggtgccgcccacccggcccgcttcgacgatggcgacgcgggcgccgtattcggctgcgcgccgcgagcctgcgacgccgcccgatccggcgccgatggtgagcaggtcgtaatcgtacatgcgttcgcgtctcctggcgttcgcgtccctgggtgcgtcgtcgtccggcaggggcagacgggccgcgacccgccctgccccgccggtccggatcaggcgccgatgccgccgatcagggcgtacttcacttcgaggtagtcctcgatgccgtacttcgagccttcacggcccatgccgctctccttcacgccgccgaagggggcgacttcggtggagatcaggccttcattgatgccgacgatgccatattccagcgcttccatcacccggaagacccggccgacatcgcgggtatagaaatacgaggccaggccgaattcggtgtcgttggcataggcgaccgcctccttctcctcgtcgaagacgaagatcggcgccacgggcccgaagatctcctcgcgcgccacccgcatctcctgggtggtgccgaagacgatggtcggcttgtagaaccggccgcccagctcgtgacggccgccgccgagcatgacttccgcacccttcgaggtagcatcggccagaagctcgtcgaccttctcgaccgcagcgtcgtcgatcagcggccccagcaccacgccctgctccagcccgtcgccgaccttcatctgggcgacgcgggccgccagcttctcggcgaaggtcttggccacgccgcgttggacataaagccggttggcgcagacgcaggtctgaccgttgttgcgatatttggagacgatcgcgccttccaccgccgcatccagatcggcatcgtcgaacacgatgaacggcgcattgccgcccagctccatcgacaccttcttgacggtggcggcgcactgttcgatcagcaccttgccgatctcggtcgagccggtgaaggtcagcttgcgcacgatcgggctggaggtaatctcgccgccgatcgccgaggcagagccggtcaccaggttcagcacgcccttggggatgccggcctcttcggccagcaccatcagggccagcgcggtgaacggggtctgcgaggcgggcttgcagaccatggtacagccggcagccagggccgggccggccttgcgggtcagcatcgccgcggggaagttccagggcgtgatcgcgccgacgacgcccaccggctccttggtcaccacgatccgcttgccggccgaaaaggtcgggatggtgtcgccatagacgcgcttggcctcttcggcgaaccattcgatgaacgacgcggcataggcgacctcgcccttggcctcggccagcggcttgccctgctcggtggtcatgatccgggcgatgtcttcctgatgcgccatgatcagctcgaaccacttgcgcagcagggccgcccgctccttgccggtcttggcacgccaggccggcagcgcggcattggcggcctcgatggcgcggcgggtctcggcggcgcccatcttgggcacgcggccgatgacggcgcccgtcgccggattgtcgacggtgatggtggcgccatcatcggcgccgacccaggcgccgtcgatatagcacgcctcgcgcatcagacccttgtgcgagagctgaatcacctgaagtcctccctggaatgtctcccacatgcggcctggctccggggcgaccgccccggggtccgcacgcgaaacttcgccgccctccgggccggccatgacttgaacccgcccgaatgcggcatcagactatatggcggccgggggtgccgcaaggaacccccacacgccgtggaccctgttccgcggatcatgcagggctggaggatcaggtcatgcgcccgcacggcaaccggaagacgacgcaccgcatcggcacagccgttctgggggttgttctgcttgcgggcggcccgaccctggcggctggaaacgaccatccggaagagggtctgggccccaagctcgaacgcctgggccgcgcagcggacgaggccctgaccagcctgcgcgatgccatcgaagacctgccccgctacgccgcccccgaaatcgacggcgacggcaacatcatcatgcgtcgcctgccccagaacgacgccccgctggagggcgacagggccccggacgaacgcgagggcgagaggccggaccgtgggcggcaggtggagcgggatggcggagtatggctctaaagcataggtaaatattcaccaccacacgaactggttgcacctatctcataagttaaattatttgacttctgtatatattcagaagaaattgaacctgaagatggacccccagcaacatcaggcgtttcgacctgctggatgatgatatgcgcgcagataacctgacagatccagcctacgcgcggcttccctcaggaagagccggggactatttggagaagctcgtcctcgatggcttcaaacgagaactagatcaggaagaaaatgtcgttcgaagcttgccattcttcgcgacctctatcggtataataattaccctgatcagcctcactatttacaatttaccagcggcggatcatgatctatggataatatttatctacgggattctggtcctattgattgcagatatttttgctcttctgtactttcttcatcaggcaatacgtacacgtgcgttcggttatcctatgcacgaggaggacctgctcggctatgcagaacggctgatgtcgtactatacgccgacacccccggcctcagcagcagacagcaaccttgaggcgaatacgttggcggtcgtcaggtcggatacacccggaagcgatcttgacgtccacgcgatcgtggagcgtgccgttctggaagacctccgcaacgtcttcataacacagctcgccacatcggccggaatcagccgccgtaacaattgggcgcgcctgaaagcccgcagcagagccttccattttctgatcatagggttgggcttcgcgctcgtactgatctgcgttatgctttttcagagcatgatccatggaggatcacatggaagacatcgcctctctggcacagaagttgcgcaaccgcgtgatgcgggatccgaagacgggacaggtgatggagaagccgcagccgccacggatgcgcaaggtcgtgaagggcttctggacttacggggaagtcccgggggacgtggaggacctcagacaggagaagaagacacgatgagtggcaaacccgtgtctcctccggcaacgtccgaaacctcgcagcccgccgacgcggcaaagcctgcaccaccgccgatgaattggactcggaagaatggcgatgatgcaggccgtgagacgaagtgaccggcctggctgtcagccgcccttcgccaaagccggcgtgatggtccccgcacattcgccgaagccgatccggtagccgtcgcattctgcgtggcctgacagggtaagactgtcgccgtcttccagataggtccgggtcgtgccgtcgggcagatgcagggggtcgcggccgttccaggtaagttccagcaggcagccacggttttcgggcgcgggccccgagacggtgccggagccgatcaggtcgccggtgcgcatggcgcagccattggcggcatggtggcagagctgctggaccagcgagaaatacatccgccggtagttggtccgggtgatgacggcttcggtgccaacagacgtgctcagccttgcggtcaggtcgatgtcgaaatgcgccggccggcccgcatcgtccagatagggcagcagcggcaggtgccgcgcgggtgcggcgcagcgggccgccgccagcgcctcgcgggtcacgatccaggcgccgatcgaggtggcgaagcccttggactgaaagggtccgagcggccggttctcccagccctggatgtcgcgggccgaccagtcgttgagcagcacatagccgaagatcatcgcctcggcctcggccagggtgacgggctcacccggccggttgggcaggccgaccaccgcccccaattccagttcgaaatccatccgcgccgaggcggcgaaaaccggcatcgtcgcgccggccggcagaatctggccaagcggccgccggaccggcgtgcccgagaccaccaccgtcgaggcccggccgttatagccgacagggatgtgcacccaattctcgaccagcgtatcggcgccacgcagtgccatgccggcattgcgggcatggtcttcgctggagaagaaatcggtgtattcggcgacggtgaacggcagatgcaactgcacctccgtcagcggcaccagcgtcgggcgcagctgcgcctcttccgccgccccggccgacagcaggtgggtcagccgctgccgcaaggccgaccatgccgccgtcccggcggccatgaagccgttccaggacggctgatcgaacaccggcggcagaccgtcgagcaggccggcgcgctgcagccaggccagatccagcacctgaccgccgatcgcggtgcagcagcgcggcgcatcaccgccacggctgaacaccccacagggcaggttgttgaggggaaaagaagtctcggcccggttcgcactcgcgagccagctttccagacgcccggacatgtctgtcgatttccttcagtcttgaccggcgctctgccggccggcggtggagatcccgccggtgatgaaccgcaccaggtgctcgcgcatctcgtcgcgcgcctggatggagcagtcgccgtccgacagacgctccacacgccggccgtcatcgcgctggctgaccgagatcagcaccgtgccgaccatgaagttgtagaaccagcagacctcggcatgatcgaggtcgggcgccgccgccgcgatcgcggcgatatagcgccgggccatgccgtccagctcttcggcgatcaggttcgaggtccattcggtcggcatcagccggttcttcaggatcagattggcgagcagcccgccctcggccggcgtgtcctcgcgaaaatagccactcacgaagctttcgacgatctggcggatccggacccgacgcccggcggcgcgcgcctcgtcttccagccggtccagctgctccagccggtattccgcacttcgccgcgccacctggcggaaaacgtcgacggccagattgtccttggtgccgaaatgatagttcactgcggccacgttcagcccggcgccgcgggcgatgtcgcgggtggtgacggcatcgacgccgcgctcgctgatcagcatgcgggcgaccagccggatacgctccttcggcccctcggccggctgaccctgtccctgggcttccatctcggtcatcaatcggttccggtcgctctcttcaccacacgtgcataggcattggacgatccggcggcggtgtcgcggctctccgccacccggtcggcgatctcgccaaaggcccggtccagcttctcgcgcagccccggcagatccacgccgaccaaccggccgtcgcgcttcaccacccggccgtcgaccagcacggtcaccgcatcgcccggccgtgattccagcagcagcatcgcaaccgggtcgcccatcggcatcatattcagcccgccggtcgcgaacagcgcgatatcggcccgggcgcccttgcggagcgtgccgatttctccgcccatccgcatcgcacgcgccccgccctcggtgccgaagcgcagcgcatcgcgcacggtcagcccgatcctgtcgggtacgatgccctgatccagcaccttctgattgtcgatcgcgcgcgccgtctgcagggccagacgcatctgggtcagcatgtcgccgccgatattggaggcgatgtcgacaccgaagctgggcagcccgccggcttcgatcagccggttggtcaccggccagcccatgcccatctgcatctcggtctcgggcgtgatcgacagcccgccacccgaggcgaccagccgttccagctcgtcatcgccgcacatattcgcatggacatgcagcatgtccggccccagacggccgcggcggtcgagatcggcaatgccgtggggcgagccgaaagtgccgacatgcagcgtgatcagcgcatcatggcgccgcgcgaagtccagctcccgatccgtcacctccggcccgaccaggccgaattcggtgagggcgacgccgaaatcgagcaacggccccgcggtcgctcgaaagctctgcgccacctcttccgcatggcgcaggcgatcgtcatggctggcgaaggcccgctcccgcgccggcacgtcgtaaaagccataacagaacacgccgcggatgccggcatcggtcagcccctggatcgcggcttcggcatgcgcggggctgttcatcagatgcgagaaatcgcaaagcgcggtgacgccggtgtccagcgcttcgagcgcgccggccagattggccaggtagatgtgctcgggcgtgtaggcggtggcatagccgacccggatctcgcgcacataatcggccagcgaccagtcggccgccacgccgcggatcgccgtctgccagacatggcgatggctgtcgaccatgccggccaccgcaatcgcccgatccccctcgatcacctcggcatccggcgcctggatcccgtcttcgaccgccacgatccggccgtcccgcaccaggatgtcggtggtacgcgggcgcgtctgcggcggcagatccgggtccgccagatagacgttcctgatcaggatctctttcggcacggcggcgtcctcccttcagttcgttgaaccgaaccatagccccagcactcgcatcaagcaagtgatccaatcatttgattcaaacaagcgctttacatctgccgaagcgtcgcctaccaattccccaaggcagacggacgcctgctgcacatcggcccgatccgtcgaagaccgaccacatccaaaaagacagggggaggactcatgaggtttccgcgcatcgcggccgtcctggccgccacgctggcaacggcgacgctggccgccggcgccgcccgggccgaagaggtcatcgacctgaaattcgccgtcttcacgcccgagcaggagatcacctatcaggaggcgatcaagccctgggtccaggcggtggaagaggccgcgggcggccgggtccggatccagcttttccccggcggcacgctcgggcgcgacgggtccaagcagatcaagatgctgaatgacggcgtcgccgacatcgccttcatcatcccggcctacaatccggggctgttccccgacaactgggtgatcgaactgcccgacacctcccggaccgcaggcgaaggctcggtcgccttctggcggatggtcgaaagcggccggctcaggggctatgacggcttcgaggtgttgagcatggtcgccacctcgccctatctgctccacggcaacaagccgatgaaccgggttgcggacctgaagggccagaagatccggatcgccggcaagctggaacagcaatgcgtcgaggcggtgggcggcgtgccggtcggcatgccgatcaccaagatccccgaaagcctgagccgcgggatcatcgatgcgaccccgatgcactatgccgcgctctatgccttcggcatttccagcgccacgaaatatcactaccacgcggcgctgggctcgatgcccttcggcttcgtgatgacccgggagcggttcgaggccctgcccgaagacgtccgaaaggccatgcaggcggagggcggcgaaaagctggcgcgcatcttcggcgccgccatggatgccgaaaacgcccgccggctggcggagaccgaggcggcgcccgggcagacgatcgtgatcccgaccgccgaagacgcagccgcctggtcggcggcgatggccggctgctcggacagattcgttgcggagcaggagaacggaccggctctcgccgcggccttcagggccgaactcgaccgtatccgcgccgaatgatccggccggtgatcccccgggagcggagcgtctgacatgaccctcgaccgcctcgacgggctcaacgtcgcctgcacgcggctcatcgcgctggcaggcctcgccgccctgttgatcatcgccatcgcgaccctggccgatgtcggcgcgcgctggctcgccgatgccccgatcgccggggtctatgatctctcgaccctgttcatcgcggtggcgatggcagcctgtttcccagccgccatcgccagccggcagaacatcaaggtcaccttcctggccgaccggctgccgcggcgggcgcagctcgcctgcgatctcttcgccgaaatcatgaccctggtcttcttcaccctgctcgcctggcagctggtggtctacacgcaggagctgatcgacagcggcgagacgtcgttcatcctcgaggtcgaaatcgccccctggtgggtggcggccaccgccctcttcatgctctgcgtgccggtgcagctggtggtggtcgccacggcgctgcgcgacctcgccaccggcaacaccgcccgtcttgccgcgcatcagggagaggtctgatggatcctttgaccaccggcgcgctcggcctcgccctgatgttcgctctgatcctggtccgggttccgatcggcatcgccatgggcatggccggcttcatcggctatgcgatcctgggcggggtgaagccctcgctcagcatcctggtctcggagccggccgggatcatcgccaattacgaattcgcggtcatcccgctcttcctgctgatgggcagtttcgccaccgcgggcggcctgtcggcggagatctaccgcctggcccatgccttcgtcggtcatcgccgcggcgggctcgcgatcgcgaccatgggcggctgcgcgctgttcggcgcggtctgcggctcctcgcccgccacggcggcgaccttcggccgggtggccctgccccagatgctggaccgcggctacgcgccctctttcgccaccggctgcatcgccgccggcggcacgctcggcgccctggttccgccctcgatcatcatgatcatctatgcggtgctggcgcaggtctcgatcctggacgtcttcgtggccgccgtgatcccggcgatcatcgcggtcgtcttccacggtatcgcgatcaccgtctatacccgcttcgtgcccgaggcaggtcccgcaggcccccgcaccggctggccggaacggtggaaggtgctgcgcgaaagctgggcggtgctggtcctgctgatcgccgtgatcggtggcatctatggcggcatcgtcacggtgaacgaggcggccgcggtcggcgcctgcttcaccctgttcctggccctgctgcgccagcgcctgagctggggcagcttcctgcatgcgctgggcgaaaccgccaccaacacggcggtgatctatctgatcatcttcggcgcctcgatcttctcgtacttcttcacgatcagcggcgcgccgcaggtgctggtctcgaccatcggtgccatggaggtgccgccgctggtgatcatcttcgcgctgctggtgatgtatctggcgctgggggccgtgttcgagaccgtctcggccatgctgatcaccctgcccttcgtgctgccgctggtcgtctcgctcggctacgacccggtctggtgggcgatcgtgaacatcgtggtgatcgaactcggcatgatcacgccgccgatcggcctcaacgtcttcgtcctcaagggcgtcgccggcaacatcccgctcggcaccatcttccgcggcgtctcgatcttcgtggtctcggatctgctccgcctgatcctgctcgcggtgtttccggtgctgtcgctctacctgctcacctcctgagccctccccgcttccctgatatggaaaacgcatatgctcaaacccattcgccgcatcgtcaccaccaacaccgccgatggccgctcgcggatcctctccgacggcccctcgccgcatgtgctggaaacggcaagccatcgtggtctgatcgatctctgggccatggccgagggaggcccggacaccgccaccccggacggcgccgaccgcccggtggttctggcccccgcccggggcggcaacaccttccggatctttcagctgccgccggccggggtgggagagaacgaccgggtgctgtcggccgatgtcttcgcccgcatgggggcgagcgacgcccatgatgcggatgcgagacatcccaacatgcactgcacccgatcgatcgactacatcgtcctgctctcgggccgggtgaagctgatcctcgacgaagaggaaaccatcctggagcccttcgacgtggtcatccagcgcgagaccaaccacgcctggcagaacctgtcggaccagccggcgcagctgatcgcggtgctgatcgacacctccgccggggtgtgacagccggaaactgatcacaaaaaagggggcggcccgcgaacccgggccgccccctttttcttggctctcggcttcctggttatcgacgtcctactccaccgtcaccgacttcgccagattgcgcggctgatcgacatccgtgcccttcagcacggcggtgtgataggccagcagctggaccggcagggcatagagcagcggtgccaccaccgggtcgacggtcggcagcaccaccacctccgccaccagatcggccaggcgcccggcccctgcctcgtcggtgatcaggatcacccggccgcggcgggcgacgatctcttcgatgttggaggccgtcttctcgaacagcggaccggagggggccagtgccaccacgggcagaccgtcgtcgatcagggcgatcgggccgtgcttcagctctcccgccgcataggcttcggcgtggatatagctgatctccttgaacttgagcgccccttccagcgcgatcggaaaggcggtgccgcggccgacatagagcacgcctgtcacatggaccaggctttcggcgatgctgcgcatccggtcgtcattgttcagcacgtcggccacgcgtgacggcacctcggcgatcgcctgggtcagcttctggtcgcgggcggcatcgatggtgccgcgggcgcgccccaggccgatggcgaggcaggcgagcgtgaccagctggcaggtgaacgccttggtcgaggccacgccgatctcggggccggccttggtgcgcagcaccagatccgcctcgcgcgccatgctgctttccggcacgttgaccaccgcaatggtgatcaacccggcggccttcgcgtggcgcatggcggcgagcgtgtccgccgtctcgcccgattgcgagatgaacaccgccacctcgcccgggatcagcggcgtgtcgcggtagcggaattccgaggcgatgtcgacatcgaccggcagccgcgccagctgctccacccagtatttggcgaccatgccggcataggccgaggtgccgcaggcgacgatcatcatgcgggtcagcgccttcggatcgaagggcatctccttcatctcgatcgtgccgcggccggggtcgagataggtcctgaggctgtcgccgatgacggccggctgctcgtagatctctttcagcatgtagtgccggtggccgcccttgccgaccgcgccgctggaaagctccgtccgccgccgcggccgcacaacctcggcgccgccggcgtcgtagatggtcatgcccgcacgggtcagaaccaccatgtcgccttcgtccagataagtgatctcgcgggtgaagggcaccagcgccatggcgtcggagcccagatacatgcagccctcgccatggccgaccgcgagcgggctgccgcggcgggcgccgatcagcagttcctgttcgccggcgaagaccagccccagcgcgaaggcgccttcgaaacgcttcagcgccgccttgcaggcctccaccggtgccagcccctgttcgatcagcgcggtgatcagctggggaatgacctcggtatcggtctggctggcgaagacccggcccgccgcctgcagctcggcgcgcagatcgcggtaattctcgatgatgccgttatgcaccgccgccacccggccggtggcatggggatgggcattggcctcggtcggcgcgccatgggtggcccagcgggtatggccgatgccggtcatgcccggaaccggccgctcggcaagcagcgcctcaagccgggcgatgcgcccttccgcccggcgccgctctatccggccttcggcatccagcacggcgatgccggcgctgtcatagccgcgatattcaagccggcgcagcccttcgatcaacaccgccgccgcatctgcaaccccaacgacaccaacgatgccacacatcaggccaactccgtgcttgtcaggtcttcccacggccggcagaccgcggttccgatctcagggggtagcagagccacccatccgctgccaatcacttcgcgttacggaatgttgcagacgcgccgcctgcgagggtcggcggatggcccatcacgaaactgcaatctgcctgcgatcacccgcttgacagccatgatgcagggccatataaagcgcccacctcaggcggccgggacggcgaaagccggcaccgacccgatcctgcgggcgcgtagctcagcggtagagcacacccttcacacgggtggggtcacaggttcaatccctgtcgcgcccaccaattcgacaaggccctcggcatcttcggatgccgggggccttgttcattccgggccgcttttcgcggccaggcctcgtgcctgtcaggcccccgcccgcaccgcgatctcggccgtatcggcccccagcctgcgccagatgcggcccaggatacgcggatcgcaggcatcgctcagtcgctcgtcagggcccaggcagcgggtcagaatgcccccggccatggcggccgccgcaaccaccacccgcccgggcaccaccggtccggtcagccgcagcggcacccggccggcaaaggcgatccgcgccgccggttcgtcgccccccgtatcgccgccgaccagcgccggtgcggtggagaccacggcgaaggcgatcgcggcctcgaagcggtcggtcacccgcccgtcctgatcgatgccgaccaccgtgccgggcgtcaccgcccggcagtccggcgccaggggaacatattcggcgaaatccgccccggccgcgttgatcgtgccggcggcattcagcgagcgcccggtcgtgccgttgacacccagcgccagcgcacaggcggggccaccgcccgatccggcgacattgtagaaccgggcgctgaccccggcatggccgccgatcatcacggcctccgccccttcggccgcggtcacgctgcgcagcctgatcatggcggtgccgacgcctgcatccatcacctccagatgcccgtcggcggtctggatcagatcccagctgcgcgcggccccgcccgtcgcctgcaggcgcagccccacggcggaaccggccagatgcagcccctgtgccggcgccgcggtgccgatgccgagtgccgcccgatcggccggcacggtcagccggtccaccccctgggtcgccagcaccagcggtgcggcgatgtcggtccgcaaccgcatattgcctccctgccaggccagggcccccttgcggctgccggcctcgcgcagcgccagcgccgcttcgccgccggcattcacatgggccgaaaccgtggccgcggttgcgtggcgcaccaccagcccttcggcatcgaccgcgctgccgtcgcccaccaccagcttctggccgacatccagccggccggtgatgacgtcgccggctttcgaaacccgggtcgcaagtgctgcatccagcccggtgacctcggtggtggcatggctgtgggccagcatggtggtcgccgtccaggcaccggcccggcggaccacgaaggcctgttcggcttcgaccagcaccacccagccgtcgcgcgcggtgatgaagcgccagccgcccgcggtccagagcgccagttgcccgtcgcgccaggcccaggcgcccgaggccccgaacggtatcagataggcatcgccctcagccgggctggcgggcggcagggtctggctgcggctcttgaccgcgatctgcgccagaacatccagcacggtcagggcttcgttatgggtgacgtgtttctgcgcctgggcggccgcaagcaacggcagccccaggcgcggcgtggcatcggccatggccggacctttcaggatctgacggaaaagacggaacgcgccctcagggcaccacgctcgcatagcgcgccgggccgggcccggtcgccgcaccgatctgtgcgaccttcaggccgagagtggcgggtgaggtgaagaagtcggcgtattgttgggcggcggaatagctccagctgccggcgccctcgacgatcaccgtgcggcggacggctgccgtctcggtcgggctcgccaggatgtccagctggtagcgctcggccgtctcgctcatcggctcgtcggcgccgtcggtccagccggccaggcggtcggcgcgcaaccagcggatcagcaccgagccgtcggtctgccgctttgcctgaagatcgaccggccggaacggccgcaacccggcgccggtcaggctgtggatgcgggtggggccgatcgcacccgcaggcgtcaccgcccggaaatgcagcacggcgccgatatcggccggccgccagcccatgaccgccagccgctcgggatccagaagatgaaccgtctcgccgatcgcatgggcgccgatcgccgcctcggtgccgcgcagcccgcgccgcagccgcgacagccgccagagaccggccgacacccgctcgatcgccccgaagctcaggatctcggccccgaccagggcaaggctgcggccgctttcggcatcggcctcggtgatcccggcatcgacccgcagatcgtcgccgaaatcgaccgtgacactggccagatcgtcgcggagcgtcgccgggcccgtcgccagaagggtggttgccgtgccgctcgcggcaggcgccagcaccgccacctctcgccaggggccgtcggccctgtcggccacctccacccgcgccgccctgaggccgccaccaccgccggtgaccatcaccaccagcccgggatcgggggcgggttccaccaccggcggcaggtccagcaccgtcacctcggccaggccttcggcgcgtgccggggccgtggtcaccggcgggatgtcatcggcaccggggcgggcggtggcatgcagaccgtcatggtcggccacggcctccacctcgatcagcccgggcgtgccgaaggccatgcgttcgatccgaagccgggccggcatcatcggcaggcgcggatcgggtgcaagcccgatcacgtcgcccggctccagcagcagatcgccgaagcccagccggaaacgccagcggtcgcgccccaccagcgcctcgtcggcgagcgtgcgggcgatgcgcgccgcctcgtccgccgtcagcaccagcggcagttccaccgcctggcgatcctcggccccggcaaggctgcgccgggcccgggcaagacccggccgaccgtcggcggcaccgtcgatgaaggcgacaccgatctcgcgcggcatctcggcctgctggatgcgggtgcgctccaccagcggcggcggctcgtcgccggcaccatgtgcccccagccgtcccgggtcgatcacggcggcgaccggcccgccgcggggcacgaaggccagtcggccgtcgcgctccaccgcatccacgaaccagctggcgagcaagggctccagcgcctcgcgcgcgctgccctggcgggcgacgacatatccgcgcagcgccatgccgctgacgccggtcagatccagctcgtccggatccacaccggcggcctgggccagatcggcgatcaccgctcccagatccgcggtctccgccggccgggtgagcgccagccaccggtcgatccaggcggcattgtcgcccgccggcacccagggcacggccatcagccgcccgccccccgcggcaaagccgaccacatggccgggctcgatctcgaccggcgtcgtcgccacccgccccgcccgatcgatctgcgccacccggtcggtgaagaccacgacgacgatgccgtccgccgcccggtgcaggccgaccggccgctgatccggccaggggttgagcgtctggtcccggtcggccgtggcggtcagcccggcaagatgacgcagccgcgcagccgacagcagcagcaggccgtcgtcgtcgccgcgcatcagcgtccgtgccgccggcaacccgtccaggatcatcgtggcctccgcatcgctgccgctgtcatccagcgcccaaagcgccagcaggccgcctggccggccgcccaggatccagatccgcgtgccccaggcgctgacaccgcggacatcgcccgccaccatcccgggcagcgccaccagccgatggcggccggtctcgatttccacgagcaccgcggccgcctcgccgtcgcgcgcataaagctgtaccggccggtcggccggcgcccaggcgcagccacgccgggtcgaggtcagcgggatcgtgtggctccagcgttcctccgccagccagcgaccggcagagctgcgctggcgggcgacatgacggacgcggttcgccatgtcgctcgcggtcacatgacgggcgatcgccccatcctccaccccgccatccatcgaggcacaggcatccgtccaggcataggcattatcgccggcaaccccgcctgccggccccgtcagcgcgtcgatcggcgcgcctgcgatcagcgagggcagccgccgcaggccgtcgcgggcgaccggggtgacgctggcaaaggcggcgggatccacccccgccaccacggggctgccgcgcacgatttcggcctcgatcagcggcacccggttgccatagggggcaagcggcaggttctggaagacgagataggcaaggtcgcggaacgcgggtgtcccagccacgccctcatgggccaggatcagcggatccggcgcctgatcggcggtcccccgatacagccggaaataccggccgggcgcggcagaggcggcgatgccggacagccccgccgcgggatcggccgaccagatcagcgtctcgtcggcccagatccgccggatgcccaggatcgggccctgggcgaaacccacggcaaagcttgcgaagtactcgtactccacccgtccggccgaaagcagccggcccgcccccagaatgccgaacaccccgccggcggatgtggtgacggggatgatgcggcggcgttcggtgatcggccgcgcccagatgatgttacccgccagccgcacgctgccatagacccggggaatgacccgaccatggccggtggtctggaccgccagatcctgcagccgcggcccctcgcgcggttcgaacccgccgctcgccgcccggcgcgccaggctgcccaaggcatcacccagcccgcccgaaggcagcaacccgctgatcagcgaggtgagaaagaacccggccatgatcactccgcctccagcgcgccgggatcgggtgtgaagggaaagccgcggaaactggcggcattgtcgaagcgcgtcgcacaggtcgccatccgcttgtcgcagccgacccgcagccggtagccgcagccggccgggggtgccgtcggcagcggcctggcaagaacgatcccgccttgcgtgctgatcgcgacatcggccacaaggccggcgagtgcgccgtccaggatcgtcaggcggccgccgtcgaaccagccggccgtctcggtccgggcgggatcggcgatcgcggtggcggttgccgcggcgatcaccccgtcgacctcgaaccccgtgcccgccaccgccacgccgcagcgggcatcggcgaaatcggccgtacaatccggaccataggcgatgccgatgccctgctgcaggcgctgcgacaccccccgcagctctgcccgccagcggctgccggtgatggagatttcgccgatgcggcccgccgccagcagcagccgcccggtttcgggcgccgtccagtcggcaatggcgaagtccacccgggcgtcgtcgaaccgcccgcaggcgatatccgcggccgagatcgcgtcgtcatccagcggcccgccgacatcgagcccgtcgaccccaagcccggtgcgggcatccaccgcccccggcaccatgccggcgcgggcacggtagagcgtgccctcaaccacgagatcgcggtcatgatcggtcagaccgatgacagcgccgtcatggcgttccacccgccagagccgggccagactgccgagcggtcgggccagtgcagcggcaagcgccgccgaggtcgtgcgcatggtgtctcccctccctcaaagccggatctcgaccagcggcaccgcacgcagggccccgatgccatagtcttccagcgtcgccggcaggtggtcggtgtcgaagcggaccggcacgtcgaaagcaaagccggccgtcagcaccacccctgccgcaggcgccacggcaaggctgaccaggccggtcgcggcatcgacggtgaaggccgccgggggcagttcggccccgtccgccgccacccgcacgctgcccgcgacgggcttcacgatccgccggtccacatgccagggcggcgtctcgtagcgcttgatcagctgaaagccggtggtgctgccgtccccctggcccagcggctggtccagcggcccgggcggaccattgccggcatcgctgctgcaatcggtccagtccttgaagcggaagccgcaggcccggccgcggcgggcccggaagaaggcgatcagccgggccagctgttcaagcccgcgcacgcccatggcgatgtcatagcgggcgcgcgcctcggcccagtcggcattgcgccgctcatggcccgaggccagcaccaccacatcggtggaaaataccggcccgccggccgacccccaggcgatgtcctcggggaagcggatgtcgtgaaaatcctcgatcatcgcatccgaccatcaaccatcgcggcggcgcgcgcgttcggccgcctctgccgcggcacgggccgcccaggcgcggcccggctccagccggtcgcgccgtccggcccggccggcaagttcgtcggccgcggcaggccgcggcgtggtatcgaccgtctcggtcatgtctcgtttctcctcagaattccgtacagacagggggtgcggccgcggtgagttccagggtgacggccgtgccgtcgaagccgttggcgctgatcagcccgggtggcagcaccagccgccgaccggcgccggcccgccccagatccaggatcgccgataccgtcccggccagagcgaggtggccggcgagcgtcgccgccgtcactccgggctcgaagccgagcgtcagcgtcacgcccccgcccagccaggcgaccggcgccggtcgatccggggccgtctggccgtgaagccgggctgccagggtcagccggcagcgccgaagcggcgccagtgccaccccatcgatccacagcccgacatccccaagggcaatccgcggcgaggtgtcggccagcccgaatgccgcaaccgtctcgggttcagccgggagcccgcggagccgcacccccagccgcggcgggccggcctcgtccaggtcgagcgtcagtcgcgccggacgggcgccggtgatccggctcgcaaccccgccggcagccggagcaatcaggacgctcagggccggccccccgcccatcgacggcaccagcaggtcgagcagggcaaggctcgccggcatctcaagttcaagcgtcggcacaaccggcccgccggccagaaccggctggccgggctctgccggatcggcaccggtgcggacgggccgcgccatctccagaccgaacgccgtcaccaccggcaccaggccggcgccggtcatcgtctccagccgcaccgccagcggcgccggggatcggatctgcatgtagtctccccctccttaagcgccgtcgatgcgccagaacaccgccagggtcagcctggcgccgtctgcatccagcgccagggcggcacggctgagaccggtcaggccggccacgaccccgcccccagcctccagcgccgcgccgggcgggaaggccgccagcacgacatcggcggcggcatccagcgccgccatgccggtgccgggcggggccaccgcctcgacggtctggcggccggtcagcgcggcatggccgccggtaccggcgatcgccgcttccatcggccccggggacggcaccagccaggcacccgcggcgggcggagggccgccgcgggtgttgggccaccgcaccggcaggccggccgtggcggccgccgcccccagccgggcatcgaaagcagcacgcagccgcgtctgcacatccggggcaagcgaggtcatcactcgccctccccgccggccggcgcgctgagctgcaaccgccaaaggtccagcaccgccaccgggcggatcgcctcacccacccgccagtcgacgagaccgatcacgatcaggtcgccgggggcgggtgcgacgcccagaccttcgaccagggccgggcggcgcgggcccgatgcggccgaaagatcaggcaactgcccggcggcaacgggatcgcgcccccagatcagccgcccggccgccagccgggtgcgggtctcggtcgtcgtcccgctcgccgggtcgaaggcggcggtcacccgatccagcgcgcagtcgagcgcaagcccgcccgcccccgccagcaggtcgcccagcatccggccgagcacggcatcgatccgggtcatgtccgcaccagccggcggcggtgccgcaacggtgccagcggcgccagcagacgggcggcaagcgccagcgcaccgccggcacccgccgcctcgcccggggtctcgccgtaatcgatcgcgacatcgccgagcgtcagccgccgggcggcaccgccggccgcctgttcggcgagcggccggtccagcgccgccagcgccagttcgatacaggcctgtgccaccggggccggcacggcgacgccgtcgagcccgatcccggtcgcaacacgcggccaggccagaggctggccgggatcggcaggccagccgacgaaatcgtagaaggcatcgatatgggccgtcgcctcgaccagtgccgccaggcggcggccggcatcggcatcggcccagacgacccggccgcgggcggcgtgatgggcatcggccagggcgaggtcggcataggtggcgacggtcatcgcacgatcctcccttcgtgcctcaggccaccgtcagccgcacgccggccaggctcttgacgtcggccgccgcaacctgccagttggtcttctgctccagcgccacatcggtcgggttgatgccgccggccaccacgtcccaggcgaagccgcgcagccggacgttgaaggcgtattcgccctggatgcgcatcaccaggttctcgagcccggtgatcacgtccgagacgatcgagcgctcctcgctttcggccacctcgatcgcatcctcgaccagccccagaacccggtagcggtcgggcgtgccgggggtcaccagcgccgggctgtcgatcaccagggtcggccggccgaagcttgcgaccgtcccctgatagatcgtgaccccggccacctcgaacaccttgtcggcaacgctctgggccatcaggtcgtaatagggtttggagtgcatcacgaagcacgagatgcggccgccggcatcgcccagccgggccatggcccggaccagcgtgccatgggcaagaccggggtcggcctcgcccgagacgtcgagatcgagcgcggccacccccgacagcgccgcagaggcggccctgagtgcggtgtcgacatagtcgacggccaccgccttgccgatctgccggccaagcaggaaggacatctctcccggatcgcggcccagcttgcgcaggctgtccagggtgttggcgaccgggccgatccggcggttgatcttgatgccgacggtctcggcctgggcaagcggcgtgtcggcgacatccgtcaccgcatcgatgtcacggcgggtgacgagcgaggccacgcgcgagatgaagctttcagccgcgtaatggccacggcggcgttccggcaccagccggatggccccgcccgaggcggcgttgaaggcgtcggcgttctgttccacgacctccaccatgccgccgaagaattcttcgggggcgatgcggaagtcctgtcgggtaccgatggtcatgtcgtgacgtctttcgtgtgaaggggctgaagatcagggatcgaggtcgagataggcggcacggccatgctcgcggatgaagcgggcgcgttcggccggcccgcccagatcggcccggcggcgatggcggccggcaccgggttcggggcgggcaccgccgccatggctgtcgggggcggcgagataggcggccccctcgcccgcggcccagtcggtgacgaagtcggcaagcggccgcgtgctgccgtcggcaagccgggcggtcagcagacgggcaccctcgtcgcccgccacctcgatcagcgggcggagcagggccgcggcccccgcaaccagcgccggcgccacgccggcgcgggcaagcgcggtttcaagcccctgatcgacgagcaggcggtgcagctcgccgcgttcgcgctccatgccggccgcaaggctggcgagttcggcgcggtgccggcgatccagccgggcgcgcagcgcggccagggccgcggcttcttcggaagcggtctcgccgctctcggccagacggggctccgcgggcatggggggagcttcgggcaagcgggtgtcctggggcggcaccggcggtgcctcccgggtctggtcggtcatgatcggatgtccttaaactccggcggtgccggatgcggcgccggccggcaggatttcgccacgggtgagcgcccggcgcagttcgccgcgggcgatcgccccgctctgccatgcctcgaccagcgccgtcagttcgtcggcggccatcggccggggccagtagtcggtgttcagcgccacgcgcgtgggcgtcgcgggctcgatgccgagccacggcttcgccaggtccagcgcccggccaagcccgtccccggccgcctgggcaagggcagacagggccgaattctcgccctgccggtggatttcggcggtcagcgccgcctcggcgaccttcttctcgggcgccagcatgcgggcgccgagcgcggccatctgggcctccttgcggtcgagcaggcgttcgagcacgcccagcccctcgccgcggaactccagaaagaaggccctggcctcgggcgcctccagcacccaggcctcgccggcgccgatcgccagcggttccgtgccgtcgaagcgctggccggtgaccaccgcggtcggtagaccggtgtaatgggcaccatgctccagatcggcgctggtgcggtaatgggagaggttgacctcgaccagatcgagcagtggcggccgcgccacctccagccccggcccgcgcggaccgatgcacaggaagggaatccggccgagcggtcggccggcggcacgcggctcgatctcggccaccaggctcggccgctcgccgccgccgctggcccaaaggcgctggcgatagatgccgtcggggtccagatccaggctccggcggcgccggatgcccgcctcgtcctcgccctcgtccagcagcacatgaaccagatgcctgcccgcgcggccatggccgcgatcgagccgccagtccaggatcgcctcggccggataggggaccagatagggcagccgcccggccgcggccgcagccgccctgctctggggcccccccgcctcgccgggcggatgatccaccagcagaccgatccggccggtggtcagcagttccgccaccacatgctcggccaggcgcctgaagccgtcgccgctaccggtcggatcggcgatcacgggggcgagccccggtgccgcctcgatctcgggcggcttgcgaaacaccagaccgctcaggccgtcgatggtacgggcggtggcgttgtaaaacagcgcccggtcgcgatagccgcgataagccgtctcgctctggccgtccaaccgcggcagatagcattcgccggcggcatgtactgcctcctgccccgccgcgacgtcgcggcagcgggcccaggcggcccggcgggcggcatgggccggatggacgcggtcggccgcgcccggcgcaccgggcgggcccggtccgaatgtcgtcatcggatttgtcctcgacatatctgaaaagggggctggcctcaaagaccgcccaatttgaggcggaccacacgcccgcgctcggcatccagccaggacagcagctggctcagcgcgtcgacctgatcgtcatgggcggcgttggggaagatcgtcgcctcgcggacgaaatcatcggcccagaccgcccccgcctcgatggtgaagccgcccgcctccagccgcggtgtcgtcaccgccagccgggtgagcttgtcggccaccggccgcaccgcctgaaccggcaggcgaccgggcatggccttcagatcctggatcagcgattggcccgatgccttgtcctcgaccaggatcaccgagggccgccagcgcgcggccaggcgggccgcctcgcgccgcagcgccggatattccagccgctcgcggaacacctccgccagatgcagcccgtcctcatgctcgatgaccgtcaggcagacgctcggatcgttgagcgcgtccgccttgtaggcggtgtcccagctctgcagcacccgccggccccgtgccggatctggcctggccgcaggccgcagccaggcagccttgatcagcccgcccgcggccggtgccggtcgctgcagatactgcgcggcatagcctgcctggcccagcatgcgccgggcctcggccagttcgtcccgtccctcgcgctcggggtgcagcggcacgcccggtcggcgaagcgtctgcacggccccgaaatggatccgctgaacgctctcgacctcggccggcagcgacagatggctccagccgccacgggccagcagatggcccgagagatcggcctcgtgcagacgctgcatcaccacgatcatcgccccccggcgcttgtcgttcagccgggtggagagggtctgatcgaaccaggtcagcgcggcctcgcgcagggcggccgattgggcgcggcgcggatcatgcggatcgtcgacgatcagcagatcaccgccatcgccggtcagcatgcccccgatcgaggttgcgaagcggaaaccgttggcggtggtggtgaagcgctgggcacgatcgcggccacgactgatgcgggtctcgggaaactggctctgataccagccgctcttcatcacctcgcgggtatcgagcgaatggcgtcgggccagctcatgggcataggaagcgacgatgaccctcaggctcggatcatgtcccagacgccaggccggataggccacggaaatcgtcagggatttgagcgagcgcggcggcacgttgacgatcagccgccggatctcgccccggcgcacagcctccagatactcggccatcaggtcgatatgccagttgccgagaaatctgctgcctgggtcgacggtgcggaaacatcgggcaatgaagctggggaagtggctcctgccaatcggctccagctcgtccccggggatcatcaccctcggggacaacctctgggcggccgcagaaaacccgtcatgtgcgtctccggctattgtggaagaacagggtgaagatggcgggaaactgcccgcatcgccgcgggcaactcgccatcatggtgaaattgttacatcaaaatcggccaatggttgcatgggaagttgtggcaacacggccgcagccaccgggtcagccggcggctgcctcggacaacccatggatgcgctggaagatcaggaaatcaagcggcgggggtgcaacctcggtctgggtcagcatgtcatgggcctgaccgcgatggtgggtctgatggttgaaccaatggccgagaaacagggccagctggtccgagaaccggtcgccgcgggtggtggtataggtgaagggttcggtgaagcgcgacagcggcagggcggtgatcgtgcccaggatgcgctgatccagcccggcacgggcattgcgcaactcgttgaaatgggcccagggctgggcattcagcggccggtcgggcgccgtggtgccgttcagccgggccaggaacagttcgtcgaccaccatcatgtggttgagcacgccgcggatgctgccgaagaacgccgcccgcggccgttcgaactccactacgggcaggcgagccaccgcgtcatagagcctgagattggcccaggcattgtagcgggcgaggatgccgaaatagctgggcatgtccataagggtacaactccgactggcggtgggcggcggaaccatggctgccatcatgacccgccgacacgcgcagggatatggcggggtcgaagaaaatcgcgaaaggaaaacatctctaacgagatataacgtcggaatttatcaccaacacgcgcatatcatcgaatgatcttgcctctttgcgcgcatatcctctaatctcgccttacgcggtgatccgggggcatgtcatgcatcgagggacgggacgggcactgctgctgttgctgatgctggctctttccggctgtgccggcagtgatgcaccggagctgccggccaccccgagcccggtggtcgagcgcgcggcccagtggcgcggcatcgccgaagatgccgccctgcagatcagggcaggactgccgcccggcgcacggctggtgatcgccccacccgaccgccgaagcgccttcgccgaccggctgcccgatctgcttgccgcggccttcatccgccagggtttcgcggtctggtcggcaccgcccggcgatgcggcccctctggtccaggcatccgcccccggtttcgatctgcctccggccgatgcgtcgatgggcctgcttcgggtcgaaaccaggatctccgcggtcggtcacgatgccgaagatacccgcagcctgctggaagccggccactacaccctgctcgccaccggcgtctacctgctcgaaaaggccggccgcgagggcgtggatctcgtcgccaatccgggctggctgatcggcgccggcctcgccgccgatctcgccaactgggcggagcggcccaccccctctaccgaactggtgctgggggtgcgggtgctggacggcgcccgctacgtcaccgccaccgaccgggtctacctgatccgagacggcgatcgcggcctctacaccggccggcggcgggcctcgcccgacacgatcaccgtactctatgatccacgcggtgacagcctctcggatgcccggcaggctgcagcccgccactgcgcccaaaccgcacgtcagccgatgctcgccgcccgctgggcccccgcccccgatctgcccgatgatccggtcgatctggcggtggcaaccctgatcgatgacggcgggcgccagccgcgccatggtgcccgtttcgactgtgtcgatgccgatgcgcggttctaggccactgcgcttcagatgggctggccacgatccgcctgggcctcggtcagcgctttcgcaaaggtgtccggatcgacattgccgccggtcagcaccaccatgaccgtccgcccggcaaccggcacccgtccggccagaaccgtcgcaagggctgcggcgccccccggttccaccaccagtttgaagcgcgcaaaggcgtaaagcatggcgcgcgccacatcggcatcggtcaccgccacggcggcatcgaccacctgggcgttgatcgcaaaggtcagcgccccgggaatgggggttgccagcgcatcgcagatcgtacgcacgccgggcacgttgccgatccgccgtccctcggcgatcgatcgggcggtatcgtcatggccggcaggctcggcgatcaccagcgccggccggtcgggcagcgcctgcaggcaaagccccgtacccgccgccagcccgccgccgccgcagggcaccaccaccacatcgggccgctgccccaggctttcggcctgatccagcatttcgaccgcgatcgagccctgccccgcgatgacgtcgcgatcgtcataggccgagaccacggtcatgccgcgttcggcgccgatccggcgggtgatccccacccgatcgtccgacagccggtcgtagaacacgatctcggcgccataggcgagcacgccctcgatcttggtgcgcggcgcatcggccggcatcacgatcacggcaggcgccccgaattcccgcgccgccgcggccagcccctgggcatgattgcccgaggaatagccgacgacgccgcgcgcccgcatctcgggcgacatcagctccagccggttataggcaccgcgatatttgaacgaaccggtatgctgcagcacctcggccttgaccagcagccgcccgcccaactcggcatccacgcgggcggagcgcagcagcggcgtctcgatcatcgacgatcgcatgcggatccaggtccgccgcagcaccgacagggtcggccagttcgacgcctggatctgctgcaggctcggccgggcgcgggggggcaggagaacggtgccggcgcggtcggcatcgatcaccggcagatccaccgcctcttccgggcgacgaagcccgccccagaggttcagcgcgggttccagcggcacgccggcacgcgcccgcgccgccgcactcagcggccgcgcggcaggtttgggaccgggggcataggccgacgcagcagccgtggtcgaggtcgggcggtccgggtcgaagggcatggcatcgccgtctgaagcgggacaggaggccccagcatatatcacgcccggccctgcgccgactatcggcccgctccgcaaggctccggcgaaaaaagctcacaccttcgatgatccgccgtgattataagcggaatggtggtggcgccgcggcagcgccgtccccctgttcgacgcgtggaggaccgccgatggaactcgccaaccagctgatcttcgtaggcgccgccctcgttttgatcagcatcggggccagcctggtctcctcccgcttcggcatgccgctgctgctggtctttcttctgctcggccttgccgccgggcctgaaggtctgggcggcatcgtcttcgccgatatagattccgccgccctgatcggctcgctcgctttggcggtgatcctgttcgacggcggcctcaagaccaagggcgagaatttccgcgtggccctctggcccgccacatcgctcgccaccatcggcgtgctgatcaccgccggcctcaccggcctgatcggctgggcgctgttcgatcagctgggcctgatggccggcctgctgctgggggcaatcctcagcccgaccgatgccgcggcggtgttcttcctgctcggcagccgcggactggtgctcaaggaacgggtcggtgccacgctcgaaatcgaaagcggcagcaatgatccgatggcggtcttcctcaccatcggcctggtcgaactgctggtcgccggtgccgcaggcggcgacggcctgggtgtggtcgaactcgccggcatcttcgtcctgcagatgggcctcggcgccggtttcggcctggtcgcgggccatgtgctgggactggccatcaaccggctgcgcctcgcctcgggcctctatccgctgctggcgctggcgggcgccctcttcaccttcggcctgaccgcggtgctcggcggcagcggcttccttgccgtctatctgatggggctgatgctcggcaaccggaagcttcagggcttccacaacatcatgcgcttccatgacgggctcacctggctcgcccagatcgtgatgttcctgatgctggggctgatggtgctgccatcggggctgatcgcgatcgcgccgctcgccctgccgctcgccttcgtgctgatgctggtggtgcgcccgatcgccgtctgggtgtcgctgctgcccttcaacttctcgaaggcggaacaggctttcatctcgtgggtgggcctgcgcggcgcggtgccgatggttctcgccctctttcccacggccgccgggctcgatgtcggcccgctctatttcggcatcgccttctgggtcgtcgtggtctcgctcaccatccagggctggacgatcaccccgcttgcccgctggctgaagctggagatcccgtcgaaatccggcccgatcgaccgcatcgaaatctcgctgcccgaactgcccgaccacgagatcgtgggttatgcgatcgaggacgacagcccgctggtcgatcgccatccgcgcctgccgccctgggcgcagccgctgcttctggtgcgggaaaagaccctgaccacccctgcgccgggcttccgcctggctgtcggcgacacgctctatctgctggcgccgccctggaaactgccggatctggatgcggtcttcggcggccgggcggaagaagatgccgccttcttcggtgcattcaccctgaatggcgaggcccgtctgtcgggactgggcgatgcctatggcgtgccggtgccggccgaggcgctgcgcgagacgctggccgatttcatcgatcgccagttcaaccgggcgcccgtggtcggcgatgtggtgttcctcggcaatgtcgccctgatcgtgcgcgaacgtgacgagaccggccgcgtcaccaaggtcggcctcgatctcgacgggctgaagcgccgtgcgccccgcgtccccttcctgcccgactggccgacgctggtccgcgccgcccgccatctgggcccggggcccgcccgggccgtccgccgcctgcgcgaccgcagccgcggcaccaccgccacccccgtcgccgcccggcccgccgacagcacccgccgcggcctggcggagcgcctgcggcggatgctcaggcgcaggtgacagccggggcccctctacaggcgaggtgtcagcttaagcgtgcggtcccgccgatgccggcctatgccgcttcgaacggcttcgaaaatttcaacaggcaacatgccccaggcaaagacgtccgaccggtcgcgccggaccggccggagatcatagccgggccatacaaaccagttgagttctcgcgtcacgatccaggagggttgatcatccaggccaagccgttgcttgaccttcaaaggcaacgccaccgcatgaggatcatcgtccggcggggtatgcgtgatcggcacgacatatacacgcctgtctccgtcctcgtcggtcatcgtcatgaccaccgcgcagggcctcgctttccggccttcctcctcaccgccatcacgctgatgacgccaaaggaagacgtaggagataacgaggcccggtacgggatcaggaagaggcatccgtcagtcgtcgagcgagtagcgcaacgcttccgggatttccgccgcctcgagggcggcaaactcctcgtcggtcaactcctcggccgacacgtggccccgcattgcctgcttcagacggtgataggtcgcagccgagatgatcacaaccgtctcgcgaccttgccttgtcacgcggaccggctccgtcagtgcccggtcgtgccaggcatcgaagtccttccggatctcggacgctgtcacaatgctggacatgacgcacctccgctctctcgcccacacagaagatgtggccatccgcccctgcgtgcaaggtcgcgacggcaggtcacaccacgtcgaaggtcagctcacccacatgctcgatgccgcagcggaccttctggccgcgggcgatcgggccgacaccggcgggggtgccggtgaagacgatgtcgccgggtttgagcgcgatatagcgcgacagttcggcgatcacctcggcggtggtgcggatcatctggttgaggtcggcctgctggcgcatctggccgtcgacttccagccagatccggccgcgctgcggatggccgaagctctcgacgcgggcgagtgcgcccaccggcgccgcctggtcgaagctcttcgccatgtcccacgggccgccacggtcgcgggcggcgttctgaaggtcgcgccgggtcaggtccacgcccacggcatagccgtagaccagcgacagcgcctgatcggccggcacattcgccccctcgcgaccgatggccgccaccagctccacctcgtgatgcaggttggcggtcatcggcggataggcgacctttgcgccgtctgcgaccacgcaatcggccggcttgatgaagaacaccgccgcctcggcactcacatcggtgccgcccatctcgcggatatgatccgcgtagttcttaccgatgcagaacacgcggcggaccggaaaccggatcgccgagccgcgaatcggcaatgtcggtgcctcccacgatgccaccgccagaccgtaggtcatgctccctccccccttggatcgatctcgtcccggggcgcagggtcatgggtgcgggtgcaggccgccctcgccaccggggcgagaaagatacgtccgcacccggtccatgttaagcgtttgtgatatattccggtgattttgcgtccgaaagttacgccagccggtcgcgcggcgtcgcgccggcgaagaaggcatccagattgtccagtgcccggaagcccatcgcggcccgggtctcgacggtggaggtgcccatatgcggcaacagataggcgttgtcgagttcggcccagcgcggatcgaattgcggctcgccggtgaagacgtcgagccccgccgcccgcaaccggcccgacgtcagggccgcaatcgccgccgcgtcgtccaccagcggcccccgcgcggtgttgaccaggatcgccccctcgggcaggcgggcgatccgctcggcattgatcatgccgatggtctcgggcgtcgccgggcagtgcagcgacagcacatcggccaccgccaccagatcgtccaggctgtcatgatagacggcgtcggcaagatcggcacccaatgccgcctcatccagccggcgacgctgatgataatggatggtcatgccgaacgccttcgcccggcgtgccgtcgcctggccgatacgcccgaagccgaccagccccagccgcttgccgcgaagatcggtgccgagcatgaaagtcggcgaccagcccgaccagccgccggtgcgcagcatgcgctgcccttcataggcgcggcgagccgcccccagcatgaccagcatggcgatatcggccgtcgcctcggccacgacgtcgggggtgttgaacacctgcagcccgcgcgccttcgccgccgcaaggtcgatatggtcatagccgaccgagaaggtggcgatcgcctcgacgcaggcgggcagcccctcgatcgccgcccggtccatgcgctcggtgggcgtcagcagaatgccacgggcggtgttgtcggccgccagcgccgccagctctgcggccgggatcggccggtcttcggccagacggatcacgcggtaatcgcccgccgcccgctcctccaccgcgtcgggcaggtggcgggtgacgaccaggaccggacgatcggcaggggcggacatggggcaactctcccggatctgaggaacggtccgcagcatatcccgagcctgtcgggctccgccaccccgtgtttaacatcatgattctgttgttcttgaaaactactctgtaaatatgtgttgtttatgggatccaccggacctacattgcttttcaacatgctgatccgcattcaacagatcggatccgtttttatcatcccgcccgccggaaccggcgtggggaggagaccgatgaccgcgctgctgcccgtttcgctcgatctgcgccgcctgcccgtcgccgtggccggccatggagagaaggcgctcacccgcctcgccatgatcatagaggcgggcgccattcatccgcgtgtctacgcaccggatgcgcccgcggatttcatcgcccgggccgaggcgctgggtggcgtggtggtcgaccggctgccgagcgatgccgaactcgatgatctgcgcgtgctgttcgtcgccgatctcgatgtcgagaccgcccggccgcttcatgaccgggcagaggcgtacaaggtgctggtcaatgtcgaggacgtggtaccgctctgcgccctgcaggtgccgtcggtgctgcgccgcggcgatctggcgatcgccatctccaccgccggcgccagccccagcctcgccatcgccatgaagcgtgaactcgcccggctgatcgggcccgaatgggccgagagaacggccgccatccgccggctgcgcatggcgctgcgcggtgccggcacgccccccgccgcggtgaaatccgcaaccgacgagatgatccggcgcgaacgctggctgcccctcggcggcgcagcaccgcgttccgacgaaaccgatactgctgcaaccaccccgaccgaccatccccgccgtgtgaaggcctgacccttccccccccgaaggccggggacggaggtcagggccggacgaacgagaaaagaccgcgaaaggtcctgatcaccatggccgtgatcgagaatgcgctctacgacgagctgaacttccgcctgggtcgcctcgacgggatcgaactgatcgccgccgctgcctatggcccgctcggcggccgcctcgcgctggtgtcgtccttcggcaccgaggctgcggtgctgctgcacatggtctcgcgggtcgaccgcgacctgccggtcatcttccttgaaaccggcatgctttttcccgagacgctggcctatcgcgaccagctgatcgaccggctgggcctgcgcaatgtccagtccgagacccccgatccggtcgaccatgcccgcgaggatccggaagacgagctctggatcaccaaccccgatgcctgctgcgccttccgcaaggtccgaccgctcgccaaggcgctctcgcgcgtcgacggctggatttccgggctgaagcgccatcatggcggcggccgcgccgaggtgatgccggtggaacgcgacggccggcgggtgaagctcaatccgctcgccttctgggatcgcgaccagatcctgggctatttcgacacccacgacctgccccgtcatccgctggagtcccagggctacgcctcgatcggctgcatcccctgcaccagccgcacccggccgggcgacgatctgcgcagcggccgctggtcgggccgggccaagaccgaatgcggcatccacaccatgtccgacggcgccggcatctgaacgtctccggtcggccgcgccggttgaccgcggccggcagggcgccgatgatcggcccacgccctgcatcctgaagaccggagccctgcccccatgccgaccgacctgcctgccgaccgcaccgacgccggcatcgccctgccgccgctcgatgcgctggtcgatcttgcgcgccgtgccggcgaggcaatcatggcgctctacggccccggcgtcgaacgctggaccaaggccgatgaaagcccggtgaccgcagccgatctggcggcacacgaggtgctgaccagggggctcgccgccctcacccccgatctgccggtgatcagcgaggaagccgtcaccgaagcggagcttgccgccggcgcacccgccgccgccttctggctggtcgatccgctcgacggcacccgcgaattcctgtcgcgcaatggcgagttcaccgtcaacgccgccctggtggtcgacggccgcccgattgcgggcgtggtcggcgtgccggccaccggcaggatctatgccggctgtcccgatggcgccgtggtggtggaagccgatggcagccgccggccgatccgggtgcgcgccgtgcccgccgatggcccggtggcgctgatcagccgcagccatctggatccgcgcacccgcgactggctggcggctcacgaggtggagcgcagccgccaggccggctccagcctgaaactctgcctgatcgccgagggcgaggccgatctctatccgcggctggggcgcaccatggaatgggacatcgccgccggccatgccgtgctcctggcggccggcggccatgtcgacaccctggcaggccccccgcttacctatggcaagccggggctcgacaatccccatttcctcgcccgcggtccctggaccaccggcgaggcggcggacgtatgaccggcgacatcgacacccgcctgctctcccgtctggtctctgccctcaccgccagcgccggccgccatccggcaagtcgggccgatctggaacgccgcgcccgcagccggctgacccgctggcaggaagccgccgccctgccgcccgaaacgctcgacaccatggtggcccgggcgctggacaaggtcgccgccgccgggctggtcgatgacgatgcctatgcccggctccgcgcccgcagcctgcgcaatcgcggccggccgcgcgccggcatcgcccgcgacctgtcgctgcgcgggctcgaacctgcgcggatcgagggcgtgctctccgacatggccgaggatgaaggcggcgccgacgaccggatcggcgccatcgcctatgcccgccgtcgccggctgggcccctggcgacccgcagccgcccgcgacggcacccgccagcgcgacatcgccgccatggcccgtgccggctattaccccgatctcgcccgccgggtgatcgatgcggtcgatgtcgatgccctggacgactgggcggccgatgccgacgccctgcccgaccggcgccggccgggcagtgccgcagaggactgaaggttcagcccaggctgcgctctatctcgtcggcaagtgcctccagctcctgggcagccgccgagcggggttcggtctccgagaccgcgagcccgtcgagcagcgaggccgcaaagcccgtccggttggcgaaacgggtggtcgccaccggggcgcccagcgctgccaccgcatcgatcatcgcctgggcgaggcgcgcacgcggcgccacccggttcagcaccagcagcacctgccgccgctcggcccgcaccaggtccagggtcggccgggtcgcgcccacatcgaaggggttgggctgcaccgggaccagcaccagatcggcggcacgcaccgcgcggcgggcatcgttttcggcctcgggcggggtgtcgacgatgaccacgtcatgctcgcgcccaagccccgccagctcgccatccagccgccagcccgacagggcccgcatggtcaccgccggccggttcgggctgcgctccgcccgccagcccgcccagcgggccaggctgccctgatcgtcgatatccaccaccgccacccggcggccgcgtgccgcccagcatcccgccagctgcgccgccagcgtcgtcttgccggcgccgcccttctgctgtgcgatggtcaggatcatctcccgtctccccgatacgttcctcatccggcgttgcactcacccgccgatatccgagctgaagcgtgacctctgcgacggctggccgcaagcctcgtgcgcggttgcgtcgcgcgccccggaccggcatagtcggcggataccgaccctgtggcgccggccggttccggtgcccgccctcgtgcggagacaaccacatgctcagcgccgaagagagcctccatttcatccgcgagcggatcgacgccctcgggcatggcagcaagcaccatgaacgggctgcgcatgacgcgttgacgctgctgtcgaaccactggtccgaggaaagcggcgagtcgatggacaacgacctcgccgtcatcgagatgatcggccaggatcttgccgatcttcagcgccacatcgccgaccttcagcatgcctatctgaaggcgcttttcggcgacaagcccgactgacctctgcacccgtgtcccctgaaccaacccgccggctgaaggttgcggtcgatccggtcagtgccgaagaccgccgcgccatcgacgacgcggcggcgctcgtcgtcgccggccgactcgtcgcattcccgaccgaaaccgtctacggcctgggtgccgatgccacctcagacgcagcggtcgcccgggtttatgccgccaagggtcggccagcccgcaacccgttgatcgtccatgcgtccgatcccgaacaggggctgatcgtggcgcgcgccgacgatcgggcgcgggtgcttgccgggctgttctggcccggcccgttgacgatggtgatgaagcgccgggcagattgccgcatcgccgatgccgccaccgccggtggccccacggtcgccgttcgggttccggcactgtcggccgcgcgcgcgctgatcagggcggccggcgtgccgatggtcggccccagcgccaaccggtcgggccatgtcagccccaccaccgccgatcatgtgctggccgatctggacgggcgtatcgccgcggtgctggatgccggcccctgcccggtgggtgtcgaatccaccgtgatcgatctctcaggcccccggatccgtgtgctccggcccggcgccatcaccacctcgatgctgcgggccgccctcggcgccgacgatctggccgatccggcggacggcggcgatctgccggcagatgacggcctctcggccctcccctcgcccggcatgctcggcagccactacgcccccggtcatgcggtgcggctggatgcaacggcgccgcttcccggccggcgggaggtgctgctcgcctatggcccgccgccgccgggctttgcccatgtgctgcagctgtcggccgatgcccgcccgcgcgaggccgcccggcggctctacgcgctactgcgcgccgccgatggcttcgatgtcgatggcattgcggtcgcccccctgcaggtgtccccagccgaccccgatggtgaaatcctggccgccctcgccgaccggttgggacgtgcggccgcgcctcgtgactgaccggtcatgccgtcatcaccccgacacggagaggttctaaggtgagcgatcttttcgatcgcagcggcggagcagtgatgcggcaatccagggagcaggatctcgaccggctgattgcgctcgcgctcgccgcaccgggcgaagccggggcggccgtcggcgacctgccggcaccgggcgactggcgggcgggggcgattgcactgcgcgccgcgccgatccctgccaccatccattgcatggacgtggtcgaccgtttcctcagggatccgaccctgcccgccctggcggtggtggatggccaggaacggccgatcggcctggtcgggcgcacccatctgctctatgaattcgcccgccccttcatccgcgatctgtatgcccgccgcccgatccgcgaattgatggcgccggatccgctggtggtcgatgaaggcaccgggatcgaagcgctgggggccgagatcaccgccgtcggcggcggcgccttctcggccggtttcgtggtcaccgccaagggtcgctatctgggggtcggctcggcgctggacgtgatgcgccggctggtcgcccgcatggccgagcacaaccgtgcactcgaccgcgcggtcgaagaggcggagcgggccaacgccgccaaaaccgccttccttgcaaatatgagccacgaactacgcacacctctgaatgcggttctgggcttttcggagatcattctctctcagatgctggggcccgtcggccatgcccgctacctggaatatgtcggtgacatccattcctcggccgaacatctgctgtcgctgatcaacgacctgctcgacgtcgccaaggccgacgccaccggcctgccgctcgacatcgagccggtcgaccccacgagcctcgccaccgaaacgctgcgcatggtggcgccgcgggccgaaaaggccggggtgatccttgccgccgacctgccggagcggatgccgatgatcaccggcgaccgccgccgcctgcgtcagatcctgctgaacctgctgtcgaacgcggtgaaattcacccccgacggcggcgaggtgcggttgatcctggaagacgtgcctgccgtgccgggtgcgccggcctgcatccggatgatggtcgccgataccggcatcgggatgagcgccgatcagatcccgatcgcgctgtcgcgcttcggccagatcgattccagcctcacccgtcgccatgacggcaccggcctcggcctgccgctgtcgcgcgcgctggcggaactgcatggcggcgggctcaccatcgacagcacgcccggcttcggcaccacgatcaccgtcaccctgccccatcgggcgatggtcaggccggtcggaacggatccggtcaaagcagacccagggctctgagttcggccgcaagcttcgggtcgccgccttcggcgctgccgctgcggcggtcggccggggcatcctcgggcttcagatagcgccaaccctgatgcggcttgcgcggctgggtctcggtctcgaccaggtcggggtccagcaccagggcgcagcggcgcacgccatccgtgccctgcaccggctccagcgccaccagccgctgacgggctgagaccaggccgcggatcacccagtagagcgagccgccatccagcagggccgcggtttccttgggcgtctggcgggtgacatggacaagcagcggcggccggcccgcggcgcgggcttctgccagccgggcggtctggagttcggccagatgttcgaccgagttgaccccgaccgcgagtttgagaagatgcagcgtcatggcgcgcactctatgccgtcctctgccgctacgccagaggctgccacacggcacctcttctcccgatccggaaggccgctcccccatgtccgcaccgctgaaccgcccctcgcccgagatcctggaccgcatccgcgccgtggtggggccgaagggctggcgtgacgatccggcggcgatggaaccgcatctgaaggaatggcgcggcctctggacgggccggacccctgccgtggtgatgcccgcaaccacggaagaggttgcagccgtggtgacgatcgcgtcgcaagccggcatcgcgctggttccccagggcggcaataccggcctggtcggcggcggcgtgccgaccgaaaccggcgacgaactgctgatcagcctcgcgcgcatgaaccggatccgcgatgtcgatgccgcaggcggcagcatggtggccgaggccggctgcattctggccgatgttcaggccgcagccgcagaggccggccggctgttcccgctcagcctggcctcggaaggcagtgcccgcatcggcgggctgatctccaccaatgccggcggcgtgcatgtgctgcgctatggcagcatgcgcgatctggtgctggggctggaggtggtgctgcccgatggccaagtgtggaacgggctgcgccggctgcgcaaggacaataccggctatgcgctgcgccagctcttcgccggcgccgagggcacgctcggcatcatcaccgcggccgcccttgaactggtgccgatgccgcgccaccgggcggcggccttcgtcgccatgggctcgcccgaggcggcgctcgaccttttcgcccgcgcccgcgcccatgcgggtgatctcctcgaagccttcgagctgatcaatgcgacgccgatgggcttcgccctccgccacattccgggcctcggcgacccgctgcccgatgccgccgggccctggttcgtgctcatcgaactggccggccccatcccgctgggtgatctgctggaaggtctgctcggcgaggcactggaagagggcgcgatcgaggacgccgccatcgcccagtccgaaacccagcgcaacgccttctggtcgctgcgcgagggtctgtccgaggcccagaagcccgagggggccagcatcaagcacgacgtctcggtgccggtctcggccatcccggcgctgatccgccgcggcggccgcctggtcgaagagctgatcccgggcgcccggctctgccccttcggccacatgggcgacggcaatatccacttcaacgtcagccgcccggtcgacatgaccgatgccgatttcctggcccactggcacgaggtcgccaccgccgtgcatgatctggtggcggagctgggcggcagcttctcggccgaacacggcgtcggccggctcaagaccggcgatctcacccgctatcgctccgaggtcgaggtcgggctgatgcgggcgatcaaggacgtcatcgacccggccggcatcatgtcccccggccgcgtgctgtcgcgggactgatgcgacgaggcggccctcagccgatgaaggccgccatcaccgccttcagcaccggccggatgcgggccgcgcgctcgggcaggaagctgaagggcgggccgttctcctccatataggtctcctggaccagttccatctggatcgcttccacgccctggtccgggcggccatagctgcgggtgatatggccgccgacgaagcggccatcgaccacatgagtatagccggccggaccggcggcggccgccgccgccgcggcgacccgccccctgcggtccgggctcatgcttgcgccgcgggcggtgccgatgttcagatccggcagccgcccctcgaacagccgcggcaccacgccccggatcgaatgggcatcccagagcagcgcccggccatgggcggccttcgcccggtcgagttccgccgccagcgccgcgtgatagggctgccaatagctggccacccgcccggcgatctcggccgcgtccggttccgcaccggccagatagagcggccggccgtcgaacagcgtcgtcgggcagagcccggtggtcgcctggccgggatacaggctctcgcccgaggacggccggttcaggtcgaccacatagcgcgacagccgggcggcgatgatcgtggcatcgaattcggccgcgaagtcatagagttcggggatatgccagtcggtatcggccagatccagcgcctcgggcgtcagccgcgcctccagcccgtcgaacaaccccgtgccgcaatgaggcatgctcaccaccagggccgaaccgccgcggcggagggtatagacctcgtgcaccatcgtctcgccggtcatcccgccatgccctccctctccaggctcacctcggtcaggtcgcagaagcggccctcgcgcaccatcatgccggccgcggtcaggtccggcgcaaaatagcggtcggtttcgtaagacggcaccaccgcgcggatccgcgccaccgcctcttcgaccttggccgccgcgcggagcggccggtggaattccagtccctgggccgccgccagcagctcgatgcccacgatctcggacacgttgtcggcgatgtcgcccagccgccgtgcggcaaaggtcgccatgctgacatggtcttcctgattggccgaggtcggcaggctgtcgacgctggccggatgggccagggtcttgttctccgaagccagcgccgccgcggtcacatgggcgatcatgaagcccgaattcagcccggcatcggccaccagaaaggccggcaggccgctgatggacgcatcgatcagcatcgcgatccgccgctccgccagcgcgccgatctcggcggccgcaatcgccagctggtcggcggccatcgccaccggctcggcgtggaaattgccgcccgagatcacctcgccggtatcggtcatcacaagcgggttgtcggtgaccccgttcgcctcgatggtcagtgtgcgggcggccatgcgcatctggtcgagcaccgcccccatcacctggggctggcagcgcagcgaatacgggtcctgcacccgatggcagtcgggcccctgatgagcggcgttgagcgggctcgccgccagcagatcacgataggccgcggcggcatcgatctggccgggttggccgcgcagcgcgtggatgcgtgggtcgaagggccggtggctgcccatcaccgcctcgaccgcgatcgcgcccgaaaccagggcagagcgatagcaacgctcgatccggaacagcccgtccagcgccagcgcggtcgagacctgggtgccgttgatcagcgccagaccctctttggcgcccaactcaatgggcgccagcccggcacgggccagcccttcggctgccgacaggcgctcgtcccccgccatcacctcgccgatgcccagcagcacaccacagagatgggcgagcggcgccagatcgcccgaggcaccgacactgcccttggacgggatcaccggcagcacgtcggccgcatgcagcgccagcagcgcctcgaccagctccccccgcacgcccgaggcaccgaccgccaggctcgccgccttgatcgccaggatcagccgcaccaccggtgccgccagcggtgccccgacgccggttgcatgcgacaggatcagattgcgctgcagccggacgaggtcgccggccgcgatgcgcttctgcgccagcttgccgaagccggtattgatgccgtagacggcctcctcgccggccgcgatgcgcccgacgatcgcggccgaggccgccatccgcgccggcgccgcatcgtccagcgccagatgcggccgccccgcccagatccggcggagatcgtcgagcgggatccggcccggcgccaggaccagggtctctgtggtctcggtcatgcatgcagcctttcgagcgcggcccggaagcggcgggcgatggcgtcctcgtggagatgccggccgcccgccacgacatggcggcccccggcgaaaacatcggtgaccagcgggcgattgccggcgaagatccagccgtcgagcacgctgtcgggccgccggccgatcatcgaggcatccgcggcgtccagcaccacgatatcggcgcgcgcccccggcgcgatgcgcccggcctcgatccccagcgcccgggcgcccccgcctgcggtggtcagatacagcgtctcgccggtcgatctgccggcgccgcccgacagcacggtgcgccggccgctcaccaggcgctggccgtattccagcagccgcaattcctcggccaccccgatcgagacatggctgtcggtgccgatgccgaagcagccgccctcggccataaaggcctcggccgggaagatgccgtcgcccagattggcctcggtcaccgggcagagcccggccacggcaccgctctgcgcgatccggcggcgctcgtccacggtcacatgggtcgcatgcaccaggcaccagcgctcgtcgacggcggcatgatcatacagccagtcgaccggccgggcgccggtggcggccaggcagtcggccacctcgcgcggctgttcggcgatgtggatatgcacggggcctgtcggccgcgccgccagcacctcggccagcagggccggcggcacggcgcgcagcgaatgcggggcgatgccgaccaccagatgcggatcggccgcggcttcggcctccagccgcgcgaccagggccaggaaacgatcggcatccagaatgaaacggcgctggccctcggtcggcggcaatccgccgaaacccgacgcggcataaagcaccggcagtatggtcagcgcgatgccggtctcgcgcgccgcggcgacggcgcgcaggctcatctccgcagggtcggcataggggctgccgtccagatcgtgatgcaggtagtggaactcacccagcgcggtgaagcccgccttcagcatctccacctggccccaggcggccaccgcctcgaaatcctcgggcgtcatccggtcgagcgcccgatacatggcggcgcgccagctccagaaactgtcggccccctccgccccggcccgctcaccaaagccggcgatggcgcgctgatgggcatggccgtggaggttcggcatgcccgggacggcatggccgtccagccgcagcgcatcggcgggtggcacggcatcggcctcgatgccggcgatccgcccggtcgcatctatggtgaccagaacatcacgttcccagccctcgggcaggcgggcagtcttcaggaacagtctctgcatcgggctccgctccggtctcgacatagacaagcctatacaagcttagacaagtctgacaagatcgttctcaacgcgaccgagatggagacgacggccatgaccacggcgacccgctgggaccggatctgggtgaacctgcatgtggcaaccatggtcccgggcgacgagccctatggcgcgatcggcgatgccgcggtggcggtgaaggatggccgcatcgcctgggtcggcccggcgcaggatctgcccggcctgccggccatgctcgccaccgaggtgatcgatgccggcggcgcctggatgacccccgggctgatcgactgccatacccatctggtccatggcggcaaccgcgcccgggaattcgagctgcggctcaacggcgcctcttacgaagagatcgcaaaggccggcggcggcattctttccaccgtcaccgccacccgtgccgccgatcaggaccggctggtcgccgatgccctgccccggctggatgcgctgctcgccgaaggtgtgaccacggtcgaggtcaagtccggctacgggcttgagactgataccgagctgcgcatgctgcgcgccgcccgtgccctcggccgcctccgcccggtcgagatccgcaccaccctgctcggcgcccatgccctgccacccgaattcgccgacgatgccgaggcctatgtcgatctggtggtgcgcgagatgatcccggccgctgccgaggccgggcttgccgatgcggtcgatgccttctgcgagcggatcgccttctccaccgcccagacccgccgggtgttcgatgcggcccgcgccgccggcctgccggtcaagctgcatgccgaacagctgagcgaccaaaagggcgcggtgctcgccgccgaattcggcgcgctgtcagccgatcatctggaatatctcgggaccgacggcgtgcgcgccatggccgccgccggcacggtggcggtgctgctgcccggcgccttctacatgctgcgcgaaaagcagctgccgccgatcctggaactcaggtcggccggcgtgccgatcgccatctccaccgactgcaaccccggtacctcgccggtgacctctctgctactgatggtcaacatggcctgcaccctgttccgcctgacgcccgaagaggcgctggccggcgtcacccgcgtggcggcacgggcgctggggctggaagatcgcggcaccatcgccccgggccggcgcgccgacctcgccctctggcggatcggcacgccggccgagctggcctatatggtcggcttcaacccctgcattcaggtggtccggggcggcctgccgcgggatccgcgcatgggctttgcaggggaagccgccgcatgacccagccgctctaccgccggatcaaagaggcgatccgtgcccgggtcatcgagggcgactggcccgaaggcagccagctgccgtcggaaaaccgcctgctggaggaattcggtgtcagccggatgaccgtgcaccgggccctgcgcgagctgaccgacgagggcctgctcgcccgggttcagggggtgggcaccttcgtggccgagcgccgcccgggcgtttcggtggtggagctgcggtcgatcgccgacgagatcaccacccgcggcaaccgccatgccgcgcgggtggaggtgctggacgaggtgacggccgatgccgccctcgcccggcagatgaacctgcccgaaggcgcccggctctggcattcgatcgtgctgcacaccgaaaacgacgtgccgatccagcatgaagagcgctgggtgaacccggttctggcgccggactatccggcccaggatttcacccgcatcacccccaccgcctatctgtcgggcctccatgccgcgccggatgtcgaacatgtgatcgaggcgaccgccgcccccaaggccatcgccgcccggctcggcatcgcccgcaacgatccctgcctcaggctcacccgccgcacctgggtggatcgcggcgtggtcacgctcgcgatcctcacccatccgggcacccgcttccgcctcggcacccgcttccgggccggtcccggcaccatgccgctggcggcgggcttctgaggtcagccgctggcgcgcgccagcagccggcccatattgcggatcaccgccgccccgacgccgcgtcgtttcgggcccaggatggcatcggtcgggccccgcccctcgatcgccagatgccggcccagcgtgctgccgaagccggccagccacaccgccgagaaccggttcacccggcccaggatcgatcgcatgtcgacatacatcacccggacggtctcgtcgctgtcggggtgctttttggtcagcggcagcggcttgccgcccaccgcctgatacatcggcaccaggcgcggaatcgcatcgaacagcatgaagcgcacgcccatcgacaggctcagccgctccacctcgcggaacaggtcgtagcggatgcggttgccgcggaaatccggatggaccaccagccgcgagacctcgacgaaaccgccctcccagaacgtgtccggcaccggcacctgggcctgcagctcgctcagcgagcggtcgccgccattgaccaccagccgggcggtggcgatcggcttgtcgcccagatatgccagaaacaggatcgacgagccgtccagccggtcggcccagtccgccggatcgcgcgcctcgggccggcgcccgtagaactggttggcatcgcgccggagcgcgcgagccgttaccatatccgccgcacccgccgccggcaccacccgcagatgccgcatcagcccgcgcggcttcagcccatgggtccagagcgcctggatcccgaagcctggcgcggtgcaggcggccagcaccgccgcccggtcgatcgccgccggatcggccatgcgcagcaggacgcgcacggtttcagccccactctccaccgccacgatccggctgcgcagccggaaaggatcggcccagggccgcaccacggtcagggtcatcagcgtgcccggcaccagcagggcggccgggcccgtgacctccgccagcgcctcgtaggggccgatggccgtgaccagggccggcagccgccgccggttcaggctccggccgtccagcatcgccggcagggcctcggccggccgcggcaggtgatcgacgaccgacgccgggatcgcggcatccagccgcatgatgccccgggcggcctctaccgagaggcagccgagccggagcggccccagccgccgccgacggatcgcccgccggtcgaccctgggttccaccgccaccgccgtggccggatcggccagccgctccgccacatcctccggcagatgcccgccggccgccacgaaggaccagccgcccgcggcatcccacgcaaggcgcccgttcagccggtccggtccggcatgcaggcagacggccaccgcatgcggcggcgacaaaccggccgccgcgatgggggatggcgcaggtggcggcgcctctgccgcaggcctggccattgcatcactgacgggcagatcgatcagggtcatggcgcgcctccccagccgcggctgaaccttttgaataacgatacttttgattgtaaattataatcactttcggttgataatcaaaattacgtattgcgatacgagacaaattccatcggtttccgccgcggcgccgtcccctccgcatccgggcgcggggttgtttggcgattgataatcaaccattgaatgatattctttcccgcaatacgcggcatgatttctcacggtccgcgcatccttcgcggacggccgcgaccacctgcgcctcggcggagggttcgccatgcacatagaagacctcgcagccctgatccaggacgacgtgttcgtaccggtccgcatcgatgcgggtggtggtgtcgacatcctgctcaagatcgaagggctgaaccccgcagggtccatcaagttcaagaccgcactcgcgatgatcgccgatatggaacgatccgggcggctgaagcccggcgccacggtggttgaaagttcgtcgggcaatctgggcctcgcactcagcatcgtctgccgggcgctcggctatgggttcgtctgcgtctctgaccccaacatatcccccgccacccgcgacatgatcgaggccaccggcggccggatggagccggtgaccgaaaccgacgagaatggcggctatctgggcacacggcttcggcggatcgccgccctgctcgaccgccatgcgggctgggtctggaccaatcaatacggcaatccggccgcgaaatgggcccatcaccgctggaccggccctgccgtgcggcggcgggtcgaccggccggatttcctgttcgtcggtgtcggcaccgccggcacggccatgggctgcgcggaatatttccggatcaacgcacccgacacgagggtgatcggggtcgacagcgtcgggtcggtgaccttcggccagacgccgggccggcgctatctgccggggctcggcgccagccagcagccaccgcttttcgaagcgaccatgctggacgaacaggtgatcgtgcccgagaccgaaaccgtcaccgcctgctggcgcttccgccgccgccacggcttcctgatcggcgcctccaccggcaccgtgctggccggcatcgcccgccatgccgccgccggcgccatcccgcccggtgccacggtggtcgcactctcgcccgatctgggcgaccgctatgccgccaccctctacgacgccgcctggatcggcagccgctatgccgaccttccccccgacattgccgaggcccttgccgcatgaccgaccgcatgcttcagccggcccccttcaccgtgatcggtgccgaggccgtccgccgggcccttgccgcccgtcccgatcatctggtcaccctggtgcgcgacacctatctggcccacgacgccgggctgaccgtcaatcccgacagctacttcctgcgcttccccgaccggcccggcgaccggatcatcgccctgccggccgcgatcgccggcgatgacccggtctcgggtatcaagtggatcgcgagctttcccggcaacctcgctcgcggcgtcgaccgtgcctcggcggtgctggtcctgaacgatgccgagaccggctatcctttcgcctgcctcgaaagctcgatcatcagcgccgcccgcaccgccgcctcggcggtgttgggggccgaactgctccatggtcctgaaaagcgggcccggcaggtggcggtgatcggcaccgggccgatcgcgcgcgccatcaccgacatgctgttcgccaccggctggcaggcgggcgaactggtcgcccatgatctcgacctcgcccgggcgacggccttcgccgatgcgatcgggctgcgtcggcggatccccacccgggccaccgccgacatcgccgcggcgatcagccaggccgatctggtgattttcgccaccaccgccggccggccgcatgtgctcgatgccgggctcttcgcccatgccccgacggtgcttcacatctctttgcgtgatctggggcccgaggtgatcctctcggcctggaacctggtcgacgatgtcgatcacgcgctcaaggccgatacctcgctgcatctggtcgaaaaggcccgcggcgatcgcggcttcgtcgccggcaccatcgccgatgcggtgcgtggccggatcatgcccgaccgcagccgtccccggatcttctcccccttcggcatgggcatcctggacctcgccctgggtctggatgtctggaaaacggtcaccgaccagggcggcggggtcgttgtgccggacttcttcccgcgcaccgcgaccctcggcctctgactgtctctcaccctccggcccgcgccagcagccggcccatgccgcggatcaccgccgcggcggggctgcggcgggcggggcccaggatcacatcggtcggctcgcgccctgcgatctccagatgccggcccagcgtgccgccgaaccccgccagccagaccgccgagaaccggttcacccgggccagaatcgcgcgcatgtcgacatacatcacctgctcgatctcgtcgctgtcctggtgcttcttggtcagcggcagccggcggccgcccaccgcctcgtaaagcggggcaagcttggggatggcgtcgaacagcagataccgcacccccagccccagggccagccgctccacctcccggaacatgtcgagccggatgcggttgccgcggaaatccggatgcaccaccagccgggacacctcgacgaagccgccctcccagaattcctccggcaccggcaccagggcgtgcaattcgcttctggaccggtcgccgccattgaccaccagccgggcggtggcgatcggcttgtcgcccagcaggcccagaaacaggatcgagcaggcatcgagcggatcggcccaggcctccgggtcatgggcatcgggcctgcggccatagaactggttggcgtcccgccgcagcctgtagacggtcgccatgtcggccagccccgccaccggcaccacccgcagatgccgcatcagcccacggggcttcagcccataggtccagagcgcatggatgccgaaacccggcgcggtgcaggtggcgagcaccgccgcccggtccaccgaggcaggatcggccatgcgcagcacgatccgtgccccggcatcgcccgcgcccgcctctaccgcaatgatccggccacgcaggcggaaaggcgtggcccagggccgcgccacggtcagggtcatcacggttccgggcaccagcagggcggcggggccggtcacctccgccaccgcttcgtaggggccgatggcggtaatacaggccggcaaccgccgccggttcaggctgcgcccatccagcatcgccggcagtggttcttccgggcgcggcagccgctcgaccactgggccgcagagcgccgcggtcagccgtaccaggccccgcccggcatcgaccgaggcgaccgccatcctgagcggccccagccgcagccggcgcagcacccgccggtcgaccatcggcaccatcgccaccgccgtcgccggatcggccagccgcccggccaccgcttcgggcaggtggtcgccatcggcggtgaagcaccaactgccggtcgcatcacgtgccagccgcccgttcaaccgcgccgccccgacatgaagacggcccgccacggcatggggcggcggcagccccgccgtcgcttccgggtcccggaccggcggactcgccatcctcgcggcttccggcgcccgcccggtgacgggcagatcgatcagggtcatggcacgcctccccggtgatggtcgcgttccttgcaaaacctgccggagattgtaggccatatctactttaagttgatcaacaaaacgacgtgctgtcgtcagaggtcgcggctatcatcgatcggtcccctcgcgctttccgcccggagccccatccgtatgacgccgatcgatgccaccctggccttcaccctggccgccctgttgatgaccctgacccccggcctcgacacggcgctggtgctgcgcacggctgcggtcgaagggccgaagcgcggcatgcaggcaggcgccggcatctgcatgggcgtgctcgcctggggtgccatcgccgcggtcgggctgggtgccgtgctggcggtgtccaggctcgcctacgacgcactcaggatcgtgggggccgcctatctgatctggatgggcatctcgatgattcgcggcgcccgcaccggcggcgcggcgctcgacgccaccgccgcaacggcggtgccacgcggccgcggccagggctggttcatgcgcggtctgctcaccaacctgctcaaccccaaggtcggcgtgttctacgtcaccttcctgccgcaattcatcccggcaggcggcgacgtgctcacctggagcctcgctttcgccggcatccatgccgtcgagggcctgctctggttcctggccctcaccctcgccacgcgcagcctcgcctcggttctgaggcgcggggccgtggtcgcctggctcgaccgggtgaccggcggggtgctggtgctgttcggtctcaagctcgccgtcgacgtccgctgagccgcggccggcgccggcattcgcccaagggaggtccaagcgcatggcggtccggatccggcgcgcggtcgaaagcgacatgtttgcggtctacaaactgctgcggtcatcgaccctgaatgcccgcaacctgccgctcgatgcccggcggcgcatgttccgcccggtctggggcggcaatgagggctattacggcttcctgatggaagacggcaacgaggtgaccggcttcctcggcaccctgttcaccacccgcgagatcgacggccagccccaggatttctgcgaaatccacagctggtatgtccgcgacagtcatcgcgacgaaagcctgaacctgctgttgccggtgatcggcatgcgcaagcgcaccatcgtcaaccacacaccgacccagacggtctacgacatcggtgcgcggttcggcttcaaggatctggaaaccggtgtggtcgccttctatccactgccgaccagcctgggccggcccgagtatcgggtcggcaaccggctggtgccggaccggatcgatcccgcctcgctccgcatcctgtcggaacatcgcgacctgcgcgactgccaccatgtcgcgatcgaagatcccgatggcccgccggtctatgccatgttcaagaccgtgcgccggcgctggttcgaacccttcggccggttgatccacaccagcgatccggccgccttcggccggctggcgggccggatcgcctggcggctgtgcctgcgcaatcgctggcaggcgatcatcgccaatcagacgatcttcgagggcgttccgctcaccggcgtcacgcggcgggtcggccgggacgttccgtcacagttccgctccaagacgctggaggcgcaccagatcgaccagctctgctcgcaacccctgcttcagggctaccggctgcactgatccggcgcaacggtcttcagggtcagtcccggtcgggcatcgctgccgctttcagcgggatcgtccggccactgctgcgccggggccgcgacggcccggtcaccacgggccggccggcgggcctctgtgccgcaccggccggttccaccagctccacggcgtcggcttcagcaccccgcacctcggccacttcggcaggcgcggcctcggccgccaccgacaggtcgcggtcatcgatccggaagccggccaccatctcggccagttggtcggcatcgccgatcagctcggccgcagccacggcactggtgcgggcggccatgcggttctcggccgaggcagcgcccagcgcctccagctcgcgcagcaccgcatcgccggcatcgcgggcctgggcggatgcctcggccacctcgccggccgcccgggcgacctcggcgctgctgccggcaatctcgtcggcggcacccgcctgttccgccacagcctgggcaatcgcgaccgcggctccgtcggcccgaccgacggcttcggcgatccgggccatgccggcctcgatccggccgatgcgggtttccagatcggccatggcggcgaccacctcgcccaccaccgcctggctggcgacgatcttggccccgatttcttccgccgcatcggccgactgggcggcaaggcgcttcacctcgcccgccaccaccgcaaagccccgcccggcctcgccggcgcgggccgcctcgatctgggcgttcagggccagcatgtgggtctgctgggcgatgtccaggatcacctgattgaccgagccgatgccccggctcgattcgtccagccggttgaccgatcgggtcgcggccagggcggcctcggcgccgtcggcgacgatccggccgacctcgcggccctcgtcgacggcggcgcgcatcgcgtcggtcaccgaccgggcatggccgtccagattgcggttggccatcacgatccgctgcaccgcatccgatgctgcggcggcgctcgccgacagctcttccgcgatcgagcccagccccgacagcacgttcatggtctgaccggccgagtcgcgggccgcggccgcgcgcccctcggtctggtctgcggcctggcccagccggccacccatccggtccagatcgcgcgaccgcaccgccagcgaggcgccgacatcgcgcacccggcccagatcgccgcgcagccgggccagcatatggtccaggtcgcgggccatggcgccgacctcgtcattgcgccggccgccgtcatgctcggcggtcagatcgccttccgccgcgcgggccagcaccttgcgcatgccgccgatcggcctcgtcaccgcccggccgatgatcagcccggcaagcagggccgcaaccgccgccgccacggccagcccgatcatcgcaaaacgggtatcggcggtcgccgccgcctcggcggcaccgcgggcatcggcggtctgggtcaggctgcgccgggtgtcggccagaagctgcgcggcgctgggccccagcacttccaccgcctcggtccggcgctcggcgacctgccccaccagctcgcgcagggtctttgcccctttggccagatcgttgcgcaggccggaaatcttcgacagcgtctccagccgccccggatgcatcatcttcagttccagcgacaacaccgcccgctttgtctcggccagcgccgcatccatcgcgtcggcatgggccatgtcgccggatgccatgaacaggcccgcttcttcccgcgccgtcagcaggaagcgctggatcaccgccgcctgataagccgactgaatgtcctgatcgatatagctttcgcggatgatgtcggtcagcccgccttccgaggtcctgaaggccggctccatccggtcccgccacagcgcaccacgggcgatctccacctcggccagttcctcgaccgcccgggcgaaggcccgggttgcggccgccacctgctccgccgccggtcccagagcgtcgatccgctcttcagccgagcggacatgactgcggaacgcctccagccgtgccggatcgccggtcgcaaccagcagatcggcggcagcgccggcggcggccaggtcaccctcggccgcggccatggcgcgggcggcgccgacatcgtccttataggcggcaagcccggttccagcccggtccagcgccaccaccgccgcgccaaagccggccacggccagaaccagcagaacggcaaagccgatcgtcagcttgcgacggatggtcatggaacgcgcgctcccgaaccgattgacgacaggccccccggaaccggggcgaccaattcgccaagaggtatagggtggcgatgacatgcgcatgacggtgcaatgacatttaacgaacgggtcatgcgatcccggtgaagcgatcccggtcagggaagcgatcccggtcaggcggtcatcgtccagggcagcgtcaccgtcatctccagcccgccgctcctccggttggcggcggcgatccgcccgccatgagcctcgaccgtgcgccgggcgatggcgaggcccaggccatagccctggccgcggctgccgtcggggccgcgcacgaagggctcgaagatcgagcccagcatttccgccggcacccccggcccccggtcgcggaccctgagcacgtggcgatgtgcccgctcgtcgacatccaccgacacgctcaccaccccgcctgcgggcgagaacttcagcgcattgcggatgatgttctccaccgcccggcgcatcagctcggcgctgcccttgatcagcatcgcaccggccgcaaggcttgccgccggcgtcacatggctctccaccgtcaccccggcgggcccggcctcgaaccgggcatcggccaccaccgaggccaccagcccgtgcagatcgaaataatcctcgcggcggggggcgtcgttttccacccgcgacagggtcagcaactcgcccaccagcgtgtcgagccgtgccgtttcaagctccagccggtccagcgtcaccgccacccgatcgggcgactggcgcaccagccccaccgccatgtgcagccgggcaagcggtgagcgcagctcgtgagagacgtcgtgcagcagccggtcgcgcgccgccaccgtctgttccagccgcgccgccataacgtcgaaatcccgggcgagatcggccagctcgtcgcgccgccgccccatcgccgggcccagccgcacgccgagatccccgccggccatatcgtcgaagccccggcgcagccgcaggatcggccggatcagatagcgcgcgagggcggcactgaacaccagaccgccgacgacccccagcaagatgatctcgggcggcatcttgaacgggccgcccgggcgcggaggtatccgcaggtccgacaggtcgcgcgacagctgccaaaccgtgccgtcgggcgccagggcatggcggatcagcacgtcgtcccggcggagcaccgccgggtccggcacggcgccggcatcggccggccgcaccatcagccccgcccgctcatccgcgggccaggccgcgaccatgcgttgcagggccggcaggccgccggtttccagcgccgccgccgccgaggccacctccacgggggccagccggtcctcgaacaggcgcatgatcggccggggcggatcgtcgaacaactggatcgcgacccacagcgtctggaccatcaggaagaaggtcacgccgaagccgaacaggatcttccagaacagccgacccctcacggccgccaggacgggcatgctcatgcacgattcacccggtaacccaccccgcgcacggtttccagcacggtctcgtcgaccccgcgctcgaccagcttgcggcgcagatggctcatatggacatcgatgctgcggtcataggtctcatgcggccggcccagcacctcgcgcgacagctcgtccttggccaccacccggttgccggcgcggatcagccgttccagcagattgaattcggtggcggtcagatccacgatctcgccggccacgatcacccgccgggcctcggtctcaagccggatcggccccgcctcgatcgaggcaggcgccaccagcgccgctgcctcgctgcggcgaagcaccgcgcgcagccgtgcgaccagctctcgcggatagcagggcttgggcacgtaatcgtcggcgcccagttccagcccgacgacccggtcgacatcgtcgccgcgggcggtgagcatgatcactggtacccggctggcggcgcgcagccggcgcagcacatccagcccgccgatccgcggcaacatgatgtcgagcagcacggcggcatagccgccgccgagtgccgccgtcagcccggcatcgccggtggtgacgagggtggtgtcgaaaccttcgccggccagatactcggtcagcatggcaccgagttcggcatcgtcgtcgatcatcaggatgcgcgggccggacatggatccctctgtgccgtcatgacgttgcgccgaagatataccggtccgcgaccgggcgtgagggggctcgcgtcggttttaccggggttttacgtatcatccacacaggccttaccgacggcggccttccgctcggttatgctctagcccgacttcttccgcgtcacccaggatcgagccgttcatcccgtgtcctccccgtcctccggtcgtcccgcctccggcttcgctcggcgcctccgcgccctgcggctgcccgtgctcctcctcgtcctcgccgctgccggctacggcatctggcgctacgccttccccgaggcgccgccggcgccaccgccgaccgttgccgtccaccgggcggatctggaagacaccgtgctcgccaacggcacgctggaagcgatcaacatggtcagcgtcggtgcacaggtctcgggccagatcaagacgctcgcggtcgatgtcggcgacaaggtcaaggccggcgacctgatcgccgagatcgattcgctcaaccagcagaacgatctgcgcaatgccgaggcggccctcgccaatgtccgtgcccagtatcgcgccaaacaggccgcgctgaaacaggcggaactcgccttcaggcgtgaacgcgaacttctggccggccgcgccggtgcccgggccgattacgaaaacgccgaggcgacgctcgccaccacaaacgccgaactcgccgcgctggaagcccagatcgcccaggccgaaatcaccgtcgacacggccaaggtcgatctcggctacacccggatcaccgcacccatggagggtacgatcgtggccgtggtcgccaaggaaggccagacggtgaacgcggtgcagagcgcgccgaccatcgtgatgctggcccagctcgacaccatgaccgtcaccgccgaggtctcggaagccgacgtgacccgggtcctgcccggccaggacgtctatttcaccatcctgggcgagccgggccggcgctacaccggcaagctgcgttcggtctatccggcgccggaatcggtcgccaccacctccagctccaccacctcttcgtcctcctccagcagttcgtcgtcctcgtccagcacggcgatctattacgatgcgctgttcgacgtgcccaatcccgacggcaagctcaggatctccatgaccgctcaggtctcgatcatcatcgaccgggcccctgatgcgctcaccatcccgtcttccgcgctcgggacccgtgccgcggacggcagctatatggttcaggtgctgggtgccgacggcaccgtcacctcccgcaaggtgacggtcggcatcgacaacaacgtccaggcccagatcctgaccgggcttgaagagggcgagcgggtggtcgccaccaacaccgccaccgtcggcaccaacatgcaggcgcgccgcccccgtggcccgatggggttctgagcccgtgaccggaaccgataccgccagggaacccctgctccgggtccgcggcctgcgccgcgaattcccggccggcgaccgcatggttgcggtgcttcaggacgtcgacctcgacatcgaggccggcgagatggtcgcgatcatcggcgcctccggctcgggcaagtcgacgctgatgaacattctgggctgcctggaccggccgagcgccggttcctaccgcatcgccggccgcgacacccgcgagctggagcccgacgaactggccgaactccgccgcgagcatttcggcttcatcttccagcgctaccacctgctctcgaccctgacggcggtcgagaatgtcgagatcccggcggtctatgccggcggcgaccggcgcagccggcgggagcgggcgctggacctgctgggccggctgggcctcggcgaccggaccggccaccggccgagccagctgtcgggcggccagcagcagcgggtcagcgtcgcccgcgcgctgatgaacggcggccgggtgatcctggccgacgaacccactggcgcgctcgacagccgcagcggcgaagagatgctgaagctgctgggcgaactgcatcagcagggccacaccatcatcatcgtgacccatgatgccaaggtggcggcgatcgccgaccggatcatcgagatcagcgacggccggatcatcgccgaccgccgcaaggaagatgccggtgcgcccaccggcgaccgcctggcaccggccggccgacgcggcggtttcggcatcgcccgtcatctcgaagccttccgcatggccctgcgggcgatggtggctcatcgcctgcgcaccttcctcaccatgctcggcatcatcatcggcatcgcctcggtggtctcggtggtggcgctcggcgaaggctcgcagcaggaaatcctgaaaagcatctcgtcgatcggcaccaacaccatcgatgtcatgccgggcgaaagcttcggcgacatgcgtgccggccgggtacgcaccctgctgccttcggatgccgaggcgctggcaagccagccctatgtcgacagcgtcaccccccaggtctcaagttccgcaacgctgcgctatggcaatgtctcgctcaccgcctcggtctcgggcgtcgggccgcaattcttccgggtgcgcggctataccatggccgacggccagatcttcaacgacaccagtgtcgagcgccgcgcccaggaagcggtgatcgacaccaagacccgcgacgaggtgttcaagcacggcgtcgacccgatcggcgaagtcatcttcctcggcaccgtgccggtgcgggtgatcggggtcgccaacacccaggacagcgccttcggcagctccgactcgctcaatgtctggatcccctacaccaccgccatgaaccgggtgctgggccagaactatctgcagcggatcaccgtccgcgtctccgacgaggtggcgagcgacgtggccgagcgcaacatccaggcgctgctgacccgccgccacggcgtgcaggactttttcatgatgaacaccgacaccatccgccagacgatcgagagcaccacccagaccatgaccctgctggtctcgatgatcgcgctcatctcgctgatcgtcggcggcatcggcgtgatgaatatcatgctggtctcggtcaccgagcggacgcgcgaaatcggcgtgcgcatggcggtgggcgcgcgccagggcgatatcctgcgccagttcctgatcgaggcggttctggtctgcctgctgggcggtgcgctgggcgtcggcctcgccttcggcatcggcgcactgctggagcagaacggtgtcgccatgatctattccggcacctcgatcatcgccgccttcgcctgctccaccctgatcggcatcatcttcggcttcctgcccgcccgctccgccgcacggctggatccggtcgaggccctggcgcgggaatgaccttcatgacctctctccgcatccccctcgccctcatggtcgcgaccgcgcttgccggctgcggcagcctgatggaaacgtcctacgaccggccggcccttcagcttccgtccggctggcagcagggcagtcccgccgacaaagccctgccgaagaccgtcgatgccgcatcggtcagggccgatgcctggtggacggtctttcaggaacccgaactcgaccggctgatcgaccgggccttcgcccgcaacaacgacctcgccgccgcggcgatcgcggtacgccgggcccagcttcaggcggggctggcggaagacgacaccctgccccggctcggctcgtccacccaggtctcgcgcgaccgcgagcttgccgacgacaccagcgccaccagctattccaccagcctgacggtcagctgggagctggatctctggggccggctggggcgcacgctcgatgccgcccgtttcgaggccgccgccaccgaacaggaccgccaggcgaccgccctcagcctggccgccaccacggccgagctttactggacccatgtctatctcacccagcgcctggccctggccgatgccagcctgaactacgcgcgccggatcgccgacatcgtcgacgtgcgctggcgggcgggtgcggtctcggatctcgaccggctccaggcccggcagaatgtcgaatcgcaggaagccgcgcggctgctgatcctgcaaagccaggtcgagaacgacaacgcgctgtcgatcctgttcgacgccccgccccagccggtggatctggcccgcgaccgcctgccggacggcatgctcccggcgatcccggccgggctgcccgccggcgtgctggcccgtcggcccgacatccgggcggcggaactcaggctgcgcgccaatctggccgatatcgacgccacccgggcgagctatctgccgaccttctcgctgaccggcagcctgggcggcagcagcgtcgcactccgcgacctgctcgccaacccggtggcaacgctcggcctgggtctcaccctgcccttcctgaactggaccgagcgcgacctgaccatccgcacgtccgaagccgattacgaagccgcagtggtcaatttccgccagaccctctaccaggctttcgccgacaccgaaaacgccctgtcggcccggcagcggcgtgccgaacgcgatctccgtcttcaggcggccctggatgccgcacgagccgctgaacagatctacgaaacccgctaccgggcgggggccgtcgacctccagtcctggctggactcccaggaaacccgccgcaccgccgaactcaacctgcttgaaaaccggctggaggagatccgggcgatgatcacgctttaccaggccctcggcggatcggccacgcccgccgcatcataacctgaggtcatgtttccaaaccagaaaacaccggagttaccgtacgctcatccctggcctcgactgcgccggccgagcgccggaccgcgcttattccgcaagtcttccgcccccttggcagctgcgttgcaagagagatttcttcctgaccctctccgcgatttactttgcagacggcctgccgcaggatggcgaccgacgttcccgtcgcctcacatgaagtggcagatccatggcaaccatccgcggcacctcgggcaataacaggctcaccggcaccgatgtcgccgacacgctctacgggctcgacggcaacgacatcctcgatggcggcgagggcaatgatctctatgacggtggcaacggcaacgacaccttcctgatctggggcgcgaccggcaccgacaccttccggggcggtgccggtaccgatacgatccggctgaccgacggggtcagcaccgccagcttcgtgctcggcaccaaggcgtcggtggagcggatcgatttcgccggtttcgacctcaccggcacggaaggcgacgacgtcttcgatctcgggggtgtgatcagcctgatcggccggcggacgatctggctgaacgacggcgatgaccgcttcaccggctcggccgccggcgacagcgttcatggcggcaccggcgacgatcgcctggatggcggggccggtgacgacatcctcgaaggcggtatcggcaacgacacgctgatcggcaatgacggcaatgaccgcatcgtgctgcagggacggaccggccaggacaagatcctgggcggcaccggcaccgaccgcgtggtgatcgcaggcggcacccagctgagctatctgtcgctcaacgcatcggcctcgatcgaaatcctgcgcttcgagaccggtgctgtgctggaaggcaccagcggacgcgacaccatcgatctctcgggcgtcaccgcctatgaaaaccgtcagaccatccgtctcggatcgggggccgacagcttcaacggctcgaagaccggcgacgtggtcgacggcggcaacggcaatgaccggcttctggggggcgacggcaacgacatcctggaaggcggcgccggcagcgatgtgctgaacggcggcaatggcaacgacatcttccgcgtccagggcgccttcggcgtggattcctatagcggtggcaccggcaccgacacgctcgagatcgtcgggggtgcacagaccagcagcctgcggctgccggccagcgcatcggtcgaggtcctgaagttcaacggcttcgacctgagcggcacggatgaggacgaccatttcgacctcagcggcatcaccacgatcatcggccggcgcacgatctggctgaatgatggcgatgacgtcttcaccggctccagaaccatcgacgacgttcatggcggcgagggtgacgaccgtatcgaaggcggcgccggcaacgacatcatcgagggtggcggcggcaatgacacgctgctcggcgacagcggcaacgacatcttccgggttcagggcgatttcggcgccgacatcatccgcggcggcagcggcacggataccctgcaggtggttgcaggcgccgagacctctgcgctgaccctggacgccgccgcctcggtcgaaatcctcgccttcgccgacgccgacctgaacggcacggatggcaatgacgacttcaacctctccggcatcacaaagatcaccaatggccggacgatctggctcaatgccggcaatgacgtcttcatcggatcgcagaccgtcgaccgggtcaatggcggcgccggcaatgaccgcctgcagggtggcaagggcgccgatatcctgaacggcggtaccgggcgcgacagcttcgtctacaccgcagcatcggacagcaccgttgccgccaccggccgcgaccggatcgaggatttctcccatgcccagggggatcggatcgacctttcggccatcgatgccgtcaccggcaccagcggcaatcaggccttcacctatatcggcagcgccggattttcgggcaaagggggcgaagtgcgggtggccgtggtgaccagcggcgtgctggtctatgccgacctcgacggtgacaaatcggcggatatgagcatcctggtcaccggcatcggcagcctggtgggcgccgacttcattctctgaccaatggctcagccctcgccccgggcatcggcataggcgtcggaggtcgggatcacccggatcagatcgatcagcgtccccgccggatcgcggatgatgaaatgccgctggccgaaagcctcgtcgcgcaacggctgaagcacttcgaccccctcggctgcctgcagccttgcccattcggcatcgacatcttcgacctccaggttcagcagcacaccgccgaccggccggcgatatccggccggtacggtctcgtgggcatggtccagcaccgccagattcacctcgggatgggtggcatggcgcagatgcacgtaccagtccgcgacgaagaccggcgcgaagcccagatgcgtctgccagaaggccgcggtctcggccacgcgatcggtcatgatcaccggataccagctctcgatgcgcatcctctgtccctcctgaacgggccggagcgtctcactccggcattcattaaacaaacagtcaacctgtttgtaaatatgccgattgcgggcggcgccccggacgcgtagcgtcagctccggaccggatgggggatgggggatcatgaccggcggcaacggacggcggagcaatcgcgagcgctcggaagaaacccggcgccggctgatccaggctgcccgcaaggccttcgccgaaaagggctatgccgcgaccggcacgccggaactggtcgccgccaccgggctcagccgcggcgcgctctatcaccagttccccgacaaagcggccctgttccgggcggttctcgaagatgcccagcaggacgtggtggccgcgatcgacacggccgccgctgcggcacccgatgccctcaccgccctgcgccggggatcgcgcgccttcgtggccgcctgtatgcgcccaggcattcgccggatcgtgctgatcgacggcccggccgtgctcggctggcaggtctggcgcgaggtggatgccgcccatgcgctgggcacgctgatcgcgggcctcgacgccctggcccaggctgggcggctgcgccccggcctcaccgttcaggccacggcgctgctgctctcgggcgcgctcaacgaagcggcgctggcggcgagcgagggccggctcggcgatgccgagatcgccacggcgatcgatgccctgctcgacgggatcagccggccggcctgacgaaatcaaccgcccgggcgatcaccccggcatcggccaggatccgggcgtggcccagcccgtccagctccaccatgacggcatccggccaggccccggccgaggcgcgtcccgccgcgatcggcaccacgcggtcatcggccgaatggaagaacagggccggcaccgtcgccgcctgtgcctggcgcggcaggttcatctcgtgaagacgggcgcccaggcggtcgagttccgtctcgaacgcggtgcgcgccgcctcgtcataacccatctgcgccgccagcgcccgggcaccgtccagatagcgcgccggagccgccacaaaggccagccgcgccgcccgggcgccctcttccaacacggcgacggcagaggccgcacaaccgatcgaatgggcgatcagcccctccaccggccccaccgccgcgatcaccgcggccaccgcctgcgccagcacaggaatcggtgcaatcttgccgccggaccggccatgtcccggtagatcgaaggccaccacccggcagcccgccgcatgcaggggcgccacaaagccggccatgtcggcatggctgccgtcccagccatgcaccagcaccaccacgggaccatcagtgccccactgataaagggcaagcgtctcgccgtcgaatgccagctcaccccgcagggccggcggcagctcgacccaggccggccgggcgcggctgcgatcgggggtgacgaaggcccgggccagctcggccggtgcaggcacggcagagtgtgccgtggcaggggtgctgctcgacatgggaacgacgggctccgatacgggttgactcaatcatgatgatcatcatcattaacagcatcaaccgctcccgtaaagggccaccaccccatccgaaggtatctcccccatgacccgcaccgtcatcgccggctatgtccggaccccgttccacttcgcccgcaagggtgcgctcgccggcatgcgcccggacgatctggctgcgatcacgctgcgcggccttctcgaccgcagcgggctcgatccccggctgatcgaggacgtgatcatgggctgcgcctatcccgaaggcgaacagggtgacaatgtcgcccgcatcgcttccctgctcgccggcctgccgatcgaaaccggcggcatgaccgtcaaccgcttctgcggctcgtcgatgtcggcaatccacatcgcccatggccagatcgcgaccggcgcgggcgaggccttcatctgcgccggggtcgaatccatgacccgcgtgccccagggcgtgtagcgcgcgaaatgatttggcacgcattgcgggccgatttgtcaccctcgcttagcgcccgcaggcatcatcgatgccggcgttcgctaccccgtcatcgccggcaagtccggtcctctgctccagcctcaccgccgccggcgtgcctgcgaagcggcgaaacccgtcatagccaccgaggcctgagcgtgcgttcacctgaccgcatacgatcgtaccgcctttgtaatcaacaataacgacatccttgatccgcatagtctccgcatccctggccgcccgacgaagccggtcggtgacgccggtgacgaacgccgcatcgcccatgctcgtgcgatcggccgcgccggactgagccagggtcgccatctcagctattgccgcgcggcggtcggccgcgtagtcagcgatcagcgcctgcgacggcgtcggccgagacggcgaataggtaggctgctgggcgcaggcgacgagggtcagggcggtggtgacgagcaggatctgacgggtcatggaagcctctcgggtgcgtgagtggtgatctaccgtaccgcgattgaccggctggctgctacgcccacgcccgcagcacaatccgaaagctggacttgctgatgtccaccacgccgccgcccgcgctgatgaaggtcacgaccggcccggcggcggcctggatcaggcggatggtggtagcgctggtcaagatcgccgtgccgctgctctcgcccgaacctctggccatatggccgccggacagattgatcacgtccccgacgctatagccgtgagcggcggtgacgcagacgagctgcatggcgacgaggcggggcaccgcgcccaggccgtgactgtagctgtcgtcgccgccattggtgatggctatgttcgggctcgtccagcacgcgcccaggcggtcgccggcggtgagggcggcggcggtggcagcgggtgtcatcgcgacggtggtggcggtgcccgcgatggcctgagcgttggtggcggctggaacggcgatcgtgcggtcggcggtgaggtccccgccgcctgtggcgaggccggcggcggtgatgctgcgcgatgcgagagcgaggccggcgatcacggctgaggtgggaatgcggatgtggtcgccggcagccgtgaggacgatcacctcgtcgccggctgccgtggccgcgcgggttccgagcgcggaaaaatcgagagagagcgaccggtcggcggtgaggtcgccgccacccgcgaggccggacgaggtcgcgatctggcgggcggccagggccagtgcatcggcgccagatcggggggtgcccgcagcgtccctatatatactgtgtgcggacggaagaacgctgaacacgctgtggacgccggcgggcagattgagccgggcagagccgatcgaggaagcgagcaccgtatcgcgggagagcgtcgccggcgggccgatgtgcacggtcccgatgccgatttcccaggcgagggcgctggtcaggatctgatagaagatctgggtgccgtcacccgcggcggtgaggggccgaagccccgtgtcaggggcgatcaacaccagatcgcccgtgccctgggtagcggtagtctgaaggccgcgatcgacgagcatcaaagcatctccctgattgaatagctgcggtccgagaatgacgaataggacttcgtcagcggatcggcggagctgatgcggccgatcagcccctcccgcgcccagtcgccggcggggttcgggacgcagaggaccggcccgctctgtcccacatcgaaatcgcgatccagaacaccaccacgctcctcatcgtcgaggatcagatcaaattcgagccgccgacgttgacggccgcggtcgacccactcgacgccagaccgctcagcggtcgtgatccgcgacaggtcctcggtcgtgagccgccacccgaaagaggcgccccaggccggtcggctgccggcgccgatccacaggtacccgagatcgacatagcccagggcagcccgcgacggggcggaaaccgatagagaccagtagcgcgcagcgagcactggcgacggtaggaccgggatagacaggccgaagccgatggcggggtggatacccgcctcgggcgggtcagtctgccagatgatgggtccgccgggctccatgcggcaggaccagatccacgtatccgtcgcggcgagggtcgcgccggcgatcgccagggcgccgaccggccgctcctcccccaggtcgaagtcgagcatgaagctggtcgcgagcacccgcgctggccgggcgaccggctcggagagcaggtgcgacagcggcagttcggaggcgaccggcgccgtggcggtcacgctcgccgtcggtgcccagttgcggtggtcaaggatcatgccggtgccccggccctgaccggaatagatcatgaaggcccccatagcgtcagaacccagcggccagccgcccagtcctcggacacgccgacgaggacgagatttcggccggcggaaagcccatagcgcgggtaagtcacccggatcgtcgacccgatacgaacagcccgccgaacagtgggcgcgccatccacgacttcctcggccagcaacggcggcacggtcacggacagcgccagtgccggccggccgtagagtgcgagcagatggtcggcgagcgcctgagcatcggcctgcccgtcgaagcacgcttcgatgacgtcggcgtcgatcgcccggaggcggtcggcgagaaggctggtatcgaccgacgtcgccaatcgccattcctcgctcagaaactcgcgcggcagggctggttctaccggcgcctctggtaggtctgcggctccctggaccctccaattgcgccgccaccccactcggcggcgccacgatggctgcgcgatgctgtcaggaaggtccaggcgctccggggtctccaatataatcgtgtgatcaaggacgtaatctggcgtcacccgcggaagtgcgagcctgcccacctcgaccagcccctggccgtccgacccccaccaagcgccggccgcccgggtgatccggtcaatcacctcacccacggttgcggtctcggtcccctgataccaaccaatgacgccgggaacagcgaccgcgagacccgccaccgcctccaggtcgatccgcgaaagatcgacggcggcgtggtcgaccagcagccgcagcaggatgtcggcagtggtagcggcccagccgccgaccgcgtcgccgtcggcgtcgcaggtcagaacaccgacgggtggataggtcccgaggcgcaggtagccgccagccagacaggttgcgtaggtacccgccggaaccgctgcggccttgagggcgccgaagctggcaaaatccaggccggacggctcgaccgcgaaacctttgtccctgacagcgagaacgctgcgcatctgccggtggtgagcttgatagatgccgatcgggtcgacgaggacgggttcaatgttgcgcacccggccgaagagtaccggcaaaggcttgcccgcgagatcctcaccaccctccgcctcgcccgtgcccgcataaaggcggctctggagtggcttatccgcccaagctgcctgcccctcgacggtcagggcgagggcctgacggtcggcctcccaggccgcaccaaggccgtcgaacagcagcgcggcacctgagtgccgccaccccggcaaatcgcgatgaagggcccgcacgatcacctgccgaccgccgaggtcgtagcgctcgggcacgtcgtcgagggtgccgtcggcgttggcgagctcgacccggccaagctcaaccgaggtccgatccgaggcttccggggcgatgggaatgcctcgctcgatcgagagcggcgatgtcgcccggccatcccaccagctgtgcgcgggcagatcggccggcccggttgtcatcggcttgtccgcgaagcgcagaaccgcgagaccatcgtcccgccgctcatcggccgacggcagcgtcgcccaggcctgagccgcccagggggcgagcagggtctgtgcgggcgcctcggccgtcaaatcccggggcctaagctcgatcgtgaccaccctgtcgacggtggtccgagggtgagcgggcggcacgtagccgcgatcgagtgcgccgatggccgttgcgacggccatctcgccgtccggatagtcatcgtcgtaggcgccggaagccgaatatgtggccgccgtcggttgataagcatcccagttccagccgtagataaatgcgcctgcgtcattgtcgccgatgacgtgggcgaggtagccccggaagtcggcgatcgatctcttggcgccggtgtgctcgtagggcggctcaagcccccattccggggggccagcccgcaggccgatcaacagggtcgtggccgggaaccaatgccgataagcggcgaacgcctcggccgggtcgtagtcggtgcccgcgtcgtaggtcatgatgttgatgtggtcgagggcggctgaagcctccgcatcgcgggccagcgccagagcgtagcctccattccagccgccccctgcgggcgcggctcgctggaacggcggctcgccgtagcacccgacgtgaacgccggcccacgacagaataaagggcctcggaaaccagcgtcggaagcgcttgatcacctccaccagctcggcgtcggtatagcagcggcgcacgccgtcctcatcggtccagcagtggtgcgcgaggtcattgacctgcgacatcagttcatagtccacgtccaccccgtccaggcccagatcatcgacgagctggcgcagggcggccatgtgagcctcggtctgccccccgaagccggccgggtcatagggctcaggcagccacgtgtagccgggccccaactgcatcacgacgagcatgatcttggtccgaggatggctcgcgcggaaccggtcaagggccgccttgaggagagagaccggccccggccacaggatgccgacggtcgtctggatgtcatcgtccagtccgctgtaagtgcactgcggcagcgcggtgtgcaggtagacgatgtcgacctcgggcgggatcgccatcagccgcatggcgtcgagatcggccggcgcgtcgctggccggcgcgtccatccacgtctcgtagtagacggcgacgatctgaccgtcgggccggggccgatagtgctcggcgcgaaggtggtcagcccgcaccggcgggagggccagatcggcggtgccgtcgatgtcggccgacggccacccggcctcgatctccacgaccgcgatcagctgggtcgcataggccaccgatcgatcgatcaccagcggcgcgcagccaccgccctggcgcgaccagagccagccgcccgcataggtgccctgagccgaggcttcggccgtccaaccggcggcggcgagttcagccgcgccaccccacggggtggccgacatggccagaacccggctcgatcggtgggtgtagggcacacgaatgcgggtcggattgtctacggagatggccgcgagccggataccggcaacccctgaacagcccgacaccgcgaccgcatgcagaacgacgatgccgacgaaccggtcccaggcggcggccagcagctcatgcgacccggccggcgggttggcgagataggcgatgcggagctttccagcctcgggcaccgccggcgccggatcatccagataccgcaagagccggccggcataggtgagcgtcggggccgggtccgtgtgcgtgtagagcacaccgacgagcagcaggtcggcaccggtggtgtcgatgatggcgggcggtgctggcgtcgagccgctaccggcgcccggattgaagacgccacccgcctgggcttgatcgatctgaccggcgtaatagacctcggccgccgtgaccagaacctcgtcgcgcggcaacccatagggctcgaccgtcacagccgcgagcgccagggcggtgccccagtctgactgtgtcacctccagcgctattccgtcgccctcggccggggcgggggcggtgaacccgaagatgcgctcatagctgccggtggccgcgcccgtcgcggtccagccggccggcgcggagatgtcgggggagcccgtgtaccaataggaagccgccgcggcgagaaccaggcctccggccggcgcctggacggccggcgtcgcgagaacgtcgccacccgccacctcagcgaccgaaaccgccagaggcgataggcggcccgaggtgccggcaagcacccagacgacgggcgagatgtaccccatccagtagggcgtcaagaccacgagatcgtggacgccgggcggcggcgagggaaggacatagagcaccacggtgccatagtccatctcggccacaagaggggccgaatgaaccggggtgagggcctgccccccgaaggtgatcgtggggatgtggtcccaggtcgtgcccacctcgaccggatcgtagtaggcgatcggcaccagcgccacgatcaggtccgcgccggtggcgtcaaggctgtgggtggatgctcccgagagaccacccagcgcgagcgttagggtcgagacgacggtgacggccatcagccgacgcctccggagagcgtgcagcggatgacactcaccacttccccgaccgcgatagaggtggtggtgaggatgagatccccgccgccgccagggcccgacaccgacccgtcgatccggagggatcccgaccgatccgacaggcggaaccacgtcgcctcgccggcgcggatggcagtaccggtccaatagccggcgatcacggcctcgccctccgtcgccggacgatagctctgcatgggcagccgcacgatcacgagtggggtggtcggagtggacgccgccggtgatgcgacccgtgtgcccgcgaagagtgccagtgtgcccccgtcgaacagcgcagccgccgcgtcaaggatcgccgcccgcagcggctcgccatagctgatcatgcccctcgtcccattttagccacggcggtggcgcgctcggtcgcgcgccgacccagccgtacctccccggtctgccgctcgatcgcatcgaccgtcgctccgcccgccgcggccgtcgtctgacgcagggccgccagttcctggcggagggcccgcacctcgtcgcgcagcgcccgaacctcggcggcggtcgcgccgccgtcacccatcgcaggcacccggccggtcgcattgatcgcgtcgagcaccggcagggtggccggggtgacgctggtcgcgcgcgttacgtgctcgccgccggccagcgcgatggcgccgccgcccgaataggcagcaagaacactgtccttgttgtagatgccgttaccgacgacgccgccggcggcgtacccgggcaccacagcgacggctgcggtagcggacgccaccgacgcggtgagctgcaccgtcagagcctcgatcgctgccgtcagggcgctgacggcgcctgtgttgtcggcgacggtgtcgtcataggcctgggtggcgggaagcgccgagagggacgatcgcacccactcgaccagggccgcctgctgcacgccgctgccatacatgtcggcgccggcatcgagcagggtctgagcggcgtctgtgatccggccgagcgcgtcgcgatcgccagcccgggcggcggacaggtcgcgcgtaaactggtcttgggctgcctggaagcggctggccggattgccggcgccggccgccgaggtcgccagatcgtccagatacgaccggatggccttgccgctttccgacgcggcggccgccgtcgcccggatcagatccgaaagctcggggaagcggctggccaggtcgtcgatcgcctgcgatgtgagatcggagccctgaaccagattgcgcaccctgagggccagaagctcgccgacctgatccacgccggcttgaccggctgcggtcatggcgtcccgggccgccgcctcggcctccttgaccagatcggcgacctgatccacgacgcccagaccctgcgcctcgcgcagctggcgatccagggcggccttgtagtcgttggcgatctggtccttacgcgcttccaacgccgccgccacctgggcggctgtcaacccgaagtccgccgccgacttggcgtagacctggaaggaggcctcagctgcaatcatggcggcctggaagtccgtcaccgccggcgccgcctctcggatcccgagcagctgctcgacataggccttggtcgcctcggcggcggcatcggtgtcctgccccaggcgcgacgcggtctcgcggaaatcggcgagggcgtcgatctgggcctgcgcgctgtcgcgtgcgctcttggcggcgttgtccgccagatcccacccgcgggtcagccaatcgaggctgtccttgtagttggccgcgaactgaaggtcgctgaacgccgcctcaagatcgctccagtcgatcttgccgatggccgtctggatctcgggggcgatgtcgccgaccagctctcccgccagatcctcggcgatcttgcccagggcggttttggccccactctcggacaaatcgcccagccgaaccttgcttgcgtgagacgcgccccactggataccatcccggccacccacgtccaaaaagcgcttgaccccgtcgagactggcgccggtgacctccgtcagcgcctgggagaccttgccgatgctgtcgagcagctgatcgcgcgcaccgacgttacggctgtcgcgtgtatagcccgccttgatgacgtcctgggaaccgacgtcgtagctggcccaggccgcgaaatttgacggctccttgttgccgaacaatccgccgaccaggccgcccaaggcgctgccgatcagcccgccgatcgggccgccgatcaccgtgccggctgcgccgccaaggccgccgccgatcatgccgcctgtcgaattgccgcccgtgagcgagctgaggaagccgccgatgccgacaccctgaagcgcgccgccgatcactccggacagggggattgaggtccacccaccgctcgccggcaactgcgccgcgcccgtgaagcccgcgctctcggcagccgccagaccagagagggccgagccggacatcgcggccggcgtcccgaagccgagggagtatccaaagctgtcgatcgcggacgagacgccagaaaagagcccgccaccgccgccgccgaagatgttgccgatcccgccgaaaagaccaccaccggaggtctgcgcaccggcggccgcggtcgacgagatcccggtcggcagcgggatcccgccggtcgacgtggcgagccccagctgcgacgccatattcggaccgagtaccgacgtggcaacgccgctgacgagaggccggaagacgagcagggcggcgatctgggcggccgagcgcttcatgacgctgacaatctggtcgccaaagtcttcgaaaccatccatgccgccgtcgaacacctgctcaaaggtgttggccaggacgtcctggatgtcttcacccgcacgggcgatggccgccgtgaatgcttggctctggctggtgcgcgcctcgatcaaggcattggtgcgcagggtctggtcgtagagctcaagctcttgcgtggcagccttggggagctgattgccatactggcggatcagatccacgcgcttcgcctccagcgcgacgagatattcccgccgagccgccgcctcggacacgagagatagctcgtactgtgcgacccgcagagcgtccctctgggtgcgcacagccgtagcggtcgcctgcccgacctcaccgagctggaggcggtcgaaggcggccagtgatagaaggtagagcttgttagcctcagtccccgccaccaatgcgtcggtgccgagttgcagggcgaggcgccgcgcatagtcatctcgcgtcgcccgcctgacggcgtcggcgcccgccgacacggcctccgccatccgctccgccgcctcggcctgctccagcatctcggcggcatcatcgcccgccttcaggacggcggaccgctgggccgcctgccgcgccagatcgatctccgctgccgcctgccggctggtgagggcgatcccccgctcgcgcaggctctgctcggcctcgtagaccgccatggcctgttcgcgggccgccgacccccgcccgatcgtcgcaatctcgacgtccagcgccttgacccgatcctgcgcggcccgaagcgccccggcatcctcgatcgccgcctgagcgtccagggcggccaccgcccgggcccgctcggccgcggcggcagcgctggtgaggtcgacgccgcgctcacgcaggtcgatgtcgacccgagccagcgccagagcccgttcccgggcccgggcagtcgcgccggcgagaccggcctctcgctgggccagctccagctcttgagcagtctgtcggccgcggcgggcctcctccgcgtcgcgcgtggcgtcggcctggtccttgaggctcttgtagatttcctcttcgcttcggcccacctgccccagggcttcgacccgcgcccgcgcccgcagatcggcctcacgctcggcggccgcggagatcctggcggccgcggcgacttcctgcgcaccctggatctcggcttggagctgccggagccgctgatcagacgccagcccctgctcggccgtccgggccgcgagcccgagattggtgaggacctcttgcgcgtctttgccggcgacgcccagctctcgcgcctgctggatcagatagtccagctgggcacgcgcacccggcgtctggtccttggcggcctccgccagcaggtcgcgggcttcctgcgccgcctgggtctgacgcagggcgtccgcgccgccgctgccatagctcgcgcgctgggcctggaggtcacgggtcttggtgaccagctcggccatgggcttcagggcggtcgcagtcacgtcggcgagcgacttgatctcccgccgcatcgtgcccgtccaccgggccgccccgccgacctcgccggtgtagtcgccgatggtcgcccgtaggagggttagttcccggcgtgcgaccttgaccgcctccgcctgttcggcggcgcgcgagaaccccaagaggtcggccagccccgcgccgacgccgccggaccccatatccgcccgcgtccccgccgacagccgcgcctgcgccgccgccagccgggcctcggccagcgccacttcggcctcggccgaagcccggatgttgtcccgctcgacctgaagctgccccgcgcgtttggacccggcctcattgagcgaccgcatggccttgtcggcggccgcaatgcggtcggtccaggcctctgtggcgcggtcagcctcggtggtcctggtcgcgaggtagccgacgccgacggtcagcagggtgatggcgatgcccgccgggccgccggccgcattgacgagagccatcccggccgccgccgcgcgggcgcggagggcggtggtccccatggcggccgacagggccacctgcgccgcttccgctcgcgcggtcgcggccgcgtgagcggtggtggccgcggccacgtcggtggtggcgtcacgcaggcggtccatggcgcccgtgcggccagccgccagggcatcctgggcctgcacgaggcgggcctgggcgccggtcagcgcctcgccggccgcatcggcgacctcgcgggcgtagcgcgcgcgctcggccagcgccgaagtggatttgaggtcgacggccgtgccgtcggctacggcctgccgcagttcgatcatgcgggcggccgcggtgccggccgccgccgccatcggacccagcccccggccgatcagcgtggccgcgatgaccccgccggccccgccggcgacggccgcggcggtgtcgatgttgtcggcgaggctcatgatcgtgccggcaaaaccggcagaggctccggaggcctgatcagcttcaccgatccacttgagggccgcgttcgacaacacctggaaggcgccgccgatcgtcggccgaagcttcgcgaactccgccgccaccgctggcgcctgctgaacaatggcgtcgaaaaccgccttgctggtgagcttgccctgctcggccaggccgcgcagttcgccgacgccgacaccgatcccgtcggcgattgccaaggcgagccgaggggcctgctccaggacgctgtttagttcctcgccccgaagcgtccccgacgcgaggccctgcccgagctgcaccagagccgcttcgtaagacgcagcccccgcgcccgacacctggaaagcctgaccgatcgccgtggtggcgagcagcatctcggtataggaggcgccgagcgtctgcgcctgccgcgcgagcgtcgaatagaggctagccgtcccttcgaaggtggcccgggtgctctgggcgatccggaagagatccccctgcgccgccgccagcgccgccgacccctgcgtcaccagggacaacctcccggccacattggtccacgtgtcggcataggcgaccacctgccgcgccgcgacggtcagccccgccaccgacgccagccccagcagttgcccgcgcaggcctgcgagcacggcggtggtcgcgccagacaccgcccccaggccctgagcctgccgcgcctgatcagccagcgccctggacgcgcccgcggaactgcgagacacgttgtcgttggccgccgccgcccgggccgcggtcgccgccgccgtcacccgcccctgggccgcctgtcgcagggccgccgtagcgtcgcgctcggccgcggccgcccgatcgagggcggcagtgttggtttccagcgcggccgccgcccgagcggcggcgccggcggcggccatccgcgcctgcgcaccctggacgatcaccgccgtcgtcgtctgatgcgcccgggcctcggccgcggccgtcgcgatggcgccctgcgtctcggccgccagcgctcgcgccgcccgcgtgacgctgtagatcgcgtcgctgacgtcgatgtaggagagcgcggccgcatcggccgccgccatcgcccgcgcgaaggcggcggcgttggtgtcgagcgccgccgaagcacccccgagagcggcggtcatggtgcgctgctggcgcgacatcgactgcccgccgcccgcttcaccaccggtgctgccggcggcggacccgccggagcgattgaccgcgcgcgccgcccccgcggccgcccgcatctgggcagtcaggtcagcgtagccggccgcggccagggccgccgactgggcgctggccgccatctgcgccgcctgatcggccagcgctgccgtggtgccggcgacggcggccgcaagggcccgctgctggcgcgcgtcggtcgcccgatcagcgccgcctcgcgccgctgcggaccgggccgcggccgtggccgactgctgttcagccgccgcgagatccagttgggaccgggcggccgccttggccgcggcggctgcggcgcgcaccgcctgcgtcgccgcctcggtctgcgccccctgacgaccgatctgctgccccgtggcggccgacgcctgccccagctcgacgatatcctggcgcagttcaccggccgcgattgatgcgcggccggtgtccagatcgactgtgagctttgtacgcagatcagccacgggcgcgggcctcttcctcacgacgtcggcgagcaatgtcgagggcgaccgcctcgcatgccgcgatatcgtccagcagatcgggtgtcaggggggtgccgatcacgtcggcgacgcgggcgacggcggtgtagtcgagcccggtgatgaccccggcctccccggcgcggcgccattgcgtctgaacgcggctccacagcgtccaggccggtacgttgaccgcccacagcgtcacctgccgctgaggcgcccgcagccccgcgagcagcacggcggggtcgcctcccatcgcctccaggtcttgggcgaggtcgcgcagatcctcggcagatgggcccgcccggccctccgcgaccgcccggaccgcctctgtcagttttttcggcgggcgcccgcgataccgtcgaaaaatgccttggcgacggcggcgcggatcgttaccaccgacagcagataatcccgagccccttcagagaattcgatggtctgcttgtttttcttgtcctggacgtcctgccacccgatccagacccgccggagcagagccttatctccgggcgcactccacggcgcagcggggtccggctggccgtactgctgggtgagcgcgtcgaggtcgacatcttcgggcagctcgaaggtggcgcggaaacgctggacggtgtccaggtggacttccacagtctcggtgaaggtcgggcgggcgttgagatcgacgttgagcatgatgatctccatacggctcagggggcggtcagggggcggtcggcgccctgtagctcagagtgatcgcaggtgaggtcggcgtgcgcgacaatgtcatcgggatctggatcccggacgcgccggcgatatccgtgagggtgatcttgccgatgcgcgctgcggggcaccggatcgcgatcgcgatctcgggagatgcgacgtgttcgaggcgcagctcgatggggctcgcgtcgatcgacgcgaaaaaatttcgcgccgtgaggtccatctccgcggtcacggtcgccgtcggcgccacgtcgatcagccgcacctcgcgctggccggtggtctcgacatactggaccgatccgcccaggtcgacctcgatcgacgacgcagcgaggacgaccccatccagagacaccgtggtggtggcggcggacgtcggggtcggatcgacataacccggcgccgcggggtaggtcaccatcgtgcctgcctcgggcggcgcgtacaagccgaccagcgacaccgagaggtacggtatcgcgggcacgtccgcccggatccggatggagccccggcagccgacgatagtctgaagcatcccgtcgatccgcgccgctacggtgacagactccaggccggactcaatcgtgctgtaccacacaccgacgtccgcagccggcggcggcgagacagtctccgccagcccgcacgcgcgcaggaggcgcgcatatggcggcggctcagcgagcgcggcggccgccgccagcggcacgtcaaatgagatctggacgtgccggccaacgaggtgacgcgccgtataggacgaccggcccagatcgatacgacgctcgatatcctggccctcaatgggggtcagcgcgatattctcgaccaacaacagatctgcggcaaagctcggagccgcgcttgacccataggcggtctcggtcttgatggacacggccttgtagcgcgatctgtaccacgtgcccatcgtcaagcctccttcttggtcttcggcgccggcgccggcgccggcggcacaggcaccgatgccgacgccgacgccgacgccgacggaatgggatcacccggctggcgccgggtcagcgcgccggtcaccgggtcgcgcagatagctgccccccgaggtcggccaggggccttcgtccgcattcttggcgggcatctaacacctcatgcatacagttgtcggctggtcagccacatactgacgagccagtaagtcccaacaccagccagctggctggccctggtccccccgtagtcgatcgggaggaggtcggcggggtctggcgtccacccggccagcgcccccttcagggcggccgagatcgtctcggcctcggcgaggtaggcctcgcccgtgccgtcctcgtaggtgcggatgcagaccgcggtaaggaccgagatcgcgatcggctgccgatgcccgcccgatgtctgggatggccgcgggtcctcggcccaggggatcacgtagcaggcgccgctctccggagcggttccctcgcgcaccgcctccagctccgccgcgcctgccaccgacaccagcggcggcatggccgccgcccgcaaccgatcgcggatggcacgggcggccgcgatcacagccagccgtccagggcccggcccgtgaacaccggctcgtccgacgctgcgtgaaccccacccgccgcatcggccaccggcgccgccaccccgtcgaccccggccaggaccaggcgcccggccgatgcgtcgaccagctgcttgagcgcgtcgcggtagtcggtggcgacgtgctcgggcgggccattgcgatgcaggcgatagcgcgcgatcgaaaccgcccagccgcgcaccatcgccggcggcggatccgacagaggggtcacgtaccggccccgcaggtagccgtcgatgacctcggcggcatccgcgatggcggcggcgatcacctcgggatccggggtgccgtcgcggtcgcggtcggcgatctgccggatttccgcttcgccggcgcgggcgatcaggtcgtccaagctggcgtacatcagcccgcctctgccggttttgccggcttcttcgtcggcggcgggggcgacgggctgacggtggatccaccgccatcctcgcccgtcggcgtgggcgcggcgatcgcgagccccgccagcccctcggcgatcagcgaggcggccagattgtccggcacgtcgacggtctcgccgatgccatagcggtggccgtcgtgacgcaggcaagtcttcgtgagggtgatcgcgaccatcacaggacctcccggatcaggtaccccagatcgggcgcgaccacgcgttcctcgacctcttcgccgacgcgcacgcgggtgccgccgtacatgccgatcttgtcgtccagcttcgacccggcgaagcgcgcactgttgctgccgggagctttcgtctgagcggtccagccccaggtcacgatgcgcttgctgccgatgttcgcggcctgataggtcagcgaggcgtgcccgccccagacgcgcacccgctgcgggggctgtccggggcggttggcattcacccaggcctgtcccacctcgatccgatcgacctcgatcagctcggcggcttcacgcctcgtcacccgccccttgtcgccgctcgatcgattgatggcggacacaagggccggatgccgccgcagcacggaccactcccgagcgccgagcgtcatcacgttcggccgcagaggcggcgcgtcgagtgcgtcggcaatctgcccgagcggatccgacgtcgggtcggaccacttatcggacccggtcagcgtctccacctgcgacgcagcgtaggacgatgccgactgcacgatcgacgccacccgaacctcacggtcgagcaggatcagctcggtcagccccgtgaccgcgaaatccaccgggtcatagccgtcgggcgcatctcggctgtccgtcagcggcaccggatcgtcgaggccataccgcttcgtctggctcgtcagctcctgcgccttgaattccacttcgttgggcgccgacttgcgcccgacggcggtatcggggaccgtgatgagctggtcgaagccgaacaggtggtagaggtagacgctcttgtcgtgcggcggcaggcgcggcatgacattgtcggcgatgtaggcgccgttggaataggcgagcgaaatgcccgtcagcacaggcgaaatcgggaacggctctccggccactgatctgctccttgcctcagaaggtcacgcgcccgggcatcaccatgccgggcacgatgtcgccgggcgacgcggtgacggtcgggtagccgacggtccagtacgaggtgtcggccgtggaaggcgtctgccccagggcgccgccggccagggcgcgcagcggcatgccggcggccgaggtggtgcccgcgccgcccggcccgtcgccgatcaccatgtcggtgatgccgctgagcaccacgtcaacgaccgccccagcggtgacgccgccggggcagtcggtgacaccgatcccgcggtcgccggcgcccgcgatggtgacggtgccgtcggtggccccgtacttgacggcccggccgtgcgtcagattgacggcggcgacgtgggccttgatgaccttgttcgacatcagacacccccacggcgacgcagctgcgccacggcatcggcgtgcgacaggatgcggccgcgcgcccgttcggtggcgatcaggtcttcgatcatggccgccacggcaaccgggtcgctcgcctccgcgaagctcgggccatcggcgtcgggggccgcgatctcgccggtgtgaaccggcaggggcagcgacgcgatcagatcacgcagcgcctgccgggcggtcgtcttgatggtcgattcgccctcgctgaactccacggacccgtccgagcccgccagctcagcgaaaacggcctcggcgcgcgcctgaaggctcttgggcagccgccccgcctcgacggcctgggcgacggccatccggtcgtcggcgatccgctgccgccgcagcgcctcggccgcgtcgcgctcgcgctggatctgcgccgcctcgcgggcggcgatttcctgctcccggcgcacgaggtccgcttcgcggtcgcccgccggggccggggtgggcgtggtggtggtggtggtcatgcgttcctcttgcgattccgcggtcgtgatcggcgcctcggcgaatgccggcccgggcgcctggtcctcggccggcagggggtgatagcccgcggcatcgcgagcctcttgatccgcggccgccagttcggcggccgagatgatccgatctgccgcctccgcgccctgcgtctccgtcagccagtccctgacccgccgcagcgcgcgggtcacgatctccagcccgcggccggtggcgcggatgggtgccgcgccttcggacagctcgatgtcgatgcagtctgccgcgtcgccgaactcgatcgggcgcaggcctttgaccgccgggggcgtcgcgcccaggaaacccacgtggcggaggtgccagcgcccgggcgtcggattgctcggggcatccggcgggtacagccgcacggagacctttgcgtagcgctcagcgcggacgaggtccgcgaaggtgggatccaccgcctccggcaccgcgaccagccggccaccctccacacggaccgccgcaatccagccccaggcgggatcgtcggttcgcggatggccgatcacgatcggcgcgcggtggagcttggggtcatacgagctggcgatctcatccagctcccgtggcccaaaggtcaggggaggccccccggacgcggggtgatgggatcccaggctcaacacttcgatcggtttcatgaggccgattttgacggctctgcaccgctcgggtcaggctgacagatgtcataccggccgcgccgtcggcaggcgccgcctggatggcccttagagcgcgatctgccccgcttggctactaccccggccgagaccgtcgaccatgcgcctatccgcccgccggagcggcgcggtggactcacctcaggcggtgcggccggtcagcagcccgtcgacgtaatccgtcgcgaggtccagcatgtcctcgccgtcggccggcgagatcccgaggtagggtcgggcggggatggtcacggactgcacccgcaccagctccgccccgagctggaacaccaatgccgccgccgtcttggggcggatcacgccgcccagctggtggatggcgccgtagatccgtgacgtgccgacctcaattgccatgtcgccggccatctgccagacgatcgtggatatcaggccgccggacatgccggcttcgcggagcatgccgccgccgcgtttcgttgcagcgtacagcgggttcagggccggccagtcgctgccgtccgggccctgctcggcgaacatccgatcgcgggtagactggaccagcagctcgccgatattgacgagcagcgcccgcggccgctggagccccacggtcaaggaccgcagggcgccggagatctggtcaattacggtgagccgggcgccggacacaggtgttcctcttgcggtttttgagtggcgtgactacctttgccttaagggctgcgtggcagtggggccgatcaccatctgcaatgtcatgcggttcgggcggggtccgcggcgggctccgcccgtttcattccgggcgccggtagagcaatgctcccgcgcgatgtttcgagaggtagttcggacgcacattgaacgccgtgacgccatgccacgcgtcgcccgtccactggaacctcgtgaacatctccttgccccccgaaagccccgtccgccgcagataggagcggcgcagtgccggcttcccgctggcaagcatcgcccagtcgacccacacttcgtccgggtcgcggatcgcatcggcgagcaagagcaggtatcgcccgcgatcgaacttgtctgccttgctgccgacgacctcacctccagccgcccgaacctggaacagttcttcgctgatgaggatgatcccgcctgagcgatcgcggaactcgcgaggtcgacccggcgttgccccgaactccgcaaggaactggtccacatactcctgcggatccagaccgtcgggcaggatccgcgccggatccaccggccgcacggggggcagcggcggcaggtcgggcggcagcggcgaaggctcgccatagggcggcagcggctcctgaagctccgccggaaccacgccttccatggaagctattccgacgttgtagtcccaccccgggtcgatccccttcgggatctgccggctttcgccggtcctcggatccgtccaggtgtaggtgccgtcatccggcgcgccgatctcggccacgccggccctcaacaaccgctgcaactgccgctcggtgatcgcttcgacccagcaggtgcagccccacccgttggccgggtaatgcgacatgatccacgggtcgtcgcgcgacacgatccgcccgtcccagctcaagtgcagcggccgcggcacccggctgtcaccgtggcgataccgcaggtgcgggcgcatgcgcacgatgtcggggtccatgagctgctgccagcggccggcctgataggcctgccggatattcaccccgtagatcagccgggtccgccagtcgcgcggccccttgtaggcccagccgtggcgttcgactagcgcgtcaaagtccgcctggaactccgcaaagctcgtgccctgctcgatcgctttggtgactgccgtccggaggtcggcgagtagatcgtcgcgcgcggcgcctgcggcggtgaaagccctcgcgtgggccgccccgtacaggtccgtccaggcggcggtcggcagcgataccttgcgtcggtggaactcgatggcctcccggaacgggacgctcacggcctcaactgtcgccatcgtccgccccctcggccagcaccgccgacctcccgatcaggtcggccgtcgccatcgcctcggtcatgatttcgccgagggcggtcacgtccaggcctggcagggcttccagcagccgaacagcgagatcgtcgtaagacgtggcagccatcaccacctcgcgcacacgctcgatcagctgccggcgcgcatcggccgtggcgtcgatcaggcgggcggtcagcacctcgggcacgcgctgggtggcgatggcggctgcggtggctgcggcctcggcgaacgccggatcgggaggagcggcttcggctggcgggggcgcctgggtgtcgacgcggtcgccgccataggtttcggcgatgtatttcgccgtcgggcggaaccccatctgggccagccgttcatccctctgagacagctgattgagatcttcaggctcgctgaaatcgcgccagacctgaggataccccgccttgatcggcagggcgttggcatcgacgatccaccgcaccatcgtctcgttaaacgtctggcagatgagatcggcgtcggctttggccagcagcgtccggatctcgttgtgaacatcacccagagcccgcgccccgtgatcccctgccgacgtggtcagcgtctcgccgaggatggcgatcgtgatcatctcgtcgaggtatcgcagcagcggctcgtagtcacccgcctccgccttgtgaagcgcgacctcgaccgaccgtggcagcaccatcgcaccgccgcggaccagacccatcagcttccgcagcagctgatcctgggtcttttcttccatgttgccgtcgtaggtcgcgaccttcatggggtccgcgtatctctccacggcctgcacccaggccgccagagtgacgcgcttcatccaggccggccaatagaggctttggccgattcccgatccgtagggatcatcgtcatggccatggatctggtggcgatggacgatgatcttgcggtcaggcacggcgatgcccgtgagcgtattgcctcgggtgagcaggcggggtgatccgtccactgcaaatcgccagcgccgctgattgcgcaccttgatccggtcgacgacaaacatgctgtcgcgccgggcccacatagcctctccgatcgcgtgccctttcacgaccgcgccggcgatcagacccttcgtcgcttggtcgtggttcatggcacggatctgcgcctccacggccagcgcggtcgaccggtcggcccgcgcgtcgctcgcccgatccacgcgccactctcggctcgtcactcccagtgtccgcttttcgaggagtgccatgatcagcgggtcaatgagcagctcatcgtagagtgccaccccttgagcgccgccgcgccgggccaaggtcggatcctgcggcgccaacacgcccgtgtacatctgcacccaggggtcagtctccggagccgcgatctcggcggtagtaatcttggaagccatcacatcctccggtagtcatcaaggctgccgccgaggctgccgcggtagtcgtcgaggggggcgtcgcggtcgggatcggtgcgggcggcggcaaggtcttcgacggaacggcccgcgtccgtggggccgccatcctgtgcgcgggcatagaccgccagggcgcaggcaatcacggtgtcgccgtgccgcggcaggccgtccttgcctttcgtccggcggccgccgacctgcggcacgccccggaccagttcgatcgcccggaaatcggcctccacatcggggtcggccggcaccggcagtgcctcgcgctcaagtgccgccttacagagaggcatcgtctggcgataccactcggtcgagatcttcacctcggagacgcgcggccgcccgaactccagcgtcatcgcctcggccagcgccgcgccgttgccggtggcgtccagcgccatgtggtgcagccgcggcagacggcgaccgagccacgccaggatcctctcctgccccctaaacggcacgttgcgcagctcgatcacggccggcgtcagccaccgattgccgccttccaccaacaaccagatgcacgtcgcgtcgatcgtgcggccgaagtcgagccccactaccgagcgcctggccgtcggcggcagcgccgccatcagcggttccagctggtccaggatccagtcgtcgatgatggcgttgaggtgttcctctcgcctctcggccgacaggatgtcgtcgggcgccgtccagcggatcacggggacatcggcatcgcggcagtcggcgatcagggccgccctgaagtaggcgccgccgccggcgcgcgggatgacgtgcagctcctcgtctgctgcatcgccatagagcccgagcacagacgcgatccactcctccttcggcggcgtggatggccgggtgagcttgatgcgctcccagagcccagcctgcaacgcgtcctcgaacgtgatccgcagcactgccgcccccggccggcggccctcgcggatctcggtgacgagctggttgaactcgttgtcggcgccgtcatgggtcgagatcacgatcacgcggccaccccacatcgtcagggccagcgcggacttaaggacctcggtgaggttacccatgaaggccgcttcgtcgaggatcaccagaccctggcggccacgcagcgcacgcgggacactggatagcgcgacgacctcatagcctgaggcgtaccggatccggaatgcctggatgctgcgggtctcttccccgtccttctggtcgtaatatacgaattcttcaacctcggcttgcgcgcccaccagggcataagccgtcgaccacatcgcgaccgtgtcgatgaattcgcgcgccatgtcacggtcgaagcccatgtaaagggtatccatgccgcccgcggcccgctgcgacgcggatatcagggcggcacgagccgcgatgccccaggtcagaccgatacgacggctcttctcgatcacgagcagcgcgcaggtatcggcctgctggaacgctgctacctgatagtccagcagcacgcccttaagcggcatcccgaccaattctggcgggagggattgggccagcgccggcgtcatatcacgtcacgcccaggatttgctcgcggatgaaggccgcggtatccggcgtgaggccccgagccttggcggcagcgccggcacgatccgcagcctcgcgccgcgccttgtcggccgcccgcttctccgcctggagcacgcgatccgcatccaccttccgggctgacgccgcattcttgatcgcggaactaagcatcatcagctctttggggtccaacgccgccccgtctcccgcccccgccagcgagactttgaggatcagcccctggagaagctcgatcgaggcgcggttcatcacgtcatcgtccgcgtcatcgcccaaccggtcgaccaccgcctccgccacgctccgcgcctgcatcgtctgcgcccgcagctcgtcgagccgcttgatgtagacgcccagcccactgcggctgacgtcggtcacgcccaggccgtcgaggtgagagcggatctcgtcgatcgtgtgcccgcgttgccggagcccccggatcgcgtccaggatttcgggcggcagccggtccaccttgcttggcctggccatcggatcagtcgccgatcagcggataggccacgcccggcacggccggcacctgccgacgcagatagaggcggccgcggggggtgatttccgcccccatgaccattccccggtaccagtcggtgcgaaccagcccggcatcgcgcaggtgatcgagatcggcgcgcacggtgtcgggcgccgatgcgaggccccggtactggagggcccacaagttggttccgatgacgctttcgttcgcggcgccatcctggtcgatcaggatgcgcaggatcgcgagccgccgccctgcggcagggtccatccggtccgtcaggtcacgctcggtcacttctcgggcctcctggtgaggtattcttccatgcgctccagcgcgcgcccctggcgcttctgctcgtcgctgagccccccgatgccgccctccaggcgggccagggtctcgcgcagggctgcgacgtcatcggcggtgggcaggtgccgaatgtccgcttccaggcgctgggtccgctcggtgagatcagcaatatcgtcggccgccggcatgtgccggacgtcgccttcgatgcgctgtagtctcgcggccagatcggcgacgccggcctgaaccggcgcaagtgtctcgcggaggtcgtcctgcgacacgagcccgcggcggaccacccacgacagaacgggcaccacgagcgtgcccgtcgccatgacgacgatgccgagggccggcacgatgtccttcagccagtccggcatgccgcctccctctcctcaccacgagcacagtcgatgcaggtccgcgcccagggcagcgccgcgcgccgatcttcggggatcacatccccgcagacccggcaggtcggccgccccacaggccgcgggcggcggaggtgacgggcgatcgcgtcggccgccgcctgcgccgcccggtcggctgcgatgtcggcgtcgtcagccattggcggacctcccggggagccgggcggtgacgtaatcccacagatccgccgcaccgtccgcgcccgcgaggtcaaaccgcgagagggcgtcaggcacgcgccgacgcaggtagttgacggccacttcgacggcctgggtcttggcctcgggcgttctgatcgcaccacccagctggtggatcgcgtaatcgatcgcgttcagggtggcgtcttcaaggtacgcgcggacgcgcgcgtcctgctccagccccagccagacgactgcacggtggatcagccgcaccgcatagccgccggcgatcacgccgatcgcgccgagcacgttctcgatcaccgggccgatcgcagcggccgcgacactggcggtggtgtcggcggcatgggcggcatgggcggcagagatgaacaggatggtcgcggtgacggcgacccaggcagcgatgcgcttgcgcatgctcacgcctcctcgtcataggcgcggatcagccacccgcggatgtagcgctggtcgcgcgggtcgcggaccacttcctcgcgatagagggcggcgatctcgcttcgataggcggggatgatggcggcgccgatctcggcgatcgcggcgcgcgatcgggggccgaggatgccgtcttcggtcagcctgcggccgtgcgcgcggcaggcgcgctggagggccgtgtgggcgcgcatgggaccgagattgacggccgcatcgagcgccttcgcgccgacgccatagggcagcgccccatattcgtagcggtcccaccacagcacccggtagaccacggcggcctcgtcccaggtgaggccgcggatccagtccggcgtgatcgtgcccggcacagcgaggccggcggcggcgagctggcggcgatcggcggcggaccagcgcttcgcgaagttgatggcgatgccgtggtgggtgatgccgcccggatccttgggatcatcgacgagaccaccctcgcggctacgaagacgcccgacggccgcggtgaagcgggcgtcgggcgaggtgtcgggctggggatcgcccgtcgggaggatcgtgaccatggccgcgattttcgcgcggccgcgggcagcggatcagggggacagatgttcacatccgcccctgagatcgagatccatctgccgcccatcctgccgccgcagccgccggcgatgcgcccgcccgcaggtcgggcagacgggcgcgggctccacgtcgtccggcccgccattgccgcgggcgacgccggcggtcaggcgggcggcgtgggtctcggtgatgcccagctcgcgggcaatgcgggcgtgagtccacccatctgccctcagtctccgcgcccgggtggcccggatcagcggggccgctgacggcacggggtgtgtgtccccacccagctcggatcggcaaaccagccgcgccgcctgaaccccgagcacccgcgccagctcgtgccccggccgcacgtcgcggggcacgtagagccgggtgccgccgtgcgcctcggccagccgcagggcagcgtcgacgccggcgatgcgggcgacgattgacaagatgccgggcaaggtttcgggcttcggggtccaggtcatggcgttacctctgccggttttcgccgggcggcaccgcccagcaccacgtgccacgcacttccgatccgtccggccaccgccagcgcgcccggaggacgtgacggctaccctcaggccgatggcggatgaccacccgctcggccaccagccgcccgccggcggccgtgtggcgggcatgggcggcggtggcggccgccggccagcccggcaggggcttcatgccgccctccggcggcgcacttcgacgccgagctgtccgatgatcgcatccagctcagacgcccccatccggcggatgtcgacctccgccgcgagctgcccgccccgccgcagctgggcctcgatcaccgcccggcgcgcggccagcggccccgcatcggccggcggccagtcgaccccgccctcgcgcgcgatccagaacttcagggcctcgatcaccttcgcgagcgtggccgggtcgacccagttcatggcgctgatacccgtctgccgctcgatccactcccccaggcccgtctccgacgggtcataggtgatgccgagattgtgcgcggatacccacagggcccggatcttgcgggcctgcgccgacccggccgggcgtcgatcgcccttgcgccggcgcgacttcggcacccacccggccgcccgcagcgcatcgagcacccgcccgaggtcggcagccgacgcacccgcggccgagcggctgccgatggtccggacgtagacgtcgcgcaggccatcgtccgagagccccagctcccgggcggcggcacggacggtccgaagccgcagcgtcctgtcatccatggcgggcctccttcagggccgcatctacggcggccctcaaatcgggggtgttcagctcggcgatttcgtcggccggcaaatcgtccggcacgtcgatcacgaccgaaactgccagaggaccctcggagaggatctgccacccggcctccagataggcctcaagggccccgtaggggatcgtggtgacatagcggggcaggtcagccatgggtcgcctccccgatcacggccagcagctgagcccgcgccagccgccggcggcgctgcgccgcggcgcagacgtcgcgggcgtggcgggcggcggcgcgggcggcatcccaggcgacctcggcgtccagcgcctgggcctgggcggccagatcgaggtcgtcgaccacctgatcgaggtcgtcggccgcgcgggccaggatcgtctgatagctggcgttcattcctgttcccctccaattccaatgtcttgccccatcgcccgcctgtgcaggaggtcgcccagctcggcgtgcgccttcgcctccgcggcccgcgccaaggaggccgtgtcccgcaggtgcccggcgagcccggtgatgacgctgccgagccgttcggccgccgccgcccgttcggcggccctgaacatgtcggccgcgacgtgcgcgatcgcgtcataggggccatgcacggcccgctcctcgtcgccctgggtcagctcgcgcaggctgcgctcggtatcgcgaatcagccacgccatgccgctgatcagcagctgctggttcgagggtgcgcctccggcggcggcgtgcatggctgccgtcgccgccttgaggtcgtcgcacaccttcagcagctcgtccttgtaggtcgtgtgtctggcctgggtcatgacagcggcatcccgagcgcgcgcttgtagacgtcgagcaggtcgtcctgctccgccacgtcctgcggctccatcctgcgcagcttgatcagctgccgcatgaccttcgtatcgaagccgttgcccttggcttcggcgaacacctcgcggatgttcgcggcgatgccggccttctcttcctccagccgctcgatccgctcgatatacgagcgcagcacgtcggccgagatacctgcgacctcggtcatggcgtcaccatcttgtcgatgttgtggggttcgaccttaaaagtcagggcgaccacccaggggttggctgcccagctggcagggccagacttgccgtgggtgcggacccaggcccaggcataggcagccgtaggcattgcgagccagtgcctcgtgtcacgatcgagcccatacacgcatatgccactcgggtgccgtccgtgctggatgccctcggcgaggatgtccgtcacctcgatatcccagaggcggcaggcgccgcctgcatcaggatgaaggcgtatctcgcgcacgcgagcggagatgcataggcgtaggtgacgacccgcggcggattcgtggggcgcgggtcaagaccgcagataaacaggtccccggaggttgattttgcgaggcggtgggcccgcttgaacgcgtcgcgggcgtcgccgtagggatcattcttcgtggtcataggtcgtaccctttgaggtatgcgagccgcgccaccgcggccctcagtggtgtcggcatccatgcccggcctgcctgccagatcagcaggtccagcacctcccgctcggccgccgcgatcgcgtcatcggtgacgcgggccgccggctcgggtgccgggcgggcggcttccagggccgcgagacgctgctcaatggcttccaggcgggcgggatcggacatgggcgcctctgccggttacagccgccgcagcgggatgacctttcccatcccggccgcggccctctcgcgcgcgacccgcgccgcgagatcgatctccatctcgcgcacccgcgcggcgatgcagaggaggagggccaccacctgttcccattcgtggggcgggatcgtgggggcggccttgtcgagccgcgagaccagctcgcggatttcggtagagggggtcatttgcttcctcccgattgggcgaccccgtacaggcacgtcttgcaggcgcgccacgtctggatcgcgaggtgtgaactggtcggcggccgcggatccgtccggatccgacggcaccgcgtttcgtcaatgcgccccaggacggggcagtcgacggcctggatgatcaggccgcgcacagccgcctcgacccgcgcgtaagagccgtcataggtccggcgcagaacccggtggacgaccatcgggtcgtatcggatctggtaggccacggcgttcgcggtcttggtctgcgcggcataggccagagcccgcacccaatccggcaagtcgtgcccccatgccgccatcgccgtgccgacatggtcggtgccgggctgcggggtacccttcttcgggccgcgcttacccaaggggcacctcccgcgcgggggcgacgcccaccgcccggccggtgttcgggtcgatcacggccctgacgtcgacaaccaccggcgcccgcggcccggtcacagcgccgggcagcagcacatagactgcctgcgccccgctgccccgcttcgcagccagaccggccgcggtcagcgcgacgcaataggcctgcgcggcgcggagggtgacgggggcggcttccgtgctcgcccagatcgccagatcgcgcgtcgtgacggccttggtcatctgcaacgtccgccacatgttcgcgcgagctgccgacggcggctgcacagtcccgtccgggcggaccgccggcgccgccggcgacagctcagcggcttcaggggccccgtagaccaccgcggtcccgtcgcggcgcagctcacgcaggatgccggcctttgccagccggcgcaggtagacctgcgccgtcgaccggctgccgccgtcgcccccggcgatcgcgttgaccgtgatgtcgccgccttcggcgatcacgcccaggatccgccgccagagggcctggtgccgggggttggcgccaccctgttcgggcagcgttgccgggatctggacgatctgggcgggggaggccttctttttggccatgtcagatcctccgcaccttactcggcgccgcgtcccacaacggccgatcgccccatgcagccgcgtcaacgacactcaggccttcggcttccgcccaatcacgcactgcatctacgccgacgcagatccgcctgacccgaccgccggccctggccgcgatcaaatcggtcagatcgcgggtgatggtcacaccacacgtgtcggtgacatagagtttggccagcacggcggcgtcatcagccgtggctggctgcgcagccacccacgcgagcacccggttatgcagccgctcattgcgccgcatcgcctgcggcaggagttcctcgccaatgagcacgatcgggaccccggtcttgttgtggatgtcccggatcgcctcgtcataacccttggcgacggcgtggtcggcttcgtcgatgatcagcagcgtcggggccgcggccagggcctcgatcaccgactgatggaggtcggccgtggtgccgcgggcgggggcgcccacaagccgggcgaggtgcgccaggaacgtcttggtggtccacaggcggccgagctcaaggtagtgagccccgcactcgttcgcaccgtagacagccgattgcgtcttcccgaaacccgacggcccgaaaaacaccccgatccccggcaagtgagcgcggcgggtgagaaggcggctgacgagcaaccggaaggtggcgacattgtcaagaggcgcaactgtatgcattcgttaatctccaaaataagtactaatggttgtctctgcggccacagccctgccgtcagcccgggtcccgggcaggcaggtgtcaaattcagcgccgcgagaagcgggcgacgccggcctccatcatcgcgatatccctcacctcggtggcgatggcggcgttgatcgcctcaatctcagtcagggccgccaccatttcggtcaacgaccacgtcaccaccggggccgcctcggcctcgatatcggtccagtccaccggggccaaggtatagatgtgcccgccttcggcacgcgcttccgcgtgtgtggtgatccggataatcgacagaccgagccggtcggcgcgggagcgcaaattattgattttgttcatcgatcctccttcagcgcgcgaggatagcggcgcgctgttcctcaaggtcccgccgcacccggtattccgggcgggtctggtatttcgcaagccacgtgacctcgctctcggtcacgctctcgccggcatccacgcgccgctcgatttcgcgggcgcgggcgtaccgcacctcagcctcggtcgccgcggccggcgccgaggcacccggccggatctcgaccacctgcgccgaccgctgccattcggccgcggctgccgacagccccgaggcgacctcttgcggtttccgcaccggggccgccggctgcgggatgctggtgatcttcggcatcccgggttcagccggcgccggggtgacgtcgatcacccgactgacgcccagcctctcgacctcgatatcctcaagccgctgctccaagagagccgaccgcctctgcgcccgctggtcgcgcgcgtgctggattttgctctcgggcatatcggggatcacgttggcgtcccgctgggccacgcagatcaggcgcccagccccgtcccgcacccacacgcggtcaccgtcgtgaatggagtaacccacccgcaccgactgcccggtgtagggcaccagggcatggtcgtagtaccgcccccagggcagacgcacttcaccgcgcacggtgcggcggatttcgtaggggcgaaacaggtcctcgacgagatcagccggcagatccgacggccgccagccgttttcgatcgcctcgcgcatggcttcggtgggggtctggtggcgggtgcggccagtttcggcgtcgcggatccgcttcagggcgctgtgcggcctgttgttataagcgtcgaccgctgcccgccagtgatcgagcgcttcctgccacgacagcagcaggcgtgatgccccgcgggtcttgatatcccgctcaactcgctgttcgacgcgcttgacgatatcccggtcggcgcggcgaccaacataggtcggcagcgagcgctccgcgggcccccaaatagtcgcctgcgccctctcgatcttgccccgcgcctgagcccgcccgccgattgaccgttccggcttcgtgccgcaccgactgaagaggccgacgacctcatcgtcgaaaaaccagttctcgaacccggccccatgatctgtgtaggtcatggccatgacgccccacctctcaacggagtgccgaaaagcgtccatcactacccaggtgctctcggcgagcccggccgaccaaccaacgcagtagcgggtcgcgacatccacgaaagagaccagctcggccttgaaggggttgcccgtgacgggatgctggaccttcgccttgtacgcgtgcccgtcaccggtgcagagatccatcggccacagcccggcactggatcgccgcttgtgcccctggagggccagcatcgccgacgggccgatccgccccttctccctcacctgtggcggcaagctggcgagataggtccgcgcctgactgtaggtcggcgccgacaccccctccggcaggcgggacggcagatcccggacgatctcactcaccgtcgaatgcggccgctccctatatatactgagtaggtacgacgcccacgccggctccggcgccggcggcggggccttcggcaacaacccgacccaccccgcctcgcgcgcctgcgcccgccaccgcttgaccgtccgctccgacaacgtgcgcccgccaccttccgccgatcgcgcgttcgccatcggcaccagccgcgccaactgctcgcccagcgacccatcggccgcggccgaaaccagcgcccggatcgcccggtcggacccgtgcacctcggccaaccgatcgacctccgccagcagcgccgcccgcgcatccgccgcccgccgctgccagtccgcggccttcaccgcgggggtgggggtgggggcgacctctggcagtttttcgggctcgaccgcggtggcctggttctcgggctggggctgggtggccagctcgcggcgggcgagttcatcgcgggcctcggccggcagaccgctggctgcgaattcccacccaccgccggacgcttcgcgtcgacgacgcggcgccccctctcgcatcagtcggcgccgcatgccgctttcgtcgtggggcatgcccgacaaccgatcagctgcccacgctgctgctgttttccagacttcagccatttcgcgccgccctccgcgacgcttcccgcaggaaatccgcagcctccctcggcaacatccgctgcacccgcgcacgcctttcccgcagggccctttcctcaagctcgatcgcggccagctctgcgatcgcggctgcctcgtgcgggacggcacgatagccggcggcctcattgatcagatgcaggcatcgcgcatcaccggtgacgcggaccagcgccggcagcgcctccgccggcaggcgccactcggccgcggaaggggcacagtacctgtccagcatcgccttcgagatctcgcgctccggatcaagccgacccatttcagcggcgatgtcgtgtcggtccaggcccagccgctcgcgagcgagcgcaagcgtctcgaccagggattcacgcagtcggaggccgaagccgggcagtggcacctccgccggagcgtcgaagaaactcccctgtcctggcgcgcaggttgtcggtgaggggcgctttttagccatgcctccctccgtcaattgcgatccaaagatttgcgggcgccatagctatgcaaccttgcgtttttgacaatgacgcactgcggggcgatcgatagcatttgtcctgcgccccttcggctcgttcctccggctgccgtccgcccgaaacctctcgggccagatctgccggggagagagccccaggtactcagcgataaccagctcgccatcgagatccgggtgtcgcagcgcgtgcctacatgcgtattccggcaagccgttcagacgggccagctctgccagggtcattccctgcatgcgcacggccgccttgatctgctctggatgccaaacatcagcgcttggacgctttggcggtgacgacgccatgcggtatcctcgtcgcttggccgtaaccggcctacttttagggggttgtctgttgtgttcgcaacaatgatgccgacaaaaagtcggatgatcaacgacaaaagatcgagtcccgacctgaatcccgacctaaaaatcgtcgataaggcgattttcgtcgatgaaccatggttttatgtcagggtgggcagcggatatggcgactgataagtcagtcccgggctggtccgacgggcacaggactcgattcagacagatactcgatacgatcggggggctcgcaccggcagcagccatcgcgtcggtgacgcccgaacagatagcgcggtggagagatggccgcgcccgaccgccattcctggcaatggttcagctggccagcgccgctggtgtcagcctcgactggctggcaaccggcgcctctgccagttcgcagccgccttccgatgccaaacagcaggtcgagcccgtcgaccctcagcttatggggactatcgttgacgccgtccgcgccctctacaagggcgaaggcgcagccatcccggaccggacgctaggcgaggaggcagcccggatctacggcgcgctggcccccacaaggcacgacgtctcggcaaccctgattgccttgggggagatcctggccgatcggcgccggcgccttcgcgagagcgcagcaacccctgaccgcagcaaacgcccggcctgaagctcgtccgtttcgataaagatcccccgatcacacaacccggccctccttcgccggatcgcgcgcttttccgtcccgtaacaatcgtcaccggtgatttcgacgtaccagttcttaatgattgattaatacgggccgacgtattcgcgtcacgcggtcgaatgcagccacgagttgccggcgggactgggcgtcacgcccaacggctgcattcctcaaggtgacaaacctcgccacaatcggccgcccaccccttcggcgcggacgccgggcatgacaaaggggccgcaaatcgctctgcggcccccgaaacccggtttatctcgtcgattcagcgccctatccggcctcgtccagcctgatccagggtaatcccgggtgccaaaccttcccgttcctcacaggcgggttcagcttctcgcccaatccgcgcttccgcagccccgatctgcccgatgccgaaatcatgaccgaggcacatatcaccatgggccgcaccgccgaaaacgtggccgcgcgctatggcatcgaccgcgcgacgcaggaaggcttcgcgctccgctcccagcagaaggcgcgtgatgcccaggcggccggccggctcgccgacgagatcgtggcggtgcacacgcccgacggcgtggtcgatgccgatggctgcctgcgccccggtaccacgctcgaaggcctggccgggctgaagcccgccttcggtgccgacggcacggtgaccgcgggaacggcctcgccgctgaccgatggcgccgtggcggttctcgtcacctccgaagacttcgcccgcgcccacggcctgccgatcatggcggtggtccgcgccaccgcgattgccggctgcccgcccgagatcatgggcatcggcccggtgccggccagccgcaaggcgcttgcccgtgccggcatcggggtcggcgatctgagcgtggtggagatcaacgaggccttcgccagccaggcggtcgcctgcctgcgcgcgctggaaatccccgaggacatcgtgaacccggatggcggcgccatagcactcggccatccgctgggggccaccggcgcgcggatcaccgccaaggcggcacagcagctggtgcggggcggcggccgcttcgcgctcgccacccagtgcatcggcggcggtcagggcatcgccacgatcctcgaagccgtctgatcggcggatctgcggtcaaaggccgcccagacgccatccggcccgtcccaggcgccgcgggtggcgcccttggaatactcggtcgcgcgctgttcgaagaaattggcgtgctcaaccccgttcaggatctcgaccagccagggcagcggatgcggcaccagcgcccgcgcgccctggtcggggtccgagaaacagccatggaccggggtcaggcccagctgggtcagccgccagtcggcgatgtagcggacataggccttcacctcgtccggccgcagcccctccaccggccccaactcgaaggcgagatcgatgaaccggtcttcaagaccgaccatcgttttcgccacatcggtgatgtcgtcgcgcaccgcccgggtgaccacgccggtctcgcggtgccattcatggaacaggcggatgatgccttcgcaatgcaggctttcgtcccggaccgaccagctgacgatctggcccatgccgttcatcttgttgtggcgcgggaagttgagcagcattgcgaagcttgcgaacagcgccatgccttcggtgaaggcgccgaacatggccagcgtacgcgccacatcggccaccgtgccggtaccgaagctgtgcatgtaatcggccttggcgcgcatgtcggcatagtcgtggaaggcttcgaattcggccttgggcatgcccagcgtcttcagcagcagcgcataggcatcgatatggaccgtctccatgttcgagaaggcggccatcatcatctggatttcgagcggctggaacagcggcagatagcgcttcagataattgtcgccgacctcgatgtccgactgggtgaagaagcggaagatctgggtcagcaggccgcgatcggcatcgctcagccggtcggatgtccagtccttgacgtcgccgccgagcggcacctcttcgcccatccagtggatctgctgctgccgcttccagaaggcataggcccaggggtagcgctccacgtcataactgccggtagccgtcagcagcccgacccggccggtgccgaccagggtcatcgggtcgagatcgccggcgatcacgcgcctcactgacatgccaggcactcctcgtaatcggtgcgtgcggtcgcagccaggccggccgcggtgcgcgtgccgccggcaaagcccgcccgctggatggatttggaccgacagtaataaaggctcttcaccccccgctcccaggcggtccagtgcagcatgtgcaggtcccatttatcgatatcggccggcagatacaggttcagcgactggctctggcacaggaagggcgcacgatcggccgccagttccacgatccagcgctgatcgatctcgaaggcggtgcggaacaccgtcttctcgtcctccgtcagcccgtccagatgctgcaccgagccctcatgctcgacgatcgactgccagatttcgggccggtcgaggccgcgttcggccagcagccgggccagatgcgggttgcgtaccgggaaggcgcccgacagggtcttgtgggtgtagatattggcggggatcggctcgatacaggcgctcgtgccgccgcagatgatgctgatcgaggccgtgggcgcgatggcgagcttgtggctgaaccgcgcctgcatgccggcctcggccgcatccgggcaggggccgcgctcctcggccaggaacaccgaggcgcggtcggcttcctggcgcagcctgcggaagatcgcgaggttccaggccttggccatcgcgctctcgaacgggatgccgcgcgcctgcaggaaggcgtgaaaacccatcacgcccagcccgaccgagcgttcgcgcatcgccgaatagcgcgcccgggccatctcgtcgggtgccgtctcgatgaagccggtcagcacgttgtcgaggaagcgcagcacgtcctccacgaagcccgcctcgccctgccattcgtcccaggtctcgatattgagcgaggcgaggcagcagaccgcggtgcgttcttcgtccagatgatcggcgccggtcgcaagcgtgatttcgctgcagagattggaggtcgagaccttgagccccagcgcccgctgatggcgtggcagggcccggttcaccgtgtcgatgaacagcagatagggctcgccggtctgcagccgggtctcaaggatcttctgccacagcctgcgggcgtcgatccggcgcatcaccgcccccgatttggggctgatcaaggggaaatcgaccccctcgcgcacggcctccatgaaggcatcggtgatcgcgatgccgtgatgcaggttcaggcccttgcggttgaaatcgcccgaggccttgcggatttcgaggaattcctcgatctccggatgatgcacgtccagatagaccgcggccgatccgcggcgcagcgagccctgcgagatcgccagcgtcagcccgtccatgacatggatgaagggaatgatgcccgaggtctcgccgcagcccttgaccggctcgccgatcgatcggacctccccccaactaggtgccgatgccgccgccattggaggcaagcgccacattctcgttccaggtccgcacgatgccgtccaggctgtcgggcaccgcgttcaggaagcacgagatcggcaggccgcggctggtgccgccattggacaggatcggcgtcgccggcatgaaccagagccgcgagatcgcatcatagatccgctgggcgtggggccggtcgtcggcataggcgcaggcgacccgcgcgaacagatcctgatagctctcccccggcatcagatagcgatcgcgcagcgtggccttgccgaaatcggtcagcagcgcatcacggccgcgatcgagcaccagatcggccggcacgggcttcggggcgagcggaaacgggatcggcgcctgcggccggcgcggcgcgctttccagcggcaccggacctgtcaccggaaccagatggccgtgccggtcgaagtcgaaggcgagagaggtcatggcgttcacccatcgatctgcggaccggggccggatgaacgcagggcgggccgaacgcgcgggcacgggatcagaacccgcgggtcgccggacggaaaccgccatgcgcccgccgggactccccgcccagggacgtatcattccaaggttccggcaggtctcctggctcgcgggtcaccgccgccacgccggccttcccgacgatcgcccgtcagtggccctgtcttgcgtggccgctctccgcctacagttgcggggacagctccggcattgacgagggtgtccctcctcgcaccggattccctcttagccccagatcttgtagacccggggaaccgagaacgccgcatcttgtgcagatcactgtcccgccgtcaagcctccgccgcgggatagggcgcgaagcggcgctccgcctcgtccaccgccagccgccgccccaccggcggaaaggcgcgctgcgggcaggccgggcggtcgcagaccttgcagccggcgccgatcggcgtcgccgcctcggggtcggaaagatccagccccttggcatagaccagccggccggcatgacgcaggtcgcagccgaggccgatggcgaagctcttgcccggcgcgccccagccgccgccggtccgtcccacggtgcgggcgatccagagataggtccggccgtcgggcatgcgggccagctgggtcaggatccgtcccgggcttgcgaaggcctcgtgcacattccagagcgggcagctgccaccgacccgcgagaaatgaaaatcggtcgccgactggcgcttggagatgttgccggcacgatcgacccgcacgaagaagaacggcaccccccgcgcctctggccgctgcaatgtgctgaggcgatggcagatggtctcgaaccccacaccgaaacgccgggccaggcgctcgatgtcgtagcccagttcctccgccgccgccaggaagggaccatagggcaggatcagcgcgccggcgaaataggcggccaggccgatccgcgccagcacccgcgcctcctcgcccgaaaagcccggatcggccgacagccggtccagcaccgccccctgctccagaaaggcaagacggctcgcgacctgaaaggcggcccgccccggcggcaggccggccgccagccgcagcacccggcgctcgggatcgaagcggctcagcaccccgccgcggctttccgcctcgccgggctgttcgtcgtcgatcacctcgacgccgtggcggcggcgcagataggcgatcagccgcggcagaacccggccgggaaccagccccgccgcctcgttcagtgcctcggcggcatggtccagctcggccacgtggttgtggcgggcataaaagaaatcccgcacctcctcgtagggcatcggcgtcagggtctggccggcgacatcctgcccgagccgggcggcaagcgcatcggcccgctcttccgccgcccgccagttccggtacagcccgaccagcgcgcggccgaccgcgggcatgccggcggcgagttcccggatctccgccatcgacacccgtccgcccgcaccgtccccgcccgcgaccagcacgtcgcgcagatcggtgatcagccgtgcctcctcgtcctccgagaacatctgcacatcgaccccgaagatcgcatggatcttcagcagcaccggcacggtcaacggccgctggttgcgctccagctggttcagatagctgggtgacacgtccagcgcgcgggccagcgccgcctgggtcaggccgcgctcttcgcgcagccgcttcagtcgcacacccatgaatgccttactcatgcccggctcatccttcgtgtcccggatcttcgcaaacttcgcaaatttccggatcgcccttcgcaaactcacgcattttcagtcatttagagattttgtggtctgcgtatattgcgaagcacccatccgatgcaagagcaaagaggcccccggtgatcctgcacgaggttcgcgcccgccgttccgccgaccacctgccccgcgaggatcagctcgcctggaagatcgcggccgttgccgccgatccggtaccggtcggtgccgaagtggccgagatgatcggcaaccgcatcatcgacaatgccgcggtcgccgccgccgccctcgcccgccggccggtggtgagcgcccgcgcccaggcggccgcccatcccttcaccccgggtgccacggtcttcggcctgtcgccccatcgccgggtctcgcccgaatgggcggcctgggccaacggggtcgcggtgcgcgagctggacttccacgacacgttcctggccgccgactattcccatccgggcgacaacatcccgccggtgctggcggtcgcccagcattgcgggctgaacggcgacaggctgctccgcggtcttgccgccgcctacgagatccaggtcgatctggtgaagggcatctgcctgcacgagcaccgcatcgaccacatcgcccatctgggcccctcggccgccgccgggatcggcgcagcgctggacctgccggccgaggtgatcctgcaggcggtccagcaggcactgcacgtcaccaccaccacccgccagtcgcgcaagggcgagatttccagctggaaggcctatgccccggcctttgcgggcaagatggcgatcgaggcggtggaccgcgccatgcgcggcgagggcgcgcccgcgccgatctacgagggcgaggacggggtcatcgcccgcatgctcggcggtttcgaggcggtataccaggtgccgctcccggcccccggagagcccaaacgcgcgattctggaaacctggaccaaggaatattcggccgaataccaggcgcaggctctgatcgatctggcccggcgcatgggcccggccatcggcaaccccggccgggtgaagagcatcgtcatccataccagccatcacacccacaacgtgatcggcaccggcagcggcgaccctcagaaattcgacccccgggccagccgcgagacgctggatcattcgatcatgtacatcttcgcggtggcgctggaagacggcggctggcaccaccagcgctcctatgcgcccgaccgggccgcccgcccctccaccgtcgccctctggcggaagatctcgacggtggaggatcccgcctggacccggcgctatcacgccgccgatccggcggaaaaggccttcggcggccgggtggtcgtcaccctcgacgacggccgggaaatcgtcgacgagctggccgtggccgatgcccatccggccggcgcccgccccttccgccgccccgactacatcgccaagttccgcaccctcgccgagggtgtgatcgagccggtcgaacaggaccgcttcctcgccaccgtcgagcgcctgccgcatctgtcggccgacgatctggccgggctgaccttcacggttccgtccgaccggctgggcacgcgcgcgctccacggcatcttcgaccggctcggctgatctcctgaaggagtccaggcagatgacaaccaccccgacccagaccgccgccgacgccaccaccaccccgcgcccgaagaaatcggtggcgctctcgggcgtgcccgccggcaacaccgcactctgcaccgtcggccgcagcggcaacgacctgcactatcgcggctacgacattctcgacatcgccgaccgctgcgatttcgaggaaatcgcccatctgctgatccatggcagcctgccgaccgaggcgcagctccgactctatcgcgagaagctgaagcggctgcgcggcctgcccgaggcggtgcgccggacgctggaagccctgccggccgccgcccaccccatggacgtgctgcgctcgggcgtctcggccctgggctgcgccctgcccgaggccgccgaccacaacccggccggcgcccgcgacctcgccgaccggctgctggcctcgctcggctcgatgctgctctactggcgccactatgcccatgccggccggcggatcgaggtcgaaaccgacgacgacagcatcggcggccatttcctgcatctgctgcatggccggccggccccgtcctcgcatatccgggcgatgcacacctcgctcaacctctatgccgagcatgaattcaacgcctcgacctttgcggcccgcaccatcgccggcaccggtgccgatctctattcggcgatcaccggcggcatcggcgccctgagcggcccgaagcatggcggcgccaacgaggtcgcgctggacatccagctgcgctatgccacgcccgacgaggccgaggccgatatccgccggcgggtggcggcaaaagaggtgatcatcggcttcggccatccggtctacaccatcgccgatccgcgcaatgcggtggcgaaacaggttgcccgccggctgacggaggaaggcggcgacatgcggctctaccgcatcgccgaacggatcgaggcggtgatggccgatgcccggtcgatgttcgccaatctcgactggtacaccgccgtcgcctatcacgtgatcggcatcccgaccctgctgttcacgccgctcttcgtcatcgcccggacctccggctggtcggcccatgtgatcgagcagcgccaggacggcaagatcatccgcccttcggccaactatatcggcccggagccgcgcaccttcctgccgatcgggcagcgcgacccggccgggcgcgtgcgcgcggcctgacccgaggatcacctccgatgccctatctcgtcgccgaccacctgcccgcggaacccgcgggccggcggttccggaacctccttgcccggccgggcatcctgcgcctgcccggtgcccataacggccttgccgccctgcaggcgaaggcggccggcttcgatgcactctacctgtcgggggcggcgatgaccgcctcgatgggcctgcccgatctcggcatcatcaccgccgacgaggtcaccttcttcattcgccagatcgcccgcgccgcggggctgccgctgctggtcgacggcgataccggctatggcgaagcgctgaacgtgatgcacatggtgcgctgcttcgaagaggccggcgccggggcggtgcatatcgaagaccagctgctgcccaagaaatgcggccatctgaacgacaagaagctggcctcgctgcccgacatggccgccaagatcgccgccgccgcccgggcgcgccgcgatctggtgatcgtcgcccgcaccgacgccgcggcatccgaaggtctcgacggcgcgatcgagcgcgcccgggcctatgtcgaggccggggccgatgcgatcttccccgaggcgctgacttcggaagacatgttcgccgaggtcgcccgccgcctgcccggcgtgccgctcttggccaacatgaccgagttcggccgcacgcctgcgatcaccggcgcccgcttcgaggagatgggctatcgcatggtgatctggccggtcagttcgctgcgcgtcgccgcccgcgcccaggaggaactctatgccgccctggcccgcgacgatgccacgacggcgatgctgccgcgcatgcagacccgcgcccagctttacagaacgctcggctatcacgactacgaggcgctcgacctgtcgatcgtgaccaccgtcattcccgtcctcggagccgcctgacatgtccgcccccctgatccccaccgcctctctcggtttcccccgcatcggcccgcgccgcgaactcaagacggcgctggaggcctgctggcggggcgatatctcgatcgacgacctgctcgacaccgcccgcagcctgcgggcggccacctgggcacgccagcatgccgccggcatcacctgcctgccctcgggcgacttctcgctctacgaccacgtgctcgacaccgccgtcatggtcggcgcggtgcccccggtctatgccggggcgggcagagatcatgccggcagccgggtcggtctcgacacgtatttcgccatggcgcgcggcacgcccgacgggctgccggccatggagatgaccaagtggttcgacaccaactaccattatctcgtccccgaactccggcccgatcagaacttcttcctgggggatacccgcgtcgtcgacgcgtatatcgaggcgcgcggcctgggtttccggacccggccggtgctgctcggcccggtcagcttcctgatgctggccaaatgcgcggacgaggccttcgaccggctacgcctgctgcccggcctgctgccggtctactcccatgtcctgcgcctgctcgcggcggcgggggcgacggaactccagctcgacgaaccggtgctggtcctggatgaggacccggcggtcaccgcggcggtcacgaccgccaccgaagcctttgcctcggcggcaaccgggcttgggatcatgctcaccacatatcacggtggcgtcgaccatctggccgacacgctctgccggctgccggtcgacggtctgcatctggatctggtccgcgcgcccgatcagctcggcccgatcctgccgaagctcgcccccgagacccggctttcgctgggggtgatcgatggtcgcaatatctggcgggccgatctttcgcagctgctcgaccggctgaccccgatcgtcgatgcgcgggggcccgagcgcatccagcttgccccgtcctgcagcctgctgcatgtgccgatcgatctcaaccgcgagacccggctcgatccggagctgcggtcctggcttgccttcgccgtccagaaactcgacgaactcaggatcctgacccaagcgctgggcgaaggccggggcgcggtcgaagaagagctggccgcggccgatgccgccctggcggcccgccgggcatcggcacgcatccacgaccccgccgttgcggcccgccttgcagccgtcaccccggccatgacccggcggcagaccgcctatccggtccgggcgaaggcacagcacgaccggctcggcctgccggcctttccgaccacgaccatcgggtccttcccgcagacgcccgagatccgcaaggcccgcgccgaccatgccgccggccggctcgacgatgccgactatgatgcgctgatcgcggcccgtaccaccgaagcggtccgctggcaggaggaaaccggcctcgacgtgctggtccatggcgagttcgagcgcaatgacatggtgcagtatttcggcgaacaactcgccggcttcgccttcaccgatcatggctgggtgcagagctacggctcgcgctatgtccgcccgccgatcatctggggcgatgtctcacggccgcagccgatgacgctgcgctggtcggccttcgcccgcagcctgaccgaccggccgatgaagggcatgctgaccgggccggtgaccatgctgcaatggtccttcgtgcgcgacgacctgccgcgcatggaggtctgccgccagatcgcgctggcgctccgcgacgaggtcgtcgatctggaagccgccggtatcgaggtcatccagatcgacgagccggccttccgcgaagggctgcccctgcgcagggcggaccgcccggcctggctcgatgccgccacggaatgcttccgcctcgccgcctcgggtgtcggcgatgccacccagatccacacccatatgtgctattccgagttcaacgacatcatcgacgcgatcgcggcgctcgatgccgacgtgatctcgatcgagaccgcgcgctcgaagatggagctgctcgacgctttcaccaccttcgcctatcccaacgaaatcgggcccggcgtctacgacatccacagcccgcgcctgccgtcggaagaggaaatggtcgcccttctggagcgggcctgtgcacgcctgcccgcggagcggatctgggtcaacccggattgcggcctcaagacccgccgctgggacgaggtgaagccggcccttcaggccctggtccgggcagctcgccagatgcggcagcgggtggcctgaccccgacccccgcctgtgatatggtcggaacctgtcgatcctgccgggttgcccggccccatccggagatgaggtcggatgatcccgcgcccggcgatcacgcccgtcatgccttcccgcgcccggccgctggccggcggccggaccgccgccggttatcgcccggacatcgacggccttcgggcaatcgccgtcctggccgtcgtgctgagccatctgccggggccggtgctgccgggcggatatctgggtgtcgacatcttcttcgtcatctcgggctatctgatcaccggcatgatccggcagcagatggccgaaggcaggttctcgcttcgggtcttctatggccgtcgcgcccgacgcatcctgcccgcactggtggtcatgctgctcctgctcgccatcctcgccctcgcagccttccgacccgccgatcgtgcaggcttcggccgcgaggcgctggcgagcctcggcttcgtctacaatttttacctgcttcaggccggtgccggtcatggcgccggccttctgctgcacacctggtcgctggcgatcgaggaacagttctatctggtcttcccgctgttctgccttctggccttccggacgagccgtcgggtcgccgtctcggctctggccctggcggccggcctgtccttcgccgcctgtgtcatcggcatggaaaccggccgctaccttacggccttcctgcttctgcccacccgcggctgggagctggcactgggcgggctggtggcgcttgccggcggtggccggcagcatcgtcatctcggtacggccggcctctgcctgatgatcctcgcccttgcaaccggcggcatggtggccggcaagccctggccggcggtcctgacggtctgcctgggggccgcgatgatcatccgcgccggcgagcatcagggcggcatggcgacggcatggctcgcgacccggcccatggtcttcatcggcctgatctcgtattcgctctatctctggcactggccgctgctggccgccgcccgaaccgttctggagcggcgcccgaccctgagcgagggcatcgcctgcgtggttctcgccggtgttctcgccgctctgtcctggcggttcgtggaacagcccacccggcgcggcgtcctgcggccggcagccctcgccggcctcgggggagcgctgaccgccctgctcctggtcctgctggccgctgccatccgctccgggggatgatccggcgtcagagattgccgccggtcatccgccggatgaactgcccggcggcgatgccgttcagcagcttcgcctgatagagggtcctcacctcacgccggtgccagttgccctcgggccagtcgtcgagaaggcgctgcaattcgtcgacatccaggatgcgccgcgccagatcggaccggccgatcgcctccacctcctcccgcatctcgtcgcgggccgcggtcagccccacatgccagtcggctgcctgccgcgcggtccggtgggcgcccagaaccgccggcggcagcaggccggccagggcgttgcgggtcaggcgcctggtcaggccgtcgcgcagccagaccgagagcggcacgccccagcagaactcgatcacccggcgatccgccgtcggatcgcgggtggcgatgccatgcacggcttcgtcatagaacgagagtgcggcgtagatcggccggatggccagatcggcccgatagccgccatcctcctggacccgtcggtcgaaccagtcctcctgccagtcggcacgcggaatggcggcgcgcacctcttcccgcaccgggatcaccaggcggctcaggctgtcgatcatcgatcgctgtttaaggcgccgcagaaaaccgacacgcttcagccggcgccccagcccgaagcggtcgatcagcgcccgggtcagcgcatcggcctgcagacgatagcttccgtattcgatcttgacgccgtgggcctcgcgcagcgccgcgatcagccggccgcgcaggatcagatgtcccagctggtgcagaccgtcatagctgatggtggcattgccggcggcggcatgcagcagcacacccgccccccgcccggccgcatcccgggcgatggcatccagccagaccatatgcacgggattatggggtggccggtcggcccccagccggaagcggtcgaggccgtcgagcggcgagcggtgcccggcgcggatgaccacgtggtcgatattgggatggagcgccgccaccgcagccgcgccctcgctctcgtcgaacagcgcgccggacgccgcatcctcgggcgtgtaacccacggccggtgcggcggtataggccgtcagccgccggcccgatgcggcgagcctgcgggccgccacggcggtcaccgtcgaactgtcgaagcccgcgctcagatgagaggcgaccggcttcgtgctgcgcatccggtcggccaccgccgtttccagaacgctgcggaagctctcttcatagtcacgatccgaggccagggtgaagcgcttaacctggccgggccgccagtggcgatgcagacgcacgccgtcgcgatcggccaccagatgggtgccgcccggaaccgccctgaccccgcgatagatcgtctcggtcggatggatcggcagccgtccgcagatccggatcagattgtcctcgtccagatcccgcggcacatcgggatcggcgaacagtccggcaggcctggaggcgaagcgcatcacatggccgtcacggcgccagaccagcggccgtgcgccgatcgcgtcacagcccagcaccagccgccggtcctggtcatcccagaccgcgcaggcgaaatcgccatagagccgggcgaaagcacctgttccccaggcttcgaaggccttcaggaacagctggccgtcgggcatggccagggcatcgccctctggcagatccagctgccgggccagtgcctcacgcgcatccagccgcccgtcgaagaccgcaatcagccgccccgccccgccggtcatcggctggcggtcgatgcgatcctgaggcgtgaccacgaaaccacgccaggccagaaccgcctgccccgaccgccattcgccatcccggccggtcaccgccggcagcatggcccccagcccgtccagacgcagatcccgaggcagcgggtcggcaaagccgatgatcccgagaagagccgacatgtctccgccggctcaggccgggtcgccgacgggcaccagaaacccgccggcgatcgcacgatcgcagacttcactcacctcgctgcgacaggtttcggcatcgatctcgaaccggtcgaggagtgtcgataccgcctcccgggtcgaggccggcacggcaaaacacgcccagatcgccgaggcggtccggttcagccaccagatctccccgctcaccgggtgcatgatgaccttctcggaccccatgtcggtcgtcagcacgcctgatgcctggataagcctgtcctgcgaggcgaagaacctgttcaacgcaccaccagcaccgaaaacgctacagtatcaaatagggaagatcgaaccactaccgccctccggctcctcaattttcggaatcatcgcctcacgagcgttcagggtctcgatctcgggtttgatccaggcttcccggccggtatttcctgcgccgtcactggtacgcttcacagtcttgtccacgacgtagctcccgtcccgtgcgtatgatggaagcactatactttaaagaggttgagaaaatccaatacccgaaaagccgctccccttattcctctgccaggatgagaccaaggcgtgcaagcaccgtgatgacggtggcacggcgcgcctcgtcaagcccgcccggcacctccaccaccacctctcgggcggcaggatcggtgcagtacacctccgcccccggggcgatatcggcgagcgccgcccgcacccgatgcagggttgcgtcctgacgcaggcggaagcgcgcgatcttgcccagcggcgtcagcggcagatccggcaccacgaagacatggcgcggccgggccggcggttcggcgatcgcggcggccacgaaggcggcgacatcttcggcccggcaatcggctcccgcacgcggcatcacatagagcaccggcaattcgcccgcataatcgtcgggcatcgccaccgccgccgcctgggcgaccgccggatggcgatgggcgacctcttcgatcaggaccggatcgatattgtggccgctgcggatgatcacatccttggcccggccggtaatccgcagctcgcccgaaggcagtacgtcgcccagatcgcccgaggcgaaccagccgtcggcaggcgccccctcgacccccgcttcggtcagatagccctgaaagacattgggaccggcgacccggatctcgccgcctgcccccatctccacctgcatcagcggcaccggcgggcccacggcgtgatcgtggaaacggccatccaccggctgtaccgcgacgatgccgccggtctcggtcatgccgtagagctgcgagaccggccgcccgctcaccgcctccacccgcttcgccagttccggggccagcggcgagccgccggtcagaaggccgcgaagcgtggcgagggtggagctgccgcgcggcgcatcgacgatcgccgccagaatggtcggcacgctgccgatcaggctggtgcgggtctcgtcgacgatctcccagaaccggccgaccacggccgggttgcgcagggcggtggcggtcgggaagatcaccgtcgccccttcggacagcgccgccagcagcacatcgaccaggccgccgacatgaaacagcggcagcccggtcagcacccggtcgtcgggctggatgccgcttccggccgccaccatcagcgtcgccgccaccagattgcgcgacgacagctgcgccagttttggggcaccggtggtgccgccggtatggatgaaagcggcgacccggtcggcatcccccggcgccaccttcccggcaccctcgcccagcgccaggaaggcagcccagccgagcgcctcggtggtctcgggccccaccggcacttccacgaccgttgcaacaccgggcgcgtccgccaccgctgccgccacccgcgcccgcacatccagcgccggatgcggccccatggtcaccaccacccgcacccgggccagacgcagctgggcggcgatcgcctcggccgagagcagaaggttgaccggaaaggcgatgccggcggtggcggcggccagcaccgccgtcacgacctggggtacgaagggcagcaggatcgccaccccgtcatccggaccgatccccagccggcgcagcgccgccgccgcccggtggacatcggccagcagccggtcataggggaccgccaccgccggcgtgcccgcggcatctggcaggtattccagcgccggatgcgccggccgggccgccgcgacccggtcgagcagcgccagcggcgtgggtgtagcgtcgaggcgggccagcagtgccgccccacgccgatcggtttccggcatcatggccgtttctccctgtcgtcttgttttttgtgtgtgatcgatgcccggcggggctcaacccttcacgcggttatccaggtcacggatggctgcgcgggcctcctcgccctcggggatcggccggccgctgtcgcgccactggacggccgccttgaagccctcggcctgggcatagcggcggaaccacagcccttccgggttgtggcgggtgatgccgtcgaacacagtcgccatcatctggctctgttccagacccatggtcagcatcacctgattgaccaccatcttgtgcatggccagatggccgcgcggcacaccggcgatccgctccgccagcttccgggtcgcggcctccagctcggctgccggcaccacctcgttggccagcccccaggcagcggcggtgcggccgtcgatcacgtcgccggtgaacatcagctgcttggcgcgggtcggccccagccggtaggtccacatcgccgtggtcgggcaaccccagacgcgggtcggcatgtagccgatgcgggcatcctcggccatcaccagcaggtcgcagcagagcgcgatgtcgctgccgccggccaccgccgcgccatggaccttggcgatggtcggcttggaacagcgccagaggctcatgaaatcctcggtgttccgcttcatgtacgcgtagtcgaccatcggatcccagggatagctttcctgctggcaggggtgctccaccacctgttctgccgtatcggccaggtcatagccgccgcagaagcccttccccgcgccctcgaccacgatcacatggacctgatcattggcctcggcccaggcgaccgcctcgcggatgtcgcggggggtctggtcggtgatggcgttcagccgctcggggcggttcagcagcagccgcgcgatgcggggcgaggcgggatcctggtcgatccgcagggtggcgaaatcgggcatgggaggctccggtcggggggttgaaggcttcacagtcaatattgactgtatgactcgaccccacaaacagtcaatactgactgttgaagcgccacccacggtcgcaggttgcaatccgccgccgggcgtgcttgcaatcccccacctcgcttacacgctgccggagacgccgccagatgaccgatgcttccgctgcccggcccacgctccgcgaccagcagcgcgaccagacccggcagcgcctgctggatgcggcggtcacctcgctgatcgaacgcggcgtggcgcggaccacgacgctggaagtccagcgccgcgccggcgccagccgcggcgcgctgctgcatcatttcccgagccatgccgccctgctctcggccacgatcggcgagctggtccggcgcaatgacgccgcggtcgcccgcgcactggagcgtcacgagccgggcacgagcccggtcgcgcgcgcgatccgcagcctggtggagatgagcagccagccggccttcatggccgagctggaattatgggccgccgcccgcaccgatcccgatcttcaggccgcgatccgggccgcggagcgcgatgcccgcagtgatcgcgaacgggtggtctccgccctgttcgcgccggtcgccgaccggccgaattatgccgcggtggtggagatgaccatccagttcctgcgcggcctcgcggtttcgcgccagatctcgcgacggcccgaggccgagcgcgatctgatcgcccgctggatctgggcggcggagacgctgctctccgccccgccgcccgaaggctgagccgaccgacatcaggcggcgagcgtcgcatccagcgtgatcttcgccttcagcaccttggagaccgggcaaccggccttggccttggcggccagttcctcgaactttgcctgatcggcccccggcaccttggcggtgagcgagaggtgaaccgcggtgatctcgaaaccgtcggcgaccttttccagggtcaccttcgcctcggtcttcatctcctcggcggtgagccccgcctcgcccagaatcagcgacagcgccatggtgaaacagccggcatgggtcgccgccagcagttcttccggattggtgccggccttgtcctcgaaccgggccgcgaagccatagggataggcgttgagcgccccgctctcggtcgtgaccgagcccttgccgtccttgatgccgcccgaccaggcagccgatccgcgtcgcacgatcttcatctcgatgaccttccgtcagagtctgatgaaacggctcaaccggtgtgccccggcacgggttccgccctcatttcggccggggccgaaacatcagggcagagccgcgggctaggatctgcatgttacatccatctcaggagcccgggcaccccatgatcctcgtcgtcttcgaggccgttcccaccgaaatcggccgtcagacctatctcgaacatgccgccatgctcggcccgcgcctcgacggggtggatggcttcgtctcggtcgagcgctacgaaaacctcgcccgtcccggccatctgctgtcgctgtccacctggcaggacatggccgcggtcgatgcctggcggcgcgatgacggccatcgcatggcccaggcggtcggccgatccggcgtttttgccgactatcgcctcaggatcgcgaccacgctgcgcgactatggcctgaaccgccgtgcggaggccccggccgatgctctctgaaaccgatcccgccctggtgctggcggtcaccggcgccttcctgcttgccggcaccgtcaagggcgtggtgggcttcggcatgccgaccgtctcgctggcggtgctggccgggatcaccggcctgccggaagccatggccctgctgctggtgccgtctttcatcaccaaccttcagcaggcgctgaccggtggccatctgaggccgctgctccgccggctctggtcgctgctgctgatctcgatcccctgcatctggatgggggtggcgatcctggcggaaaccgacccggaccggctcgcccgcctgctcggggcggtggtgatgatctatggtgccgccggcctcgccggcctctccttccgcgcgccaccgcgggccgagccctggatctcaccgctcatcggcgcggtgaacggcctgctcaccggcctcaccgggtccttcgtggtgccgggcgtcgcctggctgcaggcgctggggctggaccgcaacgccctggtccaggcgatgggcctgctgtttgccgtctcgaccgcggccctggggctcgccctcggcggcaggtcgctgctcacgcccgaactcggcctcgcctcggccctggcggtgatcccggcagtggccggcatggcgctgggcgcccggctgcgccgccgcctgcccgaacgccatttccgccgggtgttcttcggggcgctgatcctgctgggcctgcgcctgctggcgggggcggctgaccgtccgggggcttggcatcccgcctgagcctgcgcatcatcacgctttatgacggcggacggacaggagcgaacacagatgacgccgaacatcgcctccggacagctggtcgccgaaatcgccgccgtgatcggcgacgtcgcccgcgccaatattctgaccgccctgatggatggccgggcactgaccgcgggcgagcttgccgcccatgccggcgtcaccccccagaccaccagcggccatctggcgaagctggccgatgccgggctgatcgcaggcgaacgccagggccgccaccgctatgtccgcctcgcttcccccgccgtcgccgaggtgatcgaggcgctgatggcggtcgccgccgccggccccgtgcgccatcggccggtcggcccgcgcgatctggcgctgcgggccgcccgcagctgctatgaccacatggccggcaggctgggtgtggggctcgccgaagcgctggacgcacagggtctggtcgcggttgccgacggatcgggggcggtgacggcccgcggccgcgacttcttccatgatcacagcatcgcgatcgacagcggccgcggcagccgcccgctctgccgcacctgcctggactggagcgagcgccgccaccatctggccggccggctgggagctgccctgttcacccatgcgctggaccagggctgggtgcggcgtgccgaaaccagccggaccctgaccgtcaccccgcccggacggatcgccttccaccaggtgttcggggtcgacgatgccatgctggtgccctgaggtgacgacgttgcccttcgacggcctgttccgatcgctcggccaggcggcggccatgggcctggataccctgcccggcgtggcggagggctggcgggtggccgcgatccgcggcctcgccgatcacctggccgaacgttttgccgccatcgcggcgccgctggtcttccagctgttcggaacccgccgcccgcccctgccggccgccgcgctgctgctcgaccggccaccggccggcacctcttccgctgcccatgacgccttcatcgccgggctgatggcgggtggctggcaggctgtgtgcgaccggcacccggtcctggcctcgcgtctggaccggatcgcggccgatggccgggcggcggcggccgatctgctttgcgccttcgccgccgaccgcgaccggctggtcccgctcacgggccccgctcccgacatcacgagcatcaccttcggcctgtcggaccctcatggtcatggccgcggcgtggcgcgggtcgggcttgccgacggccgggcgctcgccttcaaaccgcgcggccttgcgcccgaagccggcttcttcgccctgctcggctggcttgaagagcggatgaacgctggccagcgccgccgcctgccgccgcagcatcgcccggcggtgatcgattgcggcagccatggctggatggactgggtggagcgggccccctgtgcagacgaggcggaggtcgaggccttccaccgccgcctgggcgggctcgcagccgtgctcgacctgctcggcgccaatgacgtgcattccgacaatctgatcgcggccggcgccgcaccggtggtggtcgatctcgaatgcctgttcggcctgcccgcggcttcgcccgccctcgaccggctggaggctgcacccgccctgctcaccaccgggctgctgcccttcctggtgccgctgccggacggtacttggcgcaatatgggctgtctcggcccggtgctgccggcggcgaccgtgcccgacaatggctggtgccatatcggcaccgactggatccgccgcacaacggtggcagtgccggtagaagatccctgccgtcccgtcctcgacggccacgaggtggatgtcaccccctgggtcccggcgctggtcgacggccatgacgtggcgatggaggtgttgatcgcccgacgcgatgcgctgaccgcagcggacggccccctcgccttcaccggcgccctctgccgccatgtcgccctgccgaccgaaagctatcgccgcctgctggtgcgtctggccgaaccggatctggccgacgccccggaggcgcccgccgcccaggccgcccgcatcgcccaccggccgccacagccgggcatcaatgccggtctctggccaggcctgctggcggcagaggcgcgcgcgctcgcccgtctggacgtgcccgctttccgcttcgatccggccgatggccggctcaccgaggccgatgacagcccgatcggccggctcgacccacccccgcgggcccgcatcatcgcaaaggcccgcgcgctgtcggatggcgatcggcggcgcgcaggcggcatgctcggccaggtgctggcgccggtccggccggcagccgccgattgccagagcccggcggcgcatctcgtcgccaccgccctgccccgccgcgatggcggtctcgactggatccgcccccacgaacgcccgccgatcgcctggcggccggccggccacggcctctatcacggcagtcccggcattgcgctggcgctggcccaggccggccgtctggccgggcggtccgactggctggacgctgcacgggcggcccttctgccgctccgccgcttcatcgcagatcccggggcgggcaacgcccttgccgtcttcggtcccggctatgccgacgggctgggcggcatgatcgcaggcctggtctgggcggcggagctgctcgacgatccggcgctcatcgacgatgcttcccgcctcgcccgcaccgccgatcccgacgacatcaccgcatccctgccgttcgacctgcatgacgggctggccgggctgatcgtcgccctcgccttcctgcacagccgcgccccctcggccgcgctggcccgacggctgctgcgccaggccgatcgcctcaccgccatggccaccaccgatggcgacgccctgatctggcagccggcccgcggcccggtgctggcgggccttgcccatggccagtcgggcatggcggtggcgctggccgcggccggcgccgcaaccgatgcccctgccctgctcgatgccgcccggcgggcgctgacggccgaagatcggctgttcgatccggcccgcgccaactggccctccccggatcgcggtcgtcgccccgccaccgcctggtgccatggcgcggccggcattgcgctcgcccggctggccctgctcaaccttgcgcccgacatcttcgccgaccggcgcgcggagctggacatagccctcgccacgacggcgggcgccccctcctcgggcgccggggatctctgctgcggcgatgccggccgccggatcatcctcatccgggccggcaaaacggtccccgagcctctgtgcgggccgccggtgctctggagcgaggccccgccgctggccgcgccggatccctgcctgttcaagggcctggccgggctctgccatgcggacgccctcgcccatatcgggccgcagacctcctgctttctgctgccgttcggttgagccacggtacacggtcgtcgatatcggccacggccgaccatggcggaagccgccgacaggcgctagcgtcgggtccggatcagcacatcacaccggatacccgccatgagcagtgatttcgacaagctgaaggacatcatccagtcgaaccccgacctgctgggcggcggtggcgacatcggcgccgcctcgcgccggctggaagagattgcccgcgagaacgggctcgatctcgatgccgcggaaatcgagcgccagttccacagccgcgccgccgatggccggcctgacgatgagctggacgatcaggcgctcgatcaggtcgccggtgccggttcgccctattgcatcttcaccaagggctgctactgcatcttcactaaatgacctgaaaggcccgggacctgaaaggcccggcagtcaggccagatagcgggcctccatcaggtcgatctcgcgtaccagccggcgggccaggtcgtcatcgatctcgcgggcccgggcgatgcggaagatctccgcccgctcggccctcagccccgccagccgcagccggcgttcaatctcgtcggtgcggcggaacagatcggccgtggtggcatcagggctgtcggcatccagccggcggcggtacagctccatcacccgcgccgccacggcggcgtgcagatcggcatcggtacgccccgccgacatctcgtgctgggcgcgttccaccgccagaatcgccgctcgcgccgccgccgcccgaatgcggtcggcagtctggtccacctctgccagcgaatccggcgccagccccttcagcacccgcggcaggccaatcgcggccgcgaccagcgaggccagaatcaccccggccgccagaaagaccgcaagatcccgcgccggaaacgcggttctgtggtccagcatcagcggcagggtcaggatgccggccagggtgatggcaccgcgcacccccgccagcgtcatcgcccccaccagccggtggatggtgccgcgcgacagcggcggcccctcgtgccggcgcagcagggtcaggcgcagcgagacatagacccagagccagcgcagcgccgcgagccccactgtgatcgccagcacatagaccgccaaccaccaggcctcgcgatggccggtctcgcgtaccgccgtcacggcgcccgacaggatcgccggcagctgctcccccatcagcacgaagatcacgccgttgacggcgaaccgcaccgtatcccacacggcattgcgtcgtacccgggtgatcgcctgcacctgaccgcggatctcggcatgggacatggtgatcccggcggccaccgccgccaggatcggcgacacgcctaagcggtccgccaccagatatgcgccgaaggggatcaacaggctgatcagcacctcgatacccggctcctcgccggcatggcggctgatccgccccttgatccaggtggcacccagagtgatcagcacaccggtcgcaagcccgcccagcgccagctgtgcgaaggtcagcagggcatccgacatcgagaaactgccggtcagcagcgccgccaccgcgaagcgcaggcagaccaggcccgaggcgtcgttgagcagcgattcgccttccagcacatgcatcacccgcgccggcagcgggctgcgggcggcgatcgccgtcaccgcgatcggatcggtgggcgacagcacggccgccagcgcgaaggccacctccagcggcatggtcgggatcatccagtggatgaagaaccccatgcccagcacggtgaacaccaccagccccagcgccagctgcaggacggcaccatagtcacggaacagccccggcttggggatccgccagccatccagaaacagcagcggcggcaggaacagcagaaagaagacctcgggcgcaagcacgatacccagatcggccaccgcggcaatgccggcccccagcgcgatctgaaccagaggcaggggaaccggcaccggcaacagcctgaccacaaaaccgctcgccaccaccgccagcagcatcaccagcaccagggtgatcaatcccattgccgtcgcactccacgtccgcaggccacgaggccggcccgatatgcgaacgatagccgagccgcgcgggactgcggcagacgcagctcggcatggctgccgcgtcgcggccgcatggcaggaggcaaccgggaaaacggtcagaacggcaggccgacataattctcggcaagcgtggtcagggcggcttccgacgacagcagatattcaagctccgcccgccgcaacccggcatcgaaggtcgatgccgccggcccgaaatcatgcagcatcgcggtcatccaccacgaaaagcgctgcgccttccacacccgcgccaaggcccgggccgaataggcgccaagcgccgcttcacccccgccgccataccactcgaccagggcgcgggtcagataatgcacgtcgcccgccgccaggttcagccccttggcaccggtcggcggcacgatatgggcggcatcaccggccaggaacagccggccatggcgcagcggctcggccacgaagctgcgcatcggcgtgacgcccttttccagcacccgcccctcggtcagccgcgcgccgtccgcgtcccccagcctggcgcgcagctccgcccagattcgcgcatccggccaggcggcaggatcggtttcgggcgcgcattgcacgtaatgccgcacgatgctgggggagcgcatgctgtagagcgcgaagccgcgggcatggcgggcatagatcagctcgtccatcaccggcggcgcctcggccaggatgcccagccaggcaaagggatagatccgttcatgcgtggtgatcgccccctcgggcaggcattggcgcgtgacgccgtgaaagccgtcgcagccggcgatgacgtcacagtccagccgccggctccgcccttccgcatcccgccaggtgacgaagggggccgggccgtcgaagtcctgcggcgtcacctcctccgcttcgaaatgcagggcgccgggaacgtccagccgggcgcggatcaggtctttcaccacctcggtctggccatagaccgtcacatggcgcccgccggcgcggccggccagatccacatgcacccgccggccatccagcgagatatggatgccgccatgcaccagcccctcgcgatgcagccggtctgcgacgcctgcttcgtccagcagatccaccgtgccctgttccagcacgccggcccggatccgcccctcgcaataggcccgactgcgccgttccaggatcaccgaggcgatgccatggatgtggagcagctggccgagcagcagccccgccggcccggcaccgatgatcgcgacctgggtgcgctcacgcatcttccccctcccccgaaagcctgccatcggcatgtgaggcatccgcaatcacccggtcgatgaaccggttggccgatccgcggtcgtcgccatcgcctgcccgtgcctgcatcgccggcacatcgatctccagatcgtccagcagcccgcccgcatggttcagcgccgccgcggtcgccaccgccatggccggccagctctgccattccaccgtccaggcggcgccgtcgcgctcctcggcatggatcagcgcgccatgcagtgcgccgagccgccccgcgacctcgcgcgctgccgcaaccagcagctccgcccgcaccggattgcgcttgtgcggcatggccgaagatccgccggcgccgccgatccgcacctccgcgatctcgctccgtgccatgatcagcagatcggcgccgatcttgcccagcgcccccgccaccagcgacagccagcttccaagttcggcgaggccatcacgctgggcatggcccggcatcggcggcagggtcaggcccaggcgggcagcgaattccgcctccagacgcgccgccgcgtcgggatcgatgccagaaaggctgcccaccggcccgccaagcgtcgccaccagcagccgcggctggagttcggtcaggcgccggcgatgacggatcagcggcgccgcccatccggcgatcctcaggcccagcggcacgggcagggcgatctgcccccgcgtccgcccggccatcatcgtcgcccgatgcgcatccgcaagcgcggtcagccgtgccaccagctgcgccagccgccggtcgatcaccgccaggacctgcgcggcctgacgcatcatggcgctgtccagcacatcctggctggtggcgcccagatgcacgaagccggccacctcgcccgtcaccgcccgcctcagcctctgcaccatcgccgggaccggcacgccgtcccgcgccgtggccgccgccagcatctccggggcgatgtcgagcccgcgggcagcggcggcgatcgcagcggcggccgccgccggcaccagcccggctacttgtcccgcctcggccagcaccgcctccacctccagcatcgcgccgatcagtgtgcggtccgacagcagctccgtgacctcgccgtccgaccacagcccgccgaacagcaccgagcccgtgaacagccccgtttcgcgttcatgctcagacatcgaagaacaccgtctcgccatcgccctgcatgcggatgtcgaagccgtaggcaggcagccccggcgctaccagccgccgcgccaccagcgtctcccgccgcgcctccggcaccagggccagcacgggatcggccgccagcgccgcgatgtcctcggggaaatagatccgggtgaaggcgtggctcaacagcccgcgcatgaacaggatcaccgaaagatgcggcgcgccgccctcccccgccggcacgcccggccgcacggtctcgaaccgaaagcgccgctcgggatcaatgccggtgccgcagcggccgaagccgcggaagccgggcgtctccggccccgccacccggccgacggcatcgcattgccagatctccaccagggcatcctcgatcgccgccccggcgccatccagcacccggccggtgatcacgatccgctcacccgggcaggcctcgtcggcgatcaccgcatcggcgatctggccgcccttgtagccgtattgccgcgcggtcaggccataggcgaaaaagggacccacggtctgcgacggcgtctggatcaggctgttacgcatcgcctcaatcctccatcggcgtggccatcgcgccgcgcagcacgatgtcgaacatatagcccagggcgaattccggctgcgtgacgccgatatcgaaccgcgccaccagccggtcccgcgcccccgcatcggcggtcgcctggaagatcgggtccagcgccagcagcgggtcgcccgggaaatacatctgggtcaccagccggctggcgaagctccgcccgaacagcgacagatggatgtggttgggccgccaggcattcgggtggttgcgccagggataggcgccgggtttgacggtgatgaagctgtagcggccctcgtcatcggtcaccacccgtccggccccggtgaaattggggtcgagcggcgcatcatgggtatcggcgacatggacataacgcccggcggcattggcctgccagatctcgatcagcgtgcccggtaccggccgaccggcatcgtccagcacgcggccggtcaccacgatccgctcgcccagcggctcaccattcacccggccattgcgggtcaggtcgtggtcgagcggcccgatcgcatcctggccgaagaccggggccgtcgcctccatgatgccgtgcgggatcgggatcaggggtttcgacggcgcccgcagcagggtcgatttatagtcgggcgccagatagggcggctgggccgaccagtcgcggggggaaatctttccagtcacctgtcctgccctccctctccatcggcggaagaccccgccgtcatctcggccagcacccgtttggcgatggcaaaggcggtgttggccgccggcaccccggcatagaccgcgacatgcagcagcgcctcctgcacatccgcagcactggcgccggtattggccgtggcgcggacatgcatcgccatctcgtcgtgatggcccagcgccgcgagcagcgtaatggtcagcatcgaccgttcgcgcggggtcagatgcggccggctccacacctcgccccaggcgccgcgggtgatgaactcctgaaacggcgcatcgaaggccgacatgttgcggtgggcccggtcgacatgggcatcgcccagcacccggcggcgcatcgcatcgcccctggtgtcacgcagatctgacatggccggtctccttcatggggcgccagatcggcacaggctcgtgtaggatgatgcatggcggcgtgaagggagaggcgggtagatgatcgaccggcgcatcaagttccggcatctgacatgcttcctggaagtggcgcggctgcgcagcgtggtggccgcagccgacagtctggcgatcacccagccggcggtgtcgaaaacgctgcgcgagctggaagaggtgctggacgcccggctgttcgatcgcggccgccgcggcctgaccctcacccccttcggccgcctgttcctgaaccatgccggcacggcggtgacggccctcggcgacggcgtcgacgccatcgcccgcgcccggagcggcggcgggaccgagcttctgcgcatcggcgccctgccgaccgtcgcagcccaggtgatgccggcggcagtgcgccgcttcgcgaccggcggcgcccgggccaccgtgcgggtggtcgacgggcccaacaccctgctgctggcccagctcaggatcggcgaactcgatctggtggtcgggcgtctggccgaacccgaagccatgaccgggctcagtttcgagcatctctattccgaacgtgtcaccttcgccgtccgccccggccatcccctgctcgaccgtccggtccccgacccgcgggcggtggccggttatccgatgatcgtgccaccgcccggctcgatcatccggccggtggtggaccggttcctgatcgccgccggcatccgacggatcgacacggcgatcgaaaccgtctcgggcaccttcggccgcagctatgtccgccagtcggatgcggtctggatcatttcgcgcggcgtggtcgcccgcgacatcgccgagggccagctgcgcgaactgcgcctggataccggcgacaccagcggaccggtcgggctcaccactcgggccgaccagccgccgacaccggtgctgcgcctgttcatcgatgcggtccgcgatgtcgcggcggatctgagggcagcggatgcggaacaggaactggttcatctgctcaataccccagcaatcgcggcagggtcagcgtgatcgccggtaccgccaccagcagcgccacccgcaggatctcggcggcgaagaacggcatcacgccgcggaaggtctcgcgcatcggcacgtcgcgggcgaggccgttgatgatgaagacattcagcccgaccggcggcgtgatcagccccagctccaccaccaccagggcaatgatgccgaaccagaccttctgatcctcgggcgtcaggccgaaatcgagccccgccaccaccggccagaggaaggggatggcgagcaggatcatgctcagcgaatccatcagacagccgagcaggatcagcagaaccaggatcgcgaccaggatcagatatggatcgagcgtgctctgccggaccagcgccgcgccggcctgcggcaggcccgaccgggcgaggaagatctgcagcagggccgcgccgaacaggatcagatagatcatggcggtggagagcgccgtctccagcatcgccgccttcagccccgccgggcccagcccgccgcggccggcaaggcggaggccgatcccgtagagcccgaccagcaacgcgccaacggcggccgcgggtgtcgggttgaacaggcccatatagatgccgccgatcaccaccccgaagaccagcaccaccggggccaggcgcagcgtcaggcgcagtttttcgggccagggcacgggggtcgccgcggggcccagttccgggttcagcagcacctggatgcggatcaccgccagaaagaagaccaccgcgatcagcccgggcaccagggcggccccgaacatggtgacgatgttgctttccaccgtgaccgcatagatcaccagcacgaccgacggcgggatcaggatgccgagcgtgccaccggccgccagcgtgccggtggcaagcgccggggcgtagcccagccggcgaagttccggcagcgccacctgccccatggtcgatgcggtggcaagcgatgagccgcagaccgcgccgaagccggcgcaggcgccgatcgccgccatggcgacaccgccgcgcagccggccgatccaggcattcacccccgcaaacagatcccccgagagaccggaccggccggcgaactggcccatcaggatgaagaacggcaccacgctcaggtcgtagagcgagaactggtcgaaagccagggtctgcaactggcgaagcaggatggtctctcccgacagcaccaccgtgccgccggccccgaccagcgccatggccagcgcgatcggcaccctgagggcgatcatcacgaacatgatgaccatgccggcaatgccggtctcgatcggccccatggcgtcaatgtcctcccgcgccgccaggcgtagcggcctcgtcgtcgatgcccgccgccggccgcccgccggccaccatccagcccgccaccgcggcccagagggcaagcgacaccaggatcggcgggaaggcccaccagatcgggatctgcaggatcggcgtcacttccggatagtcggtgacgtaatagccaaggaagcccaggctcatccgccagagcagcagcagggcgaggccggccatcaggacatccaccacccggtcgagcccgcgctgcaccccgggtcgcagggcctgaatgaacaggtcgaccgagacatgggcgcgcatcagctgggcaaagggcaggaaggcgaagacggcgatcgcgcagcccagctgggtcagttcgaaatcaccggtgatcggccggcggatggcgaggtcgagcacgatgctcgtccccgtcaccgccatcaccgccaccagaaccacgccccccgccagcgcccagaggcgcgccgcccgttccggcagcggacgcccgcacgcgcctgatcgctcaccatgcctctcactgggcatgggccgcgacgcgttcgcgcgcccgggcaaccagggccgtaccgtcaatgcccttcgtggccgcatcctcgatccagcgggtttcgaccggtgcaagggccgtgcggaaggccgccagttcgtcgggcgtcagcttcgcgatatcgatgccgcgatcggtataggccttgcggccgacctcttccgcctccagccaggccttgccgatctcccgggcgaaatccgcgccggaattgcggtcgatcaccgccttcagatcgtcgggcaggccgtcatacttcgccttgttcatggcgaagatgaacaccgccgtaccgaagcgctcgccattggcgccctcgccggggccgcgggtcagctggtcgagcttcagagacggcaccacttcgaacggcaccatcaccccgtcgatgacccgcttggaaatcgccgccggcacatccggcaccggcatgccgatcggcgcgccgccgagcgcctccaccacccagccgccgacccggccggggatgcggatcttcctgccctgaacatcggcggggctgcgcaccggggcatcgaccatgttcagcgtctggccggcatgaacatggaccagcagcggcttgacggtcttgaactcgtccgcgaagtcgctcgccagcatgtcgcggatcgccagattggtcgcgaccggatcgttcagatgcacgaagggcagctcgaagacttcaagcttcgggaagcggccgggagtgtagccggccaccgtccagacgatgtcggcgatgccgtcctcggcctgctggaacagctggttgggcttgccgcccagcgacatcgacggatagatctcgaccgagatccggccgccggagtcctcttccacccgcttcgcccagggctcgatcagccgggtctgggccggggccatctggttcaggaaatggtgaacggtcagtttcacctggtcggccgccatcgccgatgccgagaccagcatcgccgaggccgccacagccaaccgcacgaagatgcgcatccgatatcccccctgaacgtcgcgtcgtccggcccggaggccggctgccggatcgttccggcgcgatcattgggtcaacgatggcagcgaagacaagtgtttcaaagtaagtttgcggcccctcgccataaccaaatggttatagaccggcccagcaagaggacagtctgtcacgaagccatacacggagaggtggagacagagcctgtacaacgggtgcctctggatccacacttttgcggagacggtcgataccgcatggatgggggaacgaggcatggcgagctgggcgctgatcctggtgccgggatactaccgaaagcccaagaacaccctgcgcgacgtgctggtcgcgaacctcaccctgtccgaaaccatgccgatgaccgagaccgcctcggataccgacaaggcgacgctcacggtcaccccttctgacaccaccggtctgcccgaaacgctcgatgtcttcgaggcatcatggtcggacctgatcccgacaccggccgaagaacggccgatcggccgcctgttccaggggctgtcgctgctgatctactggctcggctatccacggatgtggctggcgatcttccgctattccttctacatcgcggtcggttatctcgcatccgcggccatgctcgtgctctggctgatttcgctgatcgccatcgtcgcccaggcgaccggcgccgataccacgaccgcggttacttccgacggctccgacgccatggtctggctggggcagcatgtgcaggccgccgccgcctggctggtggcgaagctgccgccgacctgggccgcgaccctgaccatcctcatccccctgctgccggtcatgaccgtcgccgatctcgccgctttcacccgcgcctatctgcgcgatgccgcagccgatggcatcaccggcctgcgcgcccggttgcgcatgcgtgtgcaaaccagcctcgccaaggcgctcgccgccggcagctatgaccgggtgatcgtcgtcggccactccttcggctcactgatcgtcaccgacctgatcgccggctggtatagggccgtcgacctcgagaagatctcggtcgtcaccatcgggtcgcccggtgcggtgctcgccttccgttccgattggctggatcacgaaatcgccgccgccgtcgaacgccggcccggccatggctggactgacatccatgccgaccgcgacctgctctcggccggtctggtgccgatcgacagccccgccatagaggcgggagatgtcacccgattcgtcgtcgacctgcccggtagcctgatggaccggatcgacggcaccatccatttcacctatttccgcgacgagcgggtgctgcgcaccatcctcggccagggcgcagccccgggagcgcccgccctgccgcataccgtgggaaagcccgccttgccggcgccggcggtatgaggaccagggcggatgccgaccttcgaacgcagcctctggatcatgcccgcggtctatctcttccacatcgttgaggaatacggcgccggcttccctgcctggatgaccctgcatatgcaggccgatatgaacgacgtcggctttttgcgcaacaacgccctgttcatgacgattctggtcctgctctgtctgtgggcgacgtgcagtcgcacgcggctatccgctcttctgcttctcgcctggggaagcggccagctgttctggaacttcatttttcatctggtaacgacggtgattgcagacagctactctcccggtctggtcaccgccgccctgctctatcagccggtgtcgctggcggtggccgggctggccatccgcgaccatcgcctcaacctgcctgacaccctcttggccttcaccatcggcgcaggcctgatgttgttcgtcatctggacagggctctggcacttcaccctgccggtgggctgacctcggctgatgtcacattcgctcgatgacggaaacggccatcactgtgatcaaggaagatcgcgggggccccgccacaatgacatccggcccccgctgacccccgtgttcttttagggatgccgtcgccctgccctgcctggccgcggagagagaaaggcgccgccccgaacgcagcaacgccgcccgcggcgagaggccggggcggcgtttgcttgaaacttggttgcgggggcaggatttgaacctgcgaccttcaggttatgagcctgacgagctaccgggctgctccaccccgcgtcagggcgtaggcggttggcagtgtggattgagatgagatcgcgctttgttgtggtgagcgttgtctgtccatccatgcggttacaagacctggcagcgacctactctcccgcgtcttaagacgaagtaccatcggcgcaggacggtttcacggccgagttcgggatgggatcgggtggttcacgtccgccatagccaccaggtcatgaaaccgcacggagggacagtccggaagttgtgcttccggaagctctgagcgcgagatcgtctgatttgatgatgtgtgtgcaagcttcgtgggccgcgggcccggttctgggcgcggcggggatctttcgagccgatcgagcgattagtaccggtcagctcagcgcattgctgcgcttacacacccggcctatcgacgtggtggtcttccacggctctcaagggagacctggttttgagggaggtttcccgcttagatgctttcagcggttatcccttccggacatagctacccagcgatgcgactggcgtcacaactggtgcaccagaggtccgtccatcccggtcctctcgtactgaggacagatcctctcaagtctcctacacccacggcagatagggaccgaactgtctcacgacgttctaaacccagctcacgtaccactttaatcggcgaacagccgaacccttgggacctgctccagccccaggatgtgatgagccgacatcgaggtgccaaacaaccccgtcgatatggactcttgggggttatcagcctgttatccccggcgtaccttttatccgttgagcgatggcccttccactcgggaccaccggatcactatggccgactttcgtctctgctcgacttgtcagtctcgcagtcaggcgggcttatgccattgcactcgacaaccgatttccgaccggtttgagcccaccatcgcgcgcctccgttactctttgggaggcgaccgccccagtcaaactacccgccatgcagggtcccggctccggatcacggagcgcggttagacaccaagaaccaaaagggtggtatttcaaggttgcctccacctcggctggcgccgcggcttcataggctcccacctatcctacacattcagtccctagtgccactgcaaagctgtagtaaaggtgcacggggtctttccgtctgaccgcgggaactccgcatcttcacggagaattcaatttcgctgagtcgatactggagacagtggggaagtcgttacgccattcgtgcgggtcggaacttacccgacaaggaatttcgctaccttaggaccgttatagttacggccgccgtttaccggggcttcgattcagagcgtgaacccctcctcttaaccttccggcaccgggcaggcgtcagaccctatacgtcgccttgcggcttcgcagagccctgtgtttttagtaaacagtcgccaccccctggtctgtgccccccgcccctggttgcccaggaacggggcccccttctcccgaagttacgggggtaatttgccgagttccttcagtatcgttctctcaagcgccttggtatactctaccagcccacctgtgtcggtttcgggtacggtctgtacgtgggagttatttcctggaacaacttcgctgccgggaacaatccaataagccccgacaacttacatcatccgtcacttcccacaggtgcaggaatattaacctgcttcccatcgactacggctttcgccctcgtcttaggggccgactcaccctgcgcggattagccttgcgcaggaacccttgggctttcggcgacagagtttctcactctgtttgtcgctactcatgtcagcattctcacttccgatacctccaggcgccctcacgggtcacccttcacaggcctacggaacgctccgctaccacgcaccatacggtgcatccacagcttcggtgtacggctttagccccgttacatcttcggcgcgggacagcttatctagaccagtgagctgttacgctttctttaaaggatggctgcttctaagccaacctcctggttgtcatggccgtcctacatcctttcccacttagccgcaacttggggaccttagctggtggtctgggctgtttccctctcgactacggaccttagcacccgcagtctgtctgccacgctgtactccctggtattcggagtttggttaggtttggtaagccggtgaggccccctagcccatccagtgctctacccccaggggtaatcacgtgacgcactacctaaatagttttcgcggagaaccagctatatccgagtttgattggcctttcacccctagccacaggtcatccccgtctttttcaacagacgtgggttcggtcctccagtgcgtgttaccgcaccttcaacctgcccatggctagatcacccggtttcgggtctacttcatccaactcaaacgccctgttcagactcgctttcgctgcgcctacacctatcggcttaagcttgctggataaagtaactcgctgacccattatgcaaaaggtacgccgtcaggcttgcgccctccgactgcttgtaggcatccggtttcaggaactgtttcactcccctcgtcggggtgcttttcacctttccctcacggtactggttcactatcggtcgtcagggagtacttaggcttggagggtggtccccccatcttcgaacaggatttcacgtgtcccgctctactcaaggatccagtgcgcaactctccatacggggctatcacccgctctggccggcctttccatgccgttctgatcgtcgcacaaaggaccactggcctgatccgctttcgctcgccactacttacggagtctccgttgatgtcctttcctccggctacttagatgtttcagttcaccgggttcgcctctcctggctatgtattcaccagaagataccgccgaagcggtgggttgccccattcggaaatccatggatcaaagcttactcgcagctccccacggcttatcgcagcgtgtcacgtccttcatcgcctcctgacgccaaggcatccaccagatgcccttctcttgctcgagagatccgccgccacgtccagaaccggacccgcgatccgtttgcactcctgcaaaccggcgcggtcatccttcgaggttccgacgcgcggccactcagctcgcatacatcagacgatctcatctcttcacactgtcaaagaacatcgccggtgatccaaaaggatcccggttcacggatcggaaacccgatcccggcatcccgttccgaagaacagggccgaaaccttctcgcttcctgcatcgaaccaacgtcaagggcccgtctcaaggacaggtgcctccaggacaagcaaggcagatggtgggcccgggtggactcgaaccaccgacctcacgcttatcaggcgtgtgctctaaccacctgagctacaggcccgcttgactgcgttcgatgcggaagggatgcggggacggcgggcgtcttccttagaaaggaggtgatccagccacaggttcccctacggctaccttgttacgacttcaccccagtcgctgaccttaccgtggacggctgcctcccttgcgggtcagctcaccggcttcgggtaaaaccaactcccatggtgtgacgggcggtgtgtacaaggcccgggaacgtattcaccgcggcatgctgttccgcgattactagcgattccgacttcatgcactcgagttgcagagtacaatccgaactgagacgactttttgagattagcttcacctcgcgatgtcgctgcccactgtagtcgccattgtagcacgtgtgtagcccagcccataagggccatgaggacttgacgtcatccccaccttcctccggcttatcaccggcagtttccctagagtgcccagccgaactgatggcaactaaggatgagggttgcgctcgttgcgggacttaacccaacatctcacgacacgagctgacgacagccatgcagcacctgtgtgacgtccggccgaaccgaaaaccccgtctccagggtcgcgacgtccatgtcaagggctggtaaggttctgcgcgttgcttcgaattaaaccacatgctccaccgcttgtgcgggcccccgtcaattcctttgagttttaaccttgcggccgtactccccaggcggagtgcttaacgcgttagctacgacactgcgatactaagtatcccaacgtccagcactcatcgtttacggcgtggactaccagggtatctaatcctgtttgctccccacgctttcgtgcctcagcgtcagtttcgggccaggcagccgccttcgccaccggtgttcttcccaatatctacgaatttcacctctacactgggaattccactaccctctcccgaactccagcctaccagtctcaaaagcagttccggagttgagccccgggctttcacttctgacttgataagccgcctacgcacgctttacgcccagtaaatccgaacaacgctagcccccttcgtattaccgcggctgctggcacgaagttagccggggcttcttctacgggtaccgtcattatcttccccgtcgaaagagctttacaatccgaagaccttcatcactcacgcggcattgctggatcaggctttcgcccattgtccaatattccccactgctgcctcccgtaggagtctgggccgtgtctcagtcccagtgtggctgatcatcctctcagaccagctaccgatcgtcgccttggtaggccgttaccccaccaactagctaatcggacgcgggctcatccatctacggccgaagcctttcccccgaagggcgtatgcggtattagctgcagtttcccgcagttattccccatagatgggcagattcccacgtgttactcacccgtgcgccacgtaagccggaaccgaagtcccgaccccgttcgacttgcatgtgttaggcatgccgccagcgttcgttctgagccaggatcaaactctcaagttgaaccttcgctgcgtgatcgctcacacaacaaggcttcaaccgaaaatcgtcccggcatctctctaggcacaaggtcatatcgagatgccaaggcgctcatcggtcagtcgttcttaaagtcctaagatcgacgaccgccgccctcgcatcccttccgatccgtttcacaatgtcaaagatcctgacgaagcgttcccgccccgcggcaccctcgggcacctgcccctcttaagggcctgcctcgtttaagaggctgtattctctggcttttcagccccgcccggcgccgcgtcctccgcggtgcccgtcggtgtggggcggtttataagggcccaagccaaccctggcaacaccttttttgacggttttttcggacatccgtccggcgaccgcacaacccattgggactccgtgaagaatcgcctcaggattttttcgggacgcaaccaccgttccggtacgagcggccttcatgcccccgtaccggcccgtccgcctgcatcggcggatccccggttccggcaccttgcaccagcgcccggtcatgcccatcctacatggttaaggaaatgctgcgatcaagccctcgctctaccagtggaggccgatcgtggcggcgatgcggaaccaatccgtgcgccatcccgccgttttccgcgcggggacaccgatgcaggagcaggggccagcggccccggcgcccggcatcgcaggaggaacgtcacggccggcgggtccgttcaacggacagaccgtccccctttctgcccggggacggccagcttggaggagatcgggcgcatgctcgtcgaacacatcctgcggcgcaaaggccgccgcatcgccatcgtcgatcccgaagccaccatttcccgcgccctcgaaatcctggcccaggacaatatcggcgccctgccggtggtccgcgacggccgtatcgtcggcatgctgtcggagcgcgacgtcgcccgcggcctggtcgaccggggcgccgccctgctcgacaccccggtcaccgagctgatgaccacccggctgaccacctgccggcccgagaccacgatcgaagaactgatgaccatgatgaccatgcgccgcatccgccatgtgccggtgctgggcgaggatggcgacctgaccggcatgatcagcatcggcgacgtggtgaaatgccgcctggacgagctggagaccgaagcccaggcgctgcgcgactacgtggccggcgttcaatgaccggctctccccggccctgaccggccgtcagccggcctctgcggccagccgatccagcgccacgccgtcgatcatctgcaacatcccgcccgtcgcctcgaagcccatccgggcatagaagcggcgggcgcgatcgttttcggcctggacatgcagctccagccggtcggcgccgagcgcagtcgcatggcctgcgacatgagcgatcagccgccgggcgaccgccccgccccgggcggccggcacgacgtagagattgtcgagcagcagatagtcccgcgcccgaaagctggaatagaccgggaaccagctggcgaagcccagcgcccggccggccgcatcttcggccagcgccgcccgaaagcgcggcgtcggaccgaaaccgtgcgcggccaccagcgcctcggttgcacggaaccggtggccggcgccgtcctcgaccgcaagatcgcgcagcagcgcccagagccgcccggcatccgccgccacggccgcccggatcacgatcgcgtcgccatcaccagatccggtcatcctgccctcttcaacgctcccaccctcttcacatcttcgggcaccagcccggtcgacagcgaccaggcgtcgacatcattggcgccttcggtcgcgatcaccagcacccgcgccgcaggcccgagcccgagcgccgcctgaagccccggatccgccaccgcctggaacagacccgcgagccccgcggcaccgctttcgcccaccaccagggcaggatcacccgcaaccggccgggcgagccggttcaccgccgcccgtgccgccgtatcgggcaccgccatgaaatcgcgggcgaggcgcgagaggatacgccagccggtcgccgaaggctcgcggcattcaagcagcgccatcaccgtcggggcatggctcgccagctgcagccgccgaccggcacgcgcactttccagcaggcaggcggcaccatcgggttcaaccaccaccagccggggccggtccggtccggccatagtcagatgcgccgcaaccgcggccgccatgccgccgacccctgcttgcaggaagagatgggtgggcatccggtcgccgcactggcgcaggatctcggccgccatcacggtatagccctgcatcaccagggtcgggatccgttcctgccccggcagggccatgtccgagacgttgatccagccttcggctgcgcagctccgggcgaccgcggccaggctgtcgtcataatcgcccgccacccgcacgatccgggccccctcggcccggatggcatcggcgcgcacctcgcgcacgccctgatgcaggaagaccacggcccgcgcgcccaccagccgcgccccggcagcgaccgaccggccgtgattgccgtcggtggcgcaggccatggtgagggtgcgggtgaccgcgagaaggtcaggcgtgccgagatcttccggtccgaagcggcgccccgtccgccggccggcctcgtccagcgccagacggatcgcggcatgggcgccgccgagcgccttgaagctgccgagcccgtggcggccgctttcatccttcaccagcagcgccccaaggcccgaggccgcggcgagccccggcagttcgaccagcggtgtcggcccctcgccatgggtgacggcgaacagggcttcggccgcggcagcggccccggcgccgaaggcggtcgcatcggcaggatcgagcgcgccgccggcatcggcgagcatgttgggcagatacatggtccatcccctggctgctgtgagaggatggaagaatattgcgtgtcgtcagagaaaggcgctttgatcccggggtgtcgacgcaagtttttctcgcccggaggccgccggatgacgatcggatccaaccgcgccgaactcgacggcttcgatctggcgatcctggctctgcttcagcaggatgcgcgcctgccgcagcggcggatcgccgaggcggtggcgctgtcgacgccggcggtgcagcggcggatccggcggctggaagagatcggcgtgatcctggccaatgccgcgatcgtcgatccggcccggctcggccggccgattaccatcctggtgctggtggaggtggaaagcgaacaggcggccccgctggacgcgacccgcgccgcctttgccgccgcccccgaggtccagcaatgctattacgtcaccggcgaggccgatttcgtgctggtggtgacggtgcccgacatgggtgcctatcaggcgctgacccgcaggctgttcctggacgaccccaatgtccgccgcttccggaccttcgtcgccatggaacgggtgaaggtcggactggcggtgccggtagaggatgcgctcagcgggaaggcgcgaagggattgacgccggtcgcggccagcaccgcccaggcagtggcgcccagatgcggccagcggtggtagcggaaatcatcgatcacgctgtcgggaccgatggcgagcccggtggtgatcgacggcttgcgcgtcgcccagagccagcccccgggcgagacctcgcccagcaccagatcgagcagacgctgcgcctcgcccgtctgccccagatggccggcgaccagggccgcctgggcggtgccctcgatccagaccccgtcgcggtcgtcgttgaaatcgaagccgccatcgacgccatgagcatcgcccgcccaggcccaggcgctccgccaggccacgggcgccccctgcaacagcagtggccagagctgggcatccagccccgaggtcgcggtgttgagcgtggccccgtcgggcagggtgccggtcgggaaatggtcgctgcccgcctgccacatccggtcgaggaaccggcgcgcccgatctgccgccgcgccccagcgggccgtgttgggatcggcagtcttcaggcgcgtgaacagcgccaccagatcggcatgatgttcggtcgatttccagccgatccggcgcagccccgcccctgccccatccaccccgccggtatagccgccggggccggcgtcgtcggcggtctggtcgatcacccagcccccgatccggcgggcggcgtccagagcctgtcggcgcagatcggccgaaaaggctgcatccgcgcgacgctccaccaccgccagcagcgcaagaccgacccaggcggcatttccggtggcggtgccggtctgatagggatcctccacccagcggccggcggccgcatcccaccagccattgggcggcggcgggctttcggtctgggcgccggcgcgataggcattgcgcacacggccgcgatcggcagccgcctggcgcggatcctccgacagcacggcatcggcgaaagcggtggcgatcctggccgcggcatcgctgcggccgcaggcgatcaacgcccggagcgccagggcgttgtcataggcgaaggcggcaccggcaagcgccgggtccggatgcgggcccgaccccgccggggcgtcccagctgcgcaggaaaaccggcccggcgccgtcgatcgcatccacccgcccggccatggcctgacagagcggcaccacgccctggggcagaaccggcgccgcggccggggcccgcatgatgccgagcgcggtgagcgccgccaccaggacaggaagggtcgggcgtcgaagaggggtcgggcgtcggggcatcagagatcggcgatccggaacggccggatctcgaaactctgccatacgccctgaacggtataggggtcggcggccagggcggcatccagcgccgcccggtcgggatattcggccagcatggacgaaccgatcatggtgccggcctcgtccagcatcgcgccgccgatgatcagatggccgtcggccttcatcttgcgcgcattctccagatgggccgggcgcgccgccgcacggcgagccggcgcttcggcatcggtaccgtcgcgggcgatgaccaggaactgcatgggcgtctccttatccatcgtctcggccggtctctgccggcctgccgtgtggtctctccgttcaggcctcgcggccgagcagcgtcatcagctcgcgccattcgcgcggactcatgccggtctcctcgcgcgccggcgtctcgccggccagcatgcgccggacaacatgcagggcgctgcgcgacaggtgtgcgccgcccagccggtattcctcgaaggcggcggcgaccagcggcacccagcgatgggtgatgtccatcatggtctcggcataggcgcggatttcgtactgggcatgcggatcggcacgcagcgacagaaaatgcagcaggttgtgcagatcggtcttccagtaccattgcgtgtagtagttcagggtcaggttcatccgcgccagttcgcgcgccaggcggtcgcgggtcggatcctcggcctcgccctcgtcggtctcgttcagcatccagcgataattgtcgtacacccgccgggcatcgtcgcgcaggatgtccatcacccggccggcctgatcggccggcagcagcgcctcgcggccctgacggttgctggtcgactgcgcagccacctggtcggccgccggcacatagaactcccggtccaggatggaatagcgcgccgagtactcgttgacattggcggtgcggtggcggatccactgccgggccacgaagatcggcagcttcacatgcagcttgatctcgcacatctcgaacggcgtggtatgcctgtggcgcatcagataattgatcagcccgcggtcctcgttgaccttgcgggtgccgcggccatacgagacccgcgccgcctgaaccaccgccgcatcgtcgcccatatagtcgaccacgcgcacgaaaccgtggtcgagcaccggaaaggccgtgtgcagcacgctttccatgccggtcgagaccgtgcgcagggtgggcaccgcctcggcgcgcagggcgtcgatttcggcctgctgctcgggggttacggtcatcgcgtcggtctccttccggcgtggatctggtcgcccctggatacaggggccgccccccgcaggcaagggcgcggcgtgcccctgcatcgcatggccgcagcttgggctttgcatgtcacggccgagcgcctatatatggggtgccggtcgcaaggccggctatggcgatacagggcctcacggaataaacgtatcggacccgggggcagtgcccggcgcctccaccagttcagatcaccggccttcgggccggtgctccatgggggcgagccaggatcgacgtgcgtggtaaaggtttggtcttcgcccggcatgataccgccgttatcgggtcactcaaacaggtgcgaacgacaaccgtgtcgccctcgctgcctaactaggcaagcgcggtccggggggcaccgggcaacagaagccccccactctatcaccggctgcagccggtccggatgccgtgtcgcgggatgcggggtccgccgttgcagccgacctcggcccttcttgaccagccgacgatcatcttcaaccgacgatcatcgagaccggacgccgcatgccgcagatcgcctacgaccagctcatcgacaccgctctgcgtggggtggtccgcaccgttctcgaacaggctgccgaaagcggcctgaccgacggccatcatttctacctgaccttccgcacccaggcgccgggcgtcgaggtgccggaatatcttcgcgcccgctacccggaagagatgaccatcgtgctggagcacgagttctggggcctggacgtgaaccagcacggttttgcggtgacgctggccttcggtggccgccatgagcgcctggtcgtgcccttcgtcgccatcaccggcttcgccgatccgagcgtcaaattcggccttcagttccacgccatcgacgaggcagacgacctcttcgacgacgaggatgaagaggtcgacgaggagatgttcgagatcgaagaccggctgtccgagggccaggacaacggccgcgcggcgccgacccccgaggccgaggccggcgacaacgtcgtggcgctcgaccggttccgcaagcgctgacccccgatggcggaggcaacgaccgccgatggtgccgccggcctgccggcggccgcccgccgtgtggccgcagcgcttgaagcggccggccacccggccgtgatccgcattttccccgacagcacccgatccgccgccgaggcagccgccgccgtcggctgccggacggaagagatcgtcaaatcgctgatcttccggcgcagcaacgacgatgccgcggtgttggtgctgatcggtggggccgatcgggtcgataccgcaaagctcgcccgggtcgtgggggcgaagaccggccgggcggatgcggatttcgtgcgcaggaccaccggctatgccatcggcggcgtgccaccactcggccatgcgacaccgcccgtggttgtgatggacgaagggctgatggcgctgtccaccgcctgggcggccgccggcaccccgcatgcggtgttcgagaccacgccggccgatctggcccggatcaccggtgccgtggtcgcagccgtggccgccacgcctgcagcctgaccggccggccatggccgctccgctcccgcccacccccctggacgacgatcccccgcaggacctgatgctgccgccccttgaggcggcggtcgagaaacgctcggtctccatccagggccaccgcaccagcgtgtcgctggaagcgccgttctggcgggtgctgaagcgggcggcacgcgcgcgcggcatctctctgggcgcgctggtggccgcgatcgatgccgcccggcgggtggaccgggtcaacctgtcgagcgcgctccggctcttcgccctggcagaggcggaaaaccgggcggtcacccgcctgtccgaccccgcacccgcggcgcaaagcccctcggaagacgcctcagacgcgctgtgacacccccggcgcttgcgccgcagcatccgcgtggtatatctctgggccggggatgagagccaacggcccgtccgtgaccacattcccgaattttggcggggcgtagcgcagcctggtagcgcatctgctttgggagcagagggtcgcgtgttcgaatcacgccgccccgaccatatctatcctgtccggccgcgccggccatcaggcccgcggctgaaaccgggaccaccagaatcggcccgccggcccgagcgaccggcatcaaggccggtcgacaaggatcgtgtgaggcgatggacgcgcgcatttacctgccggcgaagaacgccatgcagtccggccgcgccaacacccgcaaatgggtgctggagatggaacccgctgcggcgaagcgcctggaccccctgatgggctggaccggatctgccgacaccgaccagcaggtcgtgctgcggttcgagaccctggacgaggccgtggccttcgccaagcgcaagggcctgacctatgaggtctacgagccacatatgcgcgacctgaagattcaggcctatgccgacaagttccgctgggaccgcgtgcgctgaacagcgttccggcctgacgggtgcccttagctcagttggatagagcatcggccttctaagccggcggtcgcaggttcgaatcctgcagggcacgccagtcttccacgccgcagtccggtccgccgggctgcggcgtgtcgtttcgggggcgtggccggccggtgcccgtcttcttactgagacaccgtgttcttgctgagacatggggctgccggaggtggcggcagggcgcccgctcgatcatgctgaggggcagaccctgcagtccggaaaccggaggacgtgatgcccctgaacgcccgcaaggcggtgccggccgccctggccgccatgcttgccgtcgccaccgccgccctgcccgcccgcgccgacggcaccttccccaccagcctcgccaccgaagatcagcagcggctggaggccttcgacaccgcccgcgccgaggcggtcgccgaggcgcgcgccggtgggtcgcccgaggatgtgtcggtgctggacgaggtgctgagcggcgagccgaccacgatggaaccggccgagatggccgggatctggcgctgccggacgatcaagctgggcgggctgttgccgctcaccatctatcgcgacttcaagtgccggatcaccgatgacggcggcgggctgcggctcgaaaagctgaccggctcgcagcggaccggcggcaccttctatgacttggccgacgagacccggctgggctatgctggtgccggctgggtggcgggcgaggcccccatgcagtacggtagcgatcccgagcgcaaccaggtcggctatctggtggtgctcggccccgagcgcatgcggctggaactgccgctgccgcagttcgagtccaagttcgacattctggaactcaggcgctgacgggacttcaggcgctgagttgccggggccggccacgatccatcagcagcgccgaaatcgcccggcgcaccggtgcggccccgcggcccagatccatcaccgcccgccgggcgaggcgtgcggcggggtcgtcgcgggtgtagagcccgacgatggcattggtcgcagcccagagcggggccgcggtcagcttatggccggcttcgtagcgatgcagcatcaagggtgacgtgatatcgccatcggtgcgggcggcgcggatgatgccgtctgccaggcggtcggcgctcttcaggcccagattgaagccatgggcggtgaccggatgcatgccgaccgcggcatcgccgatcagcgcgaagcgatggccgacgaagcggcgggcctggacggcgaccagcggccagccatggcgggtactctcaagctgcatccggccgaggcggccatcgagccggaccatgatctcatccgcgaaggccgcggggtcgagcgccgtcagccgcgcgatctcggcatggggcagcgtcagcaccaccgaggagcggcggcccttgagcggcagcaacgccaccgtctggccgtgaccgaaccattcggtcgccacaccgccatgatcgacctgatcgtggctcatccggcagaccagcatcgtcttgccgaaatccacctgatccgcggcaatgccgcgggcctcgcgcatcttcgagaaccgggtatcggccgcgaccaccaggcgggcggtcagctcgcggccatcctccagatcgaccgccatgccatgcgggcgcacccggatgccggtcgccttcagaccgtccaggatcgtcgcggaggtctgctcgcgcaccgcgtcatgaagcgcccgccggatcaggtgattgggcaccagacggcccagcgggcggccatcggcggcgccgtcgaagatcaggctgcgatggccggccccgttcagcacccgggcggcgcggaggggggcggtctctccggccgggatccgcgcccaggcgcccagccgctccagcaccgccatggaatgatgggtgagcgcgatctcgcggccgtcgaaaggcgggtcggccagcacggctgccggctgcggatcgatcagggtaacgtcgagcccggtgccgtccagcgcccgcgcgaaggcaagccctgccgggcccgcgccgatcaccgccacatccgtctgcatgcgcccctcctccgtgacaccggccgccgaggccgggacggcctcgcgggcgacaggctagcagcgggcgcggtgcggtgctatgcggcgttgtgtccggtggcggcaccctttgtcctggcgtccgcttcggcctccgcctccgcttcggcgagccgggcatagcggcgggccagcacggcgcagaccatcagctggatctggtggaacagcatcagcggcatcaggatggcgccggtatcgcggccggcgaagatcacattggccatgggcacgcccgaagcgagggtcttcttcgagccgcagaacacgatggtgatccggtcggcccgcgagaagccgagccagcgcgagcccagcatggtgatcgccagcaccagggccagcagcaggcagtcgaccaccagcatcaccgccagatccagcgcgcccacccggttccagaagcccgagaccaccgcgcccgaaaaggcgagataaacgaccagcacgatggaaccgcgatcgaccagccccagcggcttgcggtgccggcgcagccagtcgccgatccagcgttccagcacctggccggcgatgaacggcaccagcagctggaagacgatcgcctccacctgatccagcgacaccccctggccgctggcgccgaacagcagcgccaccatggccggggtgatgaacatgccgaggatgttcgaggccgaggccgagcataccgccgccgggacattgccaccggcgatggcggtgaaggcgatcgaggactgaacggtggagggcagcacgcagaggaacagcagccccatcgcgatcgccggcgacagcacgctttccggcagcagatgggtgatggcaaggcccagcaccgggaagatcacgaaggtcgtggccagcaccgcgatatgcaggcgccagttggtcatgccctcgatcacggttgcgcgggacaaccggccgccatggaggaagaacaccgtcgcgatggcgacggtcgcgacgtcgtgcaggatctccgatgcccggccgtccacgggcaggagcgaggcggtggcgaccgccaggatcagcgccagcacgaaacggtctggtagaatgcgcgacaacagagccatggccgtcctccctttttgttgttctgcgccatcgcggttcaggatggaaggaataacaggcatcatgtttcacgatgaccggatccccatccccgagaggccgagccgatgctcgatcccgttcagctgcgcagtttcatggccgtggccgaggccggcagttttacggccgccgcccgcgggctggggctcggccagtcgaccgtcagccagcatgtcgcccggctggaagcggcggccggccggcggctcatcgatcgcgacacccatcatctgtcgctgacgacggatggcgaagccatgctcggcttcgcccgcgccatgctggcggtcgaagatcgcgcccgggcgcatttcgccgcccgtgaactccatggccggctgcgcttcggcgcctcggaagacttcgtcaccagccggctcggccgggtgctggaaagcttcgtgcgcgaccacccggccatcgatctggaaatcaccgtcgcgctctcgggcacgctgcaccgcatgctggatgatggcctgctggatctggtgctggccaagcggcgtctgggccgcccccgcggccggccggtgcaccgcgagccgctgatctgggcggcgcgcagcccggacatcgccgatccggcccggccgctgccgctgatcgcctttccgccccccagcattacccgggcagcggcgatcgacgcgctcgaccgtgccggccgggcctggcggatcgtctgcacctcgggcagcctgagcgggctcaaggccgcggccgatgccgggctgggcgtgatggtccagccccgcagcatgcgtccccagggcctggtggaaatcggccccggccccggcctgccggcgctggaagaggtggagttcatcatcgaggacgtctcggtccgccgcccgcccgacagccccgaagcccgcgccgcccggatcctgaccgaggcgctggtggtgggggggatctggcgcagcccctagcggctagggagagatcaccgccatgccgagcgcgcgacctgccgccgccatgcgccggtccagagtgcacatcaccagatcatggcggctggccaccgccagatgaagcgcatccccggcacgcaggccgagagcatggtgtctggcatatcttgcggccttcagaaaatcctccgccgcgatctggagaacggatattccatcatcaagcatggttgcgaaggtgctctcgacatcttcgccagtcgacgggctgatctgcgctgtccggatcttgagcgacagtgcggatgcaaattccgtgatcgtccagcgactgatccagagcccctgagattgatagttttccagccacagaatcacgcgctcagtggctgtctcacgagtcagccccgagacaagaatggaggtgtccaggtaatacattcagaagcgatcttcgtcccgcatccgccggacgaaatcacccgcctcctccggctgcagcggcatgcgcgcggtcaacgccctcaaccggttcagatcgatgcccttgcccggcctgcgcccacgcccctcgtgcccggacgcttcgggatcgcccccgtcatcccatccgaccagccgtgcgaccggctgcccattgcggatgatgaccaccgtatcacccgcttcggcacggtcgaccagttcgtcaagccggatccgggcatcctgaagattgacgcggctcatgatcaccctcggctgacatccacagccacatccctgactgggcggctgaactaaatatgcggccggcgagctgcgaccgcaacccggaacccgtctacaatcttgaaatatataagatctactcctgcgagcgatggtcctgcaggccggcatgggcagagacctgcccccgttccccaaccacctcccgcaccaccccgcgcagccagcgatggaccggatcggcgtccatccgcgggtgccagagcagcgagatggtgatgtcgggcaccggcagcggcagggggatggtgacgaggccgtcgcgcagccggccggtggaccgctcgggcacggtagcgatcagcccgccgtcgcggaccagggaaagggcggccgagaagctggcgacggtggtgatcacccgccgctccagccccagcaccgccagcgcctgatcgacggcttcgtggcccgtgggccggcgcgccacgcggacatggtcccccgcggcataaagtgccggcgtcgcccggggcgcgctggccagcgcatggtcggcacgcaccaccgcgacgaagcggtcgcggaacagggcctgggcccgcaattcgggccccgcggtcccgtccgccacccccgtttccagatccaccaccccgttgcgcagcgccgtgccgtccttgtcggtgcgggcgacgaaatgcagccgcacgcccggcgcctcccgcgcgatgcgcccgagcagggccaggccgaaggtctcgacgaaaccttctcgggttctgaaggtgaaatcgcgcccgatccgggccaggtcgggcggggctgccggccgcaacagggcggccgcatcgcgcacaagccgcgccgcctcgtcccgcagttccagcgcccgcggggtcggcaccaggccgcggccggcccggaccagaagcggatcgccggtgatttcgcgcagccgcgccagtacccggctggtcgccgaggcgctgagctgcagccgcgcggccgcccgggcgacgctgcattcgccgagcagcgcgtcgagcgcgatgagcaggttgagatcaggtgtcgacatgccggaatgataacacaccaaccggcacgacatatggcgtgcaatgcagctattgactgcaaatgctgtgccttccgccatgtctggccggggtgcaggctgtctgcagctcctgagccggagcaggagaccgacggagacccccatgacagacatgcccgcctcaccacccatctctgcccccggccgcgcgggcctgattggcctcgccctgtcgatgctgaccgcctcgctcggcgtcagtatcgccaatgtcgccctgccgaccctggcccttgccctccacgtgccttttcaggcggtgcaatgggtggtgctggcctatctgctggccgtcacggtcgcgatcgtgggcgtcgggcggctgggggatgcactcgggcgccggcgggtgctctcggccgggctggggctcttcgccctcgcctccgccttctgcgggctggccccctcgttcgaactgctggttgcagcccgggcgctccaggggctgggggcagccgcgctgatggccctgacgctcgcactggttcgcgagacggtaccagcggagcgcaccggcgccgccatggggctgctcggcacaacctccgccatcggtaccgcactcggcccctccatgggcgggctgctgatcgccgctgccggctggcgggcggtgttcgtggtgctggtgcccgcggcgctcgccgctctgctgctgatccgccggggcctgcctgcctctcctgcccccaccccggccacaacgctccggcagggactcgacctgcccggcacgctggtgctggcgctcaccctcgccgcctatgccctggccatgacccggcctcacgggctggatgccatcggcttcggcctgctcggcctcgcgggcctcggcgtcacgatcttcctggccgtggagcagcgtgccgggtcccccctgatccggccggcggctctccgcgacccgctgctcgccagcgggctgatctgcaacctgctgatcgcgaccgtgatcatgaccacgctggtggtcgcgcccttctacctctcgcacacgctcggcctcgacaccgccctggtcgggctggtgatgtccgcgggccccgtgctctcggccctgaccggcgttccgctcggccggctggtcgatcgtgtcgatgccgggctgatggcggtggcggggctcggcgccatggccacgggggccaccctgctcgcgcttctgccggcctggttcggcctgcccggctatcttgccggtatcgtggtgctcacacccggctatcagctgttccaggccgccaacaacacccagatcatgagcgcggtgccggccgaccggcgcggcgtcacctcgggcatgctcggtcttgcccgcaatctggggctggtgaccggtgcggcggtgatgggcgcggtttttgccgcagccgcgggcggggacgttgccaccgccggtgccgatgcggttgcccgggggctgcgcatcaccttcgccacggccgccgcgctgatgctggccggcatcgtcgtcgcgcttctggggcgcatgatggccggccggcgggcttcggccctcagatccaggcaggatcggtcgtgaacacgatggtcagccagcgatgcgggccggcctcgcccagtgcctcgccgatctcgcggcggatgccgtcgaaccaggcggtcgtgcccggatgatcggcgggcaccaccacatggatctcgatgaaccggccgcggccgaccttggcggcatagctggaataggtggtaaagccgtgccgcgccaccaccgcatccatcacccgccgcacccgggcatccagcgtgtcgggggtcatcaggaagatctcggtcgccgcccgccacacgatccgcgccggcaccggcagcaggcagagcgtcagcaccatcagcaccgccgggtcgacatagggggtgagccacgcatggggtgtgccgtccagaatggcccccgcgacgaaggccgccagcagcgcgctggtgatcagcgccgagagcagccagccccgcgcatccagcgccagcaggtccgagccgatctgccggttggcgcgccggccataggcgaacatggtgaagccgatcgcagccactaccaccgcatagccggccgcccagccgaaggccagcggccggccgccggccagaagatcggtcgccgcggtcacgaaggcatagccgcagagcagcagggtgatgccgccattgaccgcgatcaccatcggctcgatatgccagaaaccgtgctggaagcgccggctgtcctcgcgggcgaccagacgggtgaccatcagcgacagcagcgacagggcggcatccagcaccgagaacacgccgtcgaagatgatcgactgcgcgcccgaggccaggccgaagccgatccccagcgccgagaccagcagggtggcggcaatcgaccggcgcagaacccgggcttcatgcgcgacggtcatgggcgatcctcccggccggaggcgggcagcgccgccgcccgctcgcgcagaacccgccgcgcgacgtcgatgaaggcccgcagcttgggctgattgcggctgcggtcggggaaatagagccgcagcccgtccgagaccggcagccagtccgccagcaccgtctccagccggccggtcgcaagatcatcggcgatctgcagatcggcggcatagatcagccccagccccgccagagccagttcgcgcatcagggcggcatcgttcacgatcgtcgcccccggcgggtccagccggaaggcctcggtcccgcgttcgaattcccagcgatagatcatgcccgaagtcggatagcgatagcggatgcagtcatggccatccagcagcgcccgcggttccgacggccggccatgggtgtcgaaatagccgggcgtgcccgcgaccacccaatggaattcgcgggtcagcggcagggtgatcatgtcgcgggcgatgaattcgccgatccggatgccggcatcgaaaccttcatcggccagatccaccgccgcatcctgcaccgccacctcgaccgttaccgccggatagagccggcgcaggaccggcagcaccggcaccatcaccagatccaccgccagccgcggcacggtcagacgcagatggccctgcggccggccgcggaaatcgtccaggcggtcgaaggcggcggtcatgtcggccatggccggggccagcctcgccttcagcgcctcccccgcctcggtcagccccactttgcgggtggtgcggtgaaacagcgccaccccggtgcgcagctccagcgcccgcacggcttggctgacggcggccggcgtcacccccagcacgcccgccgcgcgccggaagctcgcctgctcggccactgccaggaattcggccacgccctgaaaggcgtcgctccgcgacatcgaacacctcgattagaaagttgaacttaacagactggatatcactacacgattttcatgacgctttcaccggaggaggatcagctatcggatccgttatcgggaaaggccccgctcatgcagtacacgaccctcggccagagcggcctcgtcgtctcgcggctcgccttcggcaccatgaccttcaccgccggcaatgccgacatgccctcggtctacaagaccggcacggccgcggccgaggcgatgatcggccgggcgctcgatgccggcatcaccctgttcgacaccgccgacggctatgccggcggcgagagcgagaccatgctcagccgtgcgctcggggtcgatcgcgaccgggtcgccatcaccaccaaggtcggtttccgcaacggtccggccctcgatcgtcagggcctgtcgcgccgccatatcctgcggtcgatcgatgaaagcctcacccgcctcggcaccgaccgggtagagctctacgtcgcccatcgcgaagacccgcacacgccgctggaagagacgctggacgcgctcgatgccgtggtccgcgccggcaaggcgctctatctgggcgtctccaactggcagccctggaagatcgccgcggcgctggagatccagcgcgcccgcggcctggctccgttcacccatgcccagatgcactattcactgctcggccgcgacatcgagcgggattttctgccgatggccgcccgctatggcctgggtctcacggtctggagcccgctctcgggcggcttcctgaccggcaaatatgatcggggcaacatggaccgggccgatggccggctgtcgggcttcgacctgctgcccttcgacaaggcgcgcggctttgatctgctcgacgtgatgcggccgatcgcggcggcccatggggccagcctcgcacagctcgccatcgcctggctgctggcccggccgggcgtctccagcgtcatcctgggggcgagccgcatggaccagctggacgacaccatcgccgccgccggcctgcgcctgtccgcggacgagatcgcggcgctcgataccgccacggccctcgccccggtctatccgcactggttcatccagggcctggccgatgcgccgatggccgccgccctctccgcctagccgaacaggtccccgattgcggcaggggccgggcgactgcgggccaggcgttccagcgccgccgcatcggtttcggcgccgccatcgggcgtcagatgcaccaattgtgcccccgccgccctcaacagcggcgagaccagatggaagcggtggcagtccagcgggtcgcgttcggcgcacatcagcgcgatgcgatgctggcgggcgccgtcgagcagacgggcgatgccgcgcgcccgcgcctcggcaagccgctccggatcggcatcggccggcggccggccgcccagctcggcccccagcggcacatgggcgataccggccgtcttcagcgccgccgccagcggccgggccccgaattgcggatgacgccgcgaccacggaaccgagcgcagatcggccacggccgtgatctccgccgcctgaagcagggcgacgaagcggtcgatcgggtggtcggaatggccgatggtccagaagaccggccgggccacgccagtgtcatcggtgggcgtctccatcgggccatcatgatccgcccggcccacggctgcaattccgcaggccggccatcggacagaccggccgcgcggcgcggtgcggatcgcgctaggcttcgcaaaacacgcgaagaacacccaggaggatcgcccatgtccgagacaccccccgtcaccctgctcgccgaaggtctggccttccccgagggcccggtcgccatgcccgacggctcggtgatcctggtcgagatcgccgccggccgcatcacccgggtgatgcccgatggccgcaagctgaccgtggcggagcccggcggcggccccaacggtgccgcgatcggccccgacggcatgctctatatctgcaacaatggcggcttcgaatgggcggtcgacaagggcttcaccaaacccgccggcacgcccgccgactggtcgggcgggcggatcgagcgggtcgatcccgagaccggcaaggtcgaggtgctctataccgaaagcgatggccggggcctgcgcggccccaacgacatcgtcttcgacgatcagggcgggttctggttcaccgatctgggcaagaccttccacgaccggaccgatcacggcgccatccactacgccagggccgacggctcgctgatccgcaccgccgcctggccggtcagcaacccgaacggcatcggcctctcgcccgacggccgcacggtctatgccgccgagaccaccaccggccggctctgggcctggaccattaccggcccgggagaactggcgccgcaaagctggcccgaggtcgagcatccgcggctgatgggcccggcccccggcttccggcgctatgacagcctggcggtggaagcctcgggcaatatctgcgtcgcctcgctgcgcatcggcggcatcgaggtctatgcacccgacgggccggtgatcgatttcgtgcccttcgacgacccctacaccaccaatatctgtttcggcggccccgggctgaagaccgcctatgtcaccctgtcgggcaccggacggctggtcagcgtgccctggccgcgggcggggctgaagcttgcctatggttgacgggcggggtgccgcaaggctatccggaaggagacctgagttgacgaaggggccgccatgtccgccgcgatccatatcgaaagtctgaccggccgggcgctgcacgaccggctcgacgatctggcggccctgcgcatcgccgtgttccgcgactggccctatctctatgacggcgaccccgattacgaacgccgctatctcgccacctatgccgaggccccgggcagcgtgatcgtggccgcgatcgaggcggcgaccggccgggtggtcggcgccgccaccggcctgccgatgtgccacgagcccgaaaccctggccggccccatgcggcaggcgggctacgacatcgaccggctgttctatttcggcgagtcggtcctgctcgccccctggcgcggcaccggcatcggcgtcggcttcttcaatgcccgggaagcccatgcccgggcgctgggcaggatgagccatgcctgtttctgcggcgtggtcaggcccgacgaccacccgcgccgcccggcgggcttcgtgccgctcgacgggttctggcgccgccggggctatgaacccgtggccggcgcggtgggggaaatctcgtggcgcgacctgggcgaggccggagagacggccaagcccatgcagttctgggcgcgcgcgctttgaccggcatcaccgcacgtcccgcccgcggccgcagcgccccggcccccggccccgaccggatcaccgtcgccgcggccgcctggccggtcgcacggccggacagccttcaggcgctggaagcgcgtctcgaccaatggctcggcgaggccgtggccggcggcgccgagctggcggttttccctgaatatggcggcatcgaggcgggggtgctctcgccccgctggcgacccggcgaccttgcggcggatatcgatgccgcctcggacatggccgggatctggctcgatctgcaccggcggcttgcccgccaccaccgcattcatctgctgaccggcagcctgccggttcgcgatccggtccatggcctgccggtcaaccgctgctggctggtggcccccgatggcagtgcggcgcatcaggacaagcggatgatgacccggttcgaacgggaaagctgggggatcggcccgggcgatgcccggcgggtcttcgacaccgccctcggcaccatcggcatcgccatctgctatgatgcggaattcccgctcgaagtacgcgacatggtcgcagccggcgccgaaatcctgctggtgccgagctgcaccgacagcgccgccggctatcaccgggtgcgggtcgcagcccgggcacgagcgctggaaggccagtgcttcgtgatgcagtcccccaccgtcggggtggccgactggtcggaagcggtggatgtgaaccggggggcggcgggcatcttcgcgccgcccgatcgtggcctgcccgatgacggggtggtggcgcagggcgggctcgaccagccgggctggaccatcgccacgctcgatctcggcgcactcaggcgggtgcgggccgacggacaggtgctgccgctccgccattgggacgagcaggcatccgccggccgggcatgatctagtctgcttccgcctcgatccgcgcaaccaccgggctggcgcgaagcgcctccaccaattcagccgtgcaggcaaccggcaccatgccaaaggcggtgggcggcccgatccagaccagatgatcggccaggccgagccgctcggcctctgcctgcaggccgcgggcgcggcgggcggtatcggcggcggcggcagcgagccctcgtccggtcgacggggtttccgtcgccgccagggtgatcagatagcgtcgggttccggccggcttgggcggcggcatgggcatgggtcctcgggagggtcttggtccgcagggagggcggcaggctgggctgccgcggaccagcatatggcatcttccgcgtccgggggtaagaccatgtcggtgacatcgcgccgtcaccgcgcgtttggcaccgcgagtttggcgcagcgagatcggcgcggcggggtcagggccggctccggaacaccgcccggctgtgctcgaacagatggcggatggcgtgcagcgccgccgcccgggcggcggtatcggccgtcgccagcggctcggccgcggccagttcggcggccagcgccctcgcccccagattggcggcggagcccttgaagccatgggccgcgcgccgccaggcctcgccgcccgcaccgagggccgcctccagcgccgccagatactccagcgccccggcttcgaacaggccgaagacctcgtcttcgagatcccggtcgccgagggtataggatctgagctggtcgaggtcgaagatctccaccggcatctccttcaccggcattctttccgggcgtggcgctcagtcgagcgggaattccgcatgcaccaccgtgtcgccggggcggatgccgagcagccgggcggtgccggcattcagctccagcaccgcacgtgcggcatgcttggagccgatcggcgtgtcggtcagcggcacggtatcggccgcgatgtcgaccaccacgccctcggcatccaggaacagcatatcgagcggcacataggtgttgcgcatccacatggtcggctggctgtcctcggggaagacgaacagcatgccgcgatcggcgtcgagatcggagcggaacatcagccccatggtccgcgcctcgtgcgagcgggcgacctccacccggaacatgcgcgccttgccgccctcggccggccggatcgccagcggctccagcggctgttccggcagggcctgggcctggatcaccgcgctcggccatgatctcgccgccaccgccggccaggcccaggcgcagttggcggccagcatcatggttgcgatcaacagacaaagcgatgcccggtagcctctgcggcaccggttcaggacctggtccagcatgcgcgttcctcgtcgggggctcacgcggccgttaccgtcgtctgccttcccgggcatgcaccagacatacctctgaaaggcggtcgtcgcgtcggccgtcgcggcttggtgcggtcgggggacgtggcggagcctgcaccacgactaccctcccggcgggatggcccgaacggcaagacggcccgggtgcgtcttcggtcatactcctgcccgggcctgcgcgcaaccggaacgctcaggccctgcgaaaacacgcgccttacgcaagggatgccatgggatcttgcaccctggataccgccggtgcatagttcggccttcacttggggggagccgcggtgcggcggctgagaggttcccggttcggaacgacccctgaacctgatccggttcgcaccggcggaggaacaagtgcgcatgccatgcccgacgacatccgtcccctcatccatccgttgaccgcagagcccgcggcccggatgcaggcgcctgccctgcaccttgccgatgtcaccatccgtccgggcgggcggctggtgaccaacgggctcgaccttgatatcgccgccggccgcatcaccgcgctgctcggcgccagcggttcgggcaagaccacgctgctgcgcctgatcgcgggcctcgatgtcgcggggctggaacgcggccgggtcaccgcctccgacggccagccgctcgacggccggatcgcctggatggcccagcaggacctgctgatgccctgggcccgggtcatcgacaacgtcacgctgggcgaccggctgcgtggccggaaagccgaccgcgcccgggcgctggatctgctcgaccggctgggtctggccggcacctcggcgctgcgcccggcggccctgtcgggcggcatgcgccagcgcgtcgccctggcccgcacgctgatggaagaccggccggtggtgctgatggacgagcccttcggcgcgctcgatgccgtcacccgccacgggctgcaggatctggcctgccgcatgctgcgcggccgcaccgtgctgctggtgacccatgatccgctggaagcgctgcgcatgggcgacgagatcgtggtgctgaccggcaacccggcccggccgatggcggtcgcggccccacccggcccggtgccgcgcccggtggatgccgccgatctgggcgaccggctggcccggctgatggctgtgctggaggtgcgcgcatgaccggacaggcttcgggcgcatggtggcgcgggctggtcgcggtggcggggctgatcgccgtctggtgggcggccgtgctcgcgaccgggctgccgcccttcctgctgcccgcccccgatcaggtggcgcaggcgatctggaccaaccgggcgctgctggccgatcatgccgcggtcaccgcgcttgaaatcgcgctcgggctcggggccggcacggccgtcggcgtcacctcggcgctggcgatcgccggcgcgcccaggctcggccgctggatgatgccggtgatggtgggcgcccaggccctgccggtctttgcgctggcgccgctgctgaccctctggttcggctatggctatgcgcccaagatcgtgatggcggcgctgatcatcttcttccccgtcgccgtcgccttcctggacggcctcaggcggaccgaacccggctggctcgacatggcgcgggtgatgggcgcctcgcggcggcgcagcctgctgctgatccgcctgcccgccgcgctgccggccctcgcctctgggctcagggtcgcggccgcggtggcgccgatcggggccgtagtcggcgaatgggtcggctcgtccgccggcctcggctacctgatgcttcacgccaacggccggatgaagaccgaccagatgttcgcggccctcgccgtgctggtcgtcctgaccctggttctctatctcgtggtcgaccgggcgctgcgcgccgccatgccctggcaggcggatgcgctcgacggcggctcgcgaggctgacaccccacccgacagataaacccctcccggaggagatgccccatgacgcagcgtgttgccacgcggcgcagcatgcgccgtctgctggccgccaccctggttgccgccaccgccctggcggccccggctgcccaggcggccgaaaagctgaccctgctgctcgactggtatgtgaaccccgaccacgcccccctgctggtcgctcaggagaagggctatttcgccgaggaagggctggaggtggagatgatcgccccggccgatccgtcggacccgcccaagctggtcgccgccggccgggccgatctcgccatcacctatcagccgcagctgatcgccatggtgcatgaaggtctgccgctgaagcgggtctcgaccctggtcgccaccccgctcaacagcatcatcacgctggccgacggcccggtgaagacgctcgccgatctgaagggccgcaggatcggctattcggtcgcgggcttcgaagacgcgctgctcggccgcatgctggccagcgccgggctcaccatcgacgacgtcacgctgatcaacgtcaacttcgccctcgccccctcggtgatgtcggggcaggtggatgcggtgatcggtgcctatcgcaatgtcgagctggtgcagatggcgctggaaggccgccccggccgcgccttcctggtggaagagcacggcgtgccgccctatgacgagctggtcgtcgccgcccgcgccgacaaggcggccgatccgcgcttcgccgccttcaaccgcgcgctggaaaagggcgtgcagttcctgatcaaccaccctgatcagtcctgggagctgtacatcaagggccggcccgagatcgcggacgaaggcaaccggaagtcgctggaggcgacgctgccgcgcttcgcccacagcccggcggccctcgattacggccgctggcgcaatttcgccgccttcatgcacgaggccgggttgatcgacaccccgaagccggtcgaagactatgcgcaggcctggcgctgatgcgaaaccggcgctgatgcagaactggcgctgatccggttctccttcccgtctgatcaagcctgaaacgcccgcttgcgaccatgtgccgcaagcgggcgttgcctttgccacgccccgggtcggtctcatgctatgccaaggacttatcggacttaattcgtccggatttccttgacccgtcccgggtttcctgggaaaaacgcgggccagggaggacgctgttcgacgggacggacacgcgctctgcatgcgccatctccgctttgcgtccggctgaacacgacgttcggccgcaggcgcgccggcgcctccttgccgtcaaggggaccaaccactcaggggagactgcggtggcgcgagccttcggcctgtttctggcactgctcacgacctggctgctgatgtcgggcatctacaagccgttgatcatcggcttcggcgtgctgtcctgcgccttttcggtgtggatcgcacgctggctcggcatcctggaccgtgaaggggcgccgctcggcatgctgccgcgtgcaatcccctactggttctggctgtcggtcgagatcatcaagtcgaacatcgacgtcttcaagcgcgtctggggcctggccccgatcgatcccgcctggaagcgggtgcccaccagccagacgaccgatctgggccgggtgatctacgcgcagtcgatcaccctgacgcccggcactgtctcggtcgatttcgaaggcggcatgatcgtcgcccacgccctgcattccagcgcgctggaggggatggacgagggagagatggaccgccgctgcaccgcgctggagggccgtgtctgatgttcatcgccgccaccgccgcccttgtcgtcgccctggtgctgggcctggcccgcgccgttctgggccccaccctcttcgaccgggtgctcgccgccaacgccatcggcaccaagatcgtgctgctgctggccgtgatcggctttctgaccgaacgcccgcatttcctcgacctggcgctgacctatgcgctgatcaacttcatcgccaccgtggcgatcctgaagctgctgcgccaccgccatctccgcagcctgaccaccgaggacgtggccgccgacgagatggatgccgccgcaaagcgcaagggaggccccgcatgacactggtcatcgacctgatctcctgggcgctgatcctggggggccattgttcgtgatcaccggtgccgtgggcctggtgcggatgcccgatttctacacccggctgcatccggccggcatgatcgacaccttcggcgcctggctgatgctggcgggcatgtgtgtccaggccggcttcaccctggtcaccgtcaagctgatcatcatcggcctgttcctgttcttcacctcgcccaccgcctcgcacatcgtcgccaatgcggcgctggtgtcgggcatgaagccgaccggccggcgtctcgacacgcccgagccgtcctcggccggtgcccatcgggagacgcgcccgtgatcgtcatcggaccatggtcgattctgaccgccgatctgctgaacatggccctgctgctgatgctggcaggtgtcgcgatcgcgatcgtgcgcacccgcagcctgctgaccgcggtgctgctgcagagcgcctattccctgctgatcgccgccctctggatggtgctggatgccatggacgtcgccttcaccgaggcggcggtgggtgccggcatctccaccgtgctgttcctggccgccctggtgctgaccgggcgagaagaggatcgcggccacaaccccgtgctgccgatgatcgcagtggtcgcaaccggcgccgccctgctctatgccacggccgacatgccggccttcggcgacccagaggcccccgtccagacccataccgtgccgcgctatatcgagggctcggtcactgaacacggcatccccaacatcgtgaccaacgtgctggccagctatcgcggctacgacacgatgggcgagacggtggtggtgttcacggccgcgcttgcggtgaccatgatcctgggcggcggcgtggcggtggcccgccggcgccgcaacggccgcgacgacgaggagggcacctctgatgatgcgtgatcattatctgatccttcgggtcgtctcgaaggtgctgatcccgttcatcgtgatgttcgggctctatgtgcagttccacggcgaatacggccccggcggcggcttccaggccggcgtgatcatcgcatccgggctgatcctctatgcgctgatcttcggcctgaccgatcgtcagcgcgagggcatgctttcggtctgccggctgctggcgccgctgggcgcgctgttcttcgtcggcaccggtttcgcgaccctgttcttcgggggcaacttcctggaatacgccgccttcgcgccggccgagcccaagctcggcctgctcatcggcatcatcgtggtcgaactgggcgtgggcctggccgtcgccgcctcgatgatcctgatcttcttcaccttctcggaacggcggagctgaggtgggcgtgttcgagcatttcaactactgggtcgccgtcttcctgatgatgaccggcttctacaccgtgatcgcgcggacgaacatggtgaagaagctgatcggcctcggcatgttccagaccgccgtcttcctgctctacatcagcatgggcaagatccggggcgccaccgcgccctatctggtcgacggcgtgcccttttccgaaaacacctacaccaacccgctgaccagcgtgctgatcctgaccgcgatcgtggtctcgatcgcgaccaccgcggtcggcctcgcgatcgtggtgcgcattcgcgaggcctacggcaccgtcgaagaggacaagaccatcgccatggacatggccgacgagcgtgcggaagacgccatgccgccgaccatccgcgaggccaagcgccggctgggctggctgccccgcagcggcgccccgcgcgtgacgccgcctgagcccgccagacagcccgcccgcgaggcggcgccccggccgcccgcgcccaagcgcggacccatgagccgccgcaagagcgcgccccgcaaagggaagggccgtccatgagcctggtcacccatctgccggcgctccaggttgccacgcccctggtcgccgccctgttcgtggccattgtcggccggcgcagcttcgcctatgccgtgctggtcctggtcagcctggcgagcttcgccagcgccgtcaccctgacgatcgaggtgctgaaccaggggccgatttcctacgagatgggcggctgggcgccgccctggggcattgaataccgcatcgacctgctgacctgtctggccctgctgctggtctcgggcatcgccgcgatctgcgccccctacgcccccgcctcgatctcggccgaaatccccgaaaagcgcatcccgtctttcgtcgccatgtatctgctggcgctcgccggcctgtccggcatggtggcgacgggcgacgccttcaacatctacgtcttcatcgagatcacctcgctgtcgacctatgcgctcgtcgccatgggaccggaccggcgggcgctgtcggccgcctttcagtatctgatcatcggcacgatcggcgcgaccttcatcctgatcggcatcggcctgatctacatgatgaccggcacgctcaacatcgccgatctggcccagcgcctgccggcggtcgaaggcagccgggtggtggtcgcaggcttcgccttcctggtcatcgggcttgcgatcaagatcgcgctcttcccgctgcatgtctggctgcccaacgcctatgccttcgcgccctcgctggtctccgccttccaggcggcgacggcgaccaaagtcggcatctatgtgctgctgcgcttcatcgtctcggtcttcggcgcctcttatgccttcgacgccatgccgctgggctggacgctgatcccgtttgcggtgctggcgatgttcgcaggctcgctggtcgcgatcttccaggtcgacgtcaagcgcctgctcgcctattccagtgtcgcgcagatcggctacatcatgctgggcctggcgctcggcaaccagcacggcgtctcggccgccctcattcatctgatcaatcacggcgtgatgaaggcggcgctgttcctggcgctgggcctgatcgcggtccgcctgggcggcacgcggctggaacatctccaggggttgggccggaccatgccggtcaccgcggccgcgatcgtgatcggcgggctcagcctgatcggcgtgccgctgacctcgggcttcatcagcaaatggtatctggtctcggcgacgctcgatgccggcatgtggccgctggccgtgttggtgatggcaagctcgctgctggcggtgatctatgtctggcgcctggtcgagacgatgtatttccgcgccccggtcgaaggcgccgccgaggcctgcgcgggcccgtccaacccctggctggcctggcctgcctggtttgcggcggcgctctgcatctatctcggcatcgacaccagggcaacggccgggcttgccgagcttgcgacccgcgcgctgatcgggggagcctgacgccatgacgcctgaattcctgctcgtcgcgtcgctgctctcgccggtcgcgggtggcatcctgatccttgccgccggccgctcgccgggggcgcgcgacatcctgatggtggcggcggcggtggtcaccgccgtcttcaccctgatgctggcggcccgggtgctggacggcgcccggcccgtgctcaccctgcatcagctgatgccgggcctgccgatcggctttgcggtcgaaccgctgggcatgatcttcgccgctgtcgccggcacgctctggccgatcaccgcggtctattcgatcggctatatgcgcggcaatcacgaagcgcatcagacccgcttccacttctgcttcgcgctggccatcgtcagcgcgctggcactcgcctattccgacggcctgctgtcgatgttcatcgcctacgaggtgctgacgctgtcgacctatccgctggtcacccattcgggcaccaaggaggcgatgaaggcaggccggacctatctcggcatcctgctcggcacctcgatcggcttccagctgaccgcgatcatcggcgtctatgtcctggccggcaccgtggccttcaccgcgggcggcgtgctgcccgatgggctgtctcccgcgctgctcggcctgctgctcggcctcttcgcctatggcatcggcaaggtggcgctgatgccgctgcatgcctggctgccggcggcgatggtggcgcccaccccggtctcggccctgctgcatgcggtggccgtggtcaagggcggcgccttcgcggtggtcaaggtcgtggcctatacgctgggcgccgatcgcctctccgccgccggcgccaatgactggctggtctgggtggcgtcggcctcaatcgtgatcgcctcgtcgatcgcgctcacccaggaccatctgaagcgccggctcgcctattcgaccgtcagccagctcgcctatgtgacgctggcagcggccatcatggcgccgctgtcgctggtgggggcggccatgcacatcgccgcccatgccgtcggcaagatcaccctgttcttcgccgcgggctccatccacaccgccgcccacaaggactatgtcagccagctggacggcatcggccggcgcatgccctggaccatgggcgccttcgtcctcgccaccctgtcgatgatcggcctgccgcccgcggtcggtttcaccagcaagtggttcatcctggaaggcgcggtctcacgcgatcagtggatcgcggtcgccgccctcggcgcctccaccctgctgaacgcggcctatttcctgccgatcgtctggcgcgccttcttccgggcgccggttgcggcgaaatcggtgggggccgccgccccccatggtggcgatggccatcacgatcatggcgaggcgccgctgccgatggtgctggcgatcctggccacggcggggctcaccttcctgctgttcctctaccccgatcccgtgcttgcgctggcagaggccatggccggcaccgtcacacagggaggcctgcgttgaccggtcccatttccccaaggctgcagaagaccgggcttgcggttgcgggcgcggtgctgatcctggccgcgctcgccgaactcgccatccatcgtcacggctatctgggcttcgacgagatctttgccttccatggctggttcggcctgatcgccggcggtgtggcggtggtgggcgcccgcgcgctcgccctcgccctcggccgccccgaggcgacggaggcggatgatgactgaacccggcctcttcgccaccctgccgccggccggcctgctgctgctcggcgccctgctcaccgcccttctcccccgcgggctgcgcgccctgccggtgatcgcagcccccctggccgtgctggcggtggcctggctgctgcccgatggccccggcgccggccatgcctggctcgatcaggttctggtcccggtcaccgtcgatgccaccggccgggccttcaccaccatcttcgcgctcgcggccctggccggcggtctctatgccctgccccgggcatcgaccaccgaactcgtcgcggcccaggcctatggcgcgggcgcggtcggcctcgccttcgcgggcgatctgctgacggtgctggtgttctgggaagtgctcgccatcggctcgaccgtggtgatctgggcggccggcaccgaacgcgcgcgccgggcggcgatgcgctatctgcagatccatctggccggcggcatgatcctgatgatcggcatcgtcggccacatcaccggcggcggcgccaataccctcgccgcattgaccgccgatatcgatgccggcagctgggccgcctggttcatcctggcgggggtggtgatcaatgccggcgccccgccgctctgggcctgggtgtccgacgcctatcccgaagcctcgtccaccggcatggtgttcctgtcggccttcaccaccaaggccgcggtgctggtgctgatccggctgttcccgggcaccgagatcctggtctggaccggcatcgtcatggccgcttatggcgcgctctatgccgtcatcgaaaacgatctccgccgggtgctggccttctcgatcgtcagccaggtgggcttcatggtcaccgcggtcggcatcggcacgccgctggcgctggccggcgcctcggcccaggccttcgcccatatcctctacaagtcgctgatggtgatggccgcgggccatatggtcgccgccaccggccggcgccggctgggcgatcttgcgggtatcggacgggccatgccgctcacctgggcggcgctgctgctgggcgggctcggcctggctgccgtcccgctcaccgccggtttcgtctccaagggcgtgatcctctcggcactgggcaaggatggcgccggcatcgcctgggcggcgctggtcggcattgcggtcgtctccaccgtctatgcggcgctgaagctgcccatggtgctctggggcacccaccgcatccagggtgtcggccgcggcgtcggcgatccgggcgtggtgcagatggtcgccatgggcttcatggcggcgctggttgtgggcatcggcgtggtgccgggcaccctgctcggcatgttcccggcctcggccgattatgccgtcttcaccgccgaccatctgatcacccagatccagctgctggcggccgctgccgtggtctggttcgcggccgccccgcggctcgctcccggccgtggcatcacccgtgatttcgactggatctatcgcaccttcctgccccggctggcggcagaattcgccatccatggcgatccgctgcgcagcggcctggcgaagcggatccaccggcggatcgatttcgtgatggccggcatcttccgcatccacggccccgaggcaccgctggcccgcgactggccgaccggcggcaccgtgctcgggatcaccgtgatgctgggcctctgtctggtggtctattacgccgcctgaccgcccgggtctcgccgttcccgacgccccgccgaccccgtcggcggggcgtcgtcgttaaaaacgccgtttgcaatgccgccatgccgccgccgcgctggtcgccggggggcttgcggcgctaaggtttgcgaaagggtcggtgccgtatcatccgcaggcccccctcacacatcgacatgcacagagcatccgtcatgctgcgtcccgcacgtcccacagacgccgccgcgatcgccgacctcgtcgccatggccgaccccaaaagcattggtggtctgaccggcatcgaagatccggttcaggcgatggaagccttccgcggtctgatccgcggccggtccggcgtcgcctcgcatctttatgcccgcgtcttcgaagaggccggccgcccgatcggggtggtggtggcctatcccggccgtctggtcactggccccgccgtcccggccgaagcccgggtgaccgaggccgatgaattctacatcgacaatgtcgcggtcttcccggaacaccgcggccgcggcgtcgcccgccggctgatcgtctcggccgaaaccgccgcacgcggcaacggcttccccgccgtctcgctgatcgtcgacgaacgcaacctcgccgcccgcggtctctacgagaagctcggctacgcggtctcgggccgcgcggtcgtgcgcggggaaagcttccaccgcatgcgcaagcccctcgtcgccgagcagaccgcgccgcgcgccgcggccctcgcctgatgaagccaggcccggcaccagagcccggcggcacgcgcatctggccccggcggacccgggctgccgccatggtcatgctggccgccgtgccgctggtgctgctcgcctggctgttcaagacaccgggctgggggctggccgcgggcatcgcgctcgccgcctatctcgccctcacctggcaggatctgcgccgccccacaaggcgggtggtcggcgccatgctggcgatcggctgggcggcccagctcgccaccggtgccgggcccgaggcgctgatccgtgcgctctcggccaatgccgtggtcggcgtgctgatcgtcgcctgcggcctgctggcggtgccggcggcaagcccgcgctatgtcgccgaactcacccggcttgtctcgggcaccgaggggcgccggccgccgctcggccggctggcgctggtgttctggactggtcatgtgctgggggcgctgctcaacatctcggcgctgtcggtgctgctgccggcgctgggcggtgcccgggcgcgcgacggccggctgatgcgcagcctgcatcgcggcttcggccttgccgggttctggagcccgttctacgccacggtcgcgatcgtgctgatcgcctatccgggggccggctggccgggcctgctggccgccactttgccgatcatcccggccgctttcctgctcgacatgggggcggcgctgcgtcatggccgcaccgcccttgcccgctcggtcgaaaccgccgtgccggaggacgaggcgccctcgccatcggggccacgccggcgcgggccctcgctctggctggcggcgggcggtctcgccaccctcggcatcggcctcgacatggtcatgcccggcccgacgctggtctgggtgatcgtggcggcgctggccgccgccctgatctggatgatctgggccaacggcaccgccgccacctgggaccggctgatccgcccgcggctgatcggcccgccgggcatgacgcttcaggccaatgaaatcgcggtcttcgcggcggcaggtcccctcgccgccggcctggcggcgatcctggcgccggcggccggcaatatcgccgccgtcgccgatgccatgccgctctggctggccatcctggcggtggagttcgtgatcttcggcctgtcgcatctgggcgtgcacccggtggcctcgatcctgctggtcgcaggcgccctgccccccgaggtcgtggccggtcgcgaggcggtttttgcgggggcgagcctcgccggctataccctcaccctgctcgcctcgcccttcagcgtcaccggccaggtcttcgccagcctgaccggcgccagcccctggaaccagaccgtcacccgcaatatcggctatgccctgctgctggcgctgctcgccgccttctggctggatctgggtgccatggcgctggtttcggccatcggctgattcccccgccccgtcaacggggaccctggccctcgcgcatccgcagccagccgcgcacgaagcgccagaccatccagatccaggtgatccccagcaccacgaagccgatgaagatcacggtcagggcggcgccgatgatgttggcgatcacgccgaaccagaaggtctcgaccagatagcggtaatgcgcccgctcggtggtttcggtgtcgagcatgaaaaagcggacatgggcgatgatgctggccaccaccagcggcagggcggtcagcatgcccagcagatgcaggccgtaggtcacggtcagcatcacctcggcctgatgggcggtgcggtcgtccgcgccgggcctgagttcgaatttcggtgtgctctggaccatgctgatccgggctccctgcgatcggtgtggcggcatcacgcgaagcgcttggctttgcggccgcttcgggcgaaatgtaggcatggtcgcgagccatcgccagcgtcccgatgcgtcagcccctcaaacatgcctccgaggagccctctccggccatgttcctgcataccctcaccgccctcacccttgccatgctgatcgcccctgcggcgcaggccgatgtaccgcccgccctgctcgatgccgcccgcgacgcaaaggtcgtgctgctgggcgaacgccacgaccatgccggccaccatctgatgcaggaagaaacctaccgggcgctgatcgccactggccaccggccggcgctggtgatggagatgttcagccgcgacgcccagccggcgatcgatgcgctgctggcgggcctcggcaccgcccccgatcagcgggcgctcgatctggcgctggagcagatgccgcagatctcgggattcaccgccggcggctggcaggactgggccgcctatcgcccgatcgtggccgtggcgctggaacacggcctgccggtccgggcagcggactggccgcggcagacgcggcgggccctggccctggaaggctggcaggccctgccctcgggcttcgttcagcatttcgcgctcgacgagccggcggagccggatgtcgaagacgggctggcccgggcgatcgtcgaaggccattgcggccatgcccccggcgatgcgctggaaggcatggtccgggtgcagcgggcccgtgatgccggcattgccggcgcggcgctcgacgccctggcagcggccggggtcgatcaggtgctggtgatcgcaggcgcgggccatgtccgccgcgatctgggggcgccgctctatctgaaggccgccgccccggaactgccgatactgacggtgggcctggccgagaccggcgagagcgatgccgcccccgatctgcgcccggcccgcgacgaagagccgttcgatctcgtctgggtggcagaggcccagccgcgcgaagatccgtgcaaggcctttgccgaccagctgcgcaacatgaaacgccagtgatacggcggcccgatccgccttatggccgatctgcgtccccggcaagccggccgatgatgaaagctgccgagatgtcgatcgcctcgcgcgcggcttcgaggctggcgagactgaacggaaagcagtacctcataccaccgcgttcacatgttcagcatgcggccaccatcgaccacgatctcgctgccgatcgtccatgccgagtcgtcggatgccagatagaccaccgccttgacgacttcctcggcgctgccgaagcggccggccgggatccccgcgatgatgtccctgttgacctgctcgcgataagcatcgggaacaccgagcttgtcgtagagcggcgtgtcgatcggaccggggctgaccgcgttgaaccggatgccgcgctgcaggagttccgcagacagcgtcttcgacagattgaggaaagccgccttggtggcaccatagaccgacgaggtggcggcaccgacatgcgcattgatggaggtgttgagcacgaccgatgccgggttggcgaaaacaggcagcagcgcctgagtcaggaagtacggccccttgacgttgatcgcaaagatccggtcgaacgcctccggtgtccaggattcgatcggctgccagatcgagatgccggcgttgagaaaggcgacgtccaactggccgtagtgctccttcaccgcggcggcgagtgcctgctgttcttccacgcgcgcactgtcggccctgatgacgggaacctcggcgccgaggaccgacctcgcctgtgcaatcgtgtcgggattgttgcccgtcacgatgacgcgcgcgccttcgttcaggaactgccgggcggcttcgaggccgatcccgctcgtgccaccggtgatgagggtgcgctttccgttgagtcgtgtcatatgccttgtcctgttgattgacgtctttgctgcaaccgacagggcgggcctcgccacggccggccccgtcggtcctctgaaaacatgggcaacccgcacgcggcgtgcgtgccggatacgctcagcttcttgcccgatcatctcaagctgcccgcgctgaacagcggctcccgtgtagtccgcaaatggccgggacgcccgacctgaagcgtcgctgcccggacatggcggcgggatgcctgaagtcaggccgcggccagtgccccgttctgacgcagatgattgcggaagcggtcggcgtagtcgggcacgacggcgtcgcggacgctcggccgcgccgccagcgcggcgcgccacgccgtgatgcgtggcaggccatcgaaaaccgcctgcgatacagccgggtcgatgatcccgaaatagcggaagagcggagcataaaccgcatcgaccatgccgaaatcgggaccggcgaaatacggcccggcgcccagctccgcctccagcctgcgcagcttgtcgcgaagtgcggagcgccgggcgtcagcggtcggaacgtcgacggcatggagaaactgccaggcgtcggccatggtctgggttgcgaactcgatccaggcgcggtgccgggcgcgggcgagaggatcctcggggtacatcgaggcaccgcccagcgtttcgttcagatattcgcagatcaccatgctctcgaagacaacggcatcctctccgtcgggctggcgcaccttgagcacgggcaccttgccggtcggcgacagcgccagaaaccagtccggcctggccgacaggtcgacatttattcgttcaaacggcacccccttttccagaagggtgatcgcggcgcgctggacgaacggacagagcggatggcttataagggtgagatttgtgtcggtcatggagcgcggccctttctcgggatgatccggtcaggcaccgctgctgcattgcggtgccggtccgataccagccagatggtccccagacgtgccgcgcgcccgcccgatcgtctcaactcattgcccgattgtctcaagggctttgcccggggggcgagggatgtcatgatgagacgatgagcgatactcttcagccccatctggaccttgcccggcgccacgcgcgatcggggatgaccgtgacgccgatcccccgcctggaaataggcgtcggtcaggcgacgtccggcacgtcaccctgcctttaccgctcgatgatctgcttcatccttcagggctcgaaggaggtgaccattcacgacaacctgctccgctatggtgcggggcagtatctgatcagcgcgctggacttgccgctgagcggccagatctacgatgcgggccatggtcggccatatgttgccgtctcgctcgttctcgatcctgcacagcttgcgcagatggcgtccacaatgccgcccgtccgcgaccccgatgcgccgggcagcggcatcgcgatcaatccgctgacgccacagcttcgcgacacgttgctgcgcctgctcgcgctgctcgatacgccgggcgacatccccgtcctggccccgatcgccgagcgtgaattgctctaccgtctcctgcagggaccgcaggggcgcctgttgcgtcatatcgcccggcccgagggcgcacttggccggatccggcgcgccgtcgagtggatccgcgagcaccacaatacccggttgcggatcaaagacctgtgcgatgtgagcggcatgagccgcgccagcctgcaccgccacttcgtggcattgaccggactgagcccgattcagtaccagaaacagatccgcctgcaggaagcacggacattgcttctggccggcaaccacaatgctgccgacgtcgccttcgccgtcggctacgaaagcgcctcgcagttcagccgcgaatatctgaggcagttcggtgcaccacccgtccgtgacctgcagcggctcaggcagtcgatcacaggcatccggcgcccccagccccagggcgacgatggagtgagcgcttgaggaaactcgtgtgatcggcgtcagccgacccgggccgccgcttcgcgtgcggctgccgggtcgagcagcagcgaggtgacgtcgagcgaggtccgcaggtcccgccgcggcccgcccagcagatgggcgtacatgaaggcatcgcccagacgcacgatcgcctcggccagcacggggatcggcagccagggcgtgaagcgtccggcggcctgttcggtcgccatcacctcgcccagcagccgggcggagcgggtctcgatcggccccatcgaggtcgcgagccggatgaacagcaacggttcgcgctgcacgaagatcttgagcggctcggcgtcgagcacatcggtcatgaaccggttgagcagcgccacgatgccgggcacgccggtctcccggatgtcgcgctgggcgcggcggaagctgtattcggtgcgatcggccagcaccagccccagcagccggtcgcgattgccgacccggcgatagagcgtcgcccggcccacccccagttcgaccgccagatccgacatgtcgatcgcctcgccgcgggtatagcggcgcacggccgccttcaccacctcggcctcggcggtgttgcgcgggcgatcgtcttccagcccgccttcggccaggcccggggtcttcgcggcaaggcccggcgtcttcgcggcccggctgcgtgccggggccgtctgcgccgccgacatgcggcgggatcgtgtcggggatgcgtcgttcatctatcctgcctgtggtggccgccgaaacgggtcgtggcacgctgaccgaaatcgcggccggtgctgagacagtgtatcacgaaaccgggcccggctgaaaaccggcgacactcagtcggcaaccgggcggccgcgattgcgcttgatcgccccacgcttcgtcttctcgtccatccgtcgccgcttcgcgcccagtgacggccgggtcgggcggcgcagcgggtcgcggtggcgggcctcggcgatcatccggcgcagccggtcccgcgcgtcctcgcgattgcgctcgcgactgcggaaccggtcggcgagcagcacgatatcgccctcggccgtcgcccggctgccggccagcgccagcaggcggcgccgggtctcgtcatcgcccacgaaccgcgccccggccacccggaagcgcagacggacggcggtcgacaccttgttcacattctgcccgccgggccccgaggccagcagatagctctcctcgatcgccgcctcgtcgaggcggacgttccgggcagcgcggtcgagatcatcttccctgaggctcatgcccccaaaatggccgcagggggtgcggcatgcaagtaatgccgcacccccacctgtcgtccgggacatgccgatgtcgtcaggcccgcaccgtctgcaggaagtcctccacctgccggcggagatcctcgccgttccgccccagatcgcccgcggccgagagcacctgattggcggcgaggtcggtttcccgcgccgccgcggtgacgctgccgatattacccgtgacctcgaccgtgccctggctcgcttcctggacattgcgcgagatttcgcgggtcgccgcgccctgttcctgcatggcggcggaaatcgcggtcgagatttcattcacccgattgatggtcgcgccgatctcttcgatcgcatgggccgagtcgcgggtcgcgtcctggatcgaccggatctgggcggcaatctcttcggtcgcccgcgcggtctgcaccgccagcgtcttgacttcagaggccaccaccgcgaagcccttgccggcctcgccggcgcgggccgcctcgatggtcgcattcagcgccagcagattggtctgagaggcgatgtcgttgatcagctgcaccacattgccgaccttctgcgccgcctcggacaggttcttcacccgcagaccggtggcgtcggcctgacgcaccgcctcgctgacgatgccgctcgactggttgacccggtcgccgatctcgccgatcgcggccgaaagctgctcggccgccgccgccacggtctggatgttctggctggcctgttcggtcgcactcgcagccgccgtggaccgccggctggtctcgtcggccgtgaccgtcatggtctcggcggtcgaccgcaactcggtcgcggccgacgtgaccccgttcagaaccccgccgaccgaggcctcgaaacggtcggccatgtcgcgcatcgcctggcgccgggcggcttcggccgccgcctgatcctcggcacgctgggcgatgttgcgccgcagatccccctgcatgcgggtcagcgccgtcgccagccggccgacctcgtccttctgatcgaccgtcaggctctggtcgaagcgcccttcggcaatgccgtcggcaaagccggcgcaggcgcggatcggccgggcgatcccgcgggcggcaagcgccaccaccaggatcgcgccaagcaccaccgcaagcccgacccccagcgagaccagcgtgtcgcgcgtcgaccgttcggccatatcgccgctcaacgcattgaccgaggcgagcgccacatcccgcggcaccgagatcaccaccgaccacggcgtggcagtgtcgccgaaacggatcggcgagaagacgtcgatatcgggatggccctgacggtcgagcaccgtcgcctcaccggcgcggatcacctcaagcccgtcggtccagctgtcgccggccgcggtcaccggctggccgatcgtctcgggcgcgccgctgtcggccacgatcagcccggcatcgctgatgatcgcaacccggcttcggccgtcatagagcgcgttcgacaccttcaccgccagcgcctggatgaaatccaggttgtagtcggtgccggccacgccgcggaaacggccgtcgatcatgatcggcaccgacagcgtcgccaggaagaccggcttgccctgcacgatatagggcagcggacccaggatgttctcgcggccggtctcggccgggcctatataccagccgcccttgaccagaccgttgggatgacggtcgctgctgtcgtattcgaccagcggctggatcgcgatccggccgtcggtgccacgggtccagtagggcaggaaacggccggtcgcatccgatccgtgctcgcggtcgccgcggaaggcggcatcggcgccatccagcgcatccggttcccaggccgaataggtgccgttcagcgccggatcctgcgccagcgcctggcggagcatcgtgttcagctggtcgcgccgctgcccggccggcgtgcctgccggaccatccgtggccagcaccgcgaagctgcgcgccagcgtccgggcagtatcgagcccggcttccagctgggccttgatcgccgccgcctcggttgccgcccggttttgcagcgccgccttggtctggccgtcgacgatcccgagcacgctctcggtaacatattcatgcgtgttgcgcgccgataccaggctgaaccccaccagcaccaccaccgtcgtcgcaaggcacagccccgcggtcagcgcgatcctggcctgcacgctggtcagccgccccgacagaacagacaccatctttccccctccacaccgcgcctgaatcaaatcctgatgtacaaagtattcgatccccgaaaatccgccttgatcgatgtcaaatgatcttcattaacaaatggttagcttaattcccaactcaaccgcacatgaataaaggaccgcaaatgtctttgcagatcatatgatttgatatgttcagcatgaatgcatgccagtggcaaaagtagcaagacgacgaaatgacataacactctttacgccctggtaaggtcgaaagtcgcactctgaagcgcacgttctcatgaatctccccgggacgcctccagatgaagctcgcacacaagatcctggcgccggtcgcgatccttgccgccatcgccatcctgatcgccctcgccggcatgattggcctgaaccggatgggtgatgccgcccatcgcatggccgacgattccgacctggtgatcaagacgtcggaactcagaagcgtcagccgggcgctgcagcgcgatgcgctgaacctgatcttcgagcccgaagccggccgtgcctcgatcgccagccgcttcgacagccgcgcccaggccatggaggcccagctggtggcgatcgaggccgtcgtcggcgaccgcgaccgccggttcatcgggctgcagcgcgaggtgatccgggccctgatccgcgtgcgggaactggcgctggcgggggagaccgatgctgcgcatcaggccttcatcaacggcgtgcgccaggccgagcgtgcggcatcggagctgaccgacccgatgatcgacgacggcatcgccgaggtcgcggcccagtccaccggcctggaagacacccggacctcggtcatgagtgtgatgctggccaccgccgtgatcggcatcctggccggcgtcctgctctcgagcctggtcgcgcgccgcggggtcatcgccccgcttggccggatgaccggggcgatggcgcggctgaaggcccgggattacggtttcgatctggccgatgccggccgcagcgacgagatcggcgccatggccgccgcggtcgcgaccttccgcgatgcgatgcaggaaaccgaccggctgcaggccgaacagcgtgccgccgaagaacgtaccctccgccgcctggcccgccgggccgagctggtgaaggagttcgtcgacggcatgaacggcctctctgcccgcctggccgacgaggcccggcagctggaaaccgatgccggcgcgctttcgggcgccgccgccgagaccagccggatgaccgccagcaccagcaccgccaccgaccgcaccaccgccaatgtccagacggtggcggccgcgaccgaggaactctcggcctcgatcggcgagatcagcgcgcgggcgaacgaaaccgcctcaacctcgggcagcagtgccaacgaggcccggcgaaccgccgatcaggtcggccagctgcgccgcacggccgaagagatcggccaggtggtggcactgatcaccgacgtcgccgcccagaccaatcttctggcgctgaacgccacgatcgaggccgcccgcgccggcgaggcgggcaagggcttcgcggtcgtcgccgccgaggtgaagacgctcgccacccagaccgggcgggcgaccgaagaaatccgcgccaaggtcgccgcggtccagaccgcaaccgacggcgccgtcgcctcgatcgagcgcatcgtcgggatgatcggcgagatcagcagcatgaccacctcgatcgcgaccgcggtggaagaacagtccgccgccaccggcgaaatcacccgcaatgtgcaggaagcggccaacggcaccgagcagatccgccaggatgtgcaggtgctggaccagaccgccacccgcacccacgacatcgccggccgggtcggcggcttctcgaccgaggtttcgcgccggtcgggcgagctgcgcgatctggttgcgggtttcgtcagccgcctgtccgaatcggaagcggcggcctgagcggccgggccatttcggccagccgccggacccgctccgccgtcgcggggtgggtccgcagcaggccgggcccctggtggcgcaggcggaagatcgcctcccaggggcccgaacgctccagcgccagcagggccctggccagcgccgccggatcgccggtcagccgcgccgcctccagatcggccgcgaattcacgggtgcgggagagcgccagctgcatcagccccacaagcccgggggcggcgatcagcagcagcaccgccgccaggggcacggtgacggcacccagcaggatcagtggcaggttcagggccagcagggcgatgccgagccaggccatcagcccggtgatccgccccagcccgtcggccagacgcatgatcttgaggtcgccattggcgatatgcgccagttcatgggccagcaccgccatcagttccgggggcgtcaggcggcgcagcagcccgtcggtgatcaccaccaccggcacgccggcatcgtccagcgcaaaggcgttgggctggcgcgccgggcaccagcagagccgcgggcgggcatggatcccggcacgggcggccagcgccgccagggcgtcgtggatttccggaagggccgcataggggatcgggcgggcgcgatgggcgcgcagcaccagcccggccggcaggcccggcagcagcagggccgcggcgacggcaccggccagcgcccacggaatgccgccggggccccagacgatccagctggtcaggcacagaaccagcgccatgccagcgaccagcagaaccgaccaggcaagattgcgcagaacctggcgtgtggttgccatccgtcacctccgcccgcgacgccacccctgaggggcatgctctcagacaggcgatctgggagaaggcgagaggcggatcaagagggggaagccggcgatccgcggcggggcgcgaagacccgggtctgccggcgcggcctggtcaggccgggcaggtcggcccccagcgcatcggcaagcgtcggcccgtcggcgctgatcaggcggctggcctctgcctcggcgcggccgatatggcgcagccgttccgggtgccagggggtgggggcaacatcggcggcatggcgcggcgtctcggcgcgccgccgatcgcgcaacagggcccggaccagggcgcgggccgcgcgggggtccagcccgtcgggccccgccatctgggggcgcggctgcgccatcggctggggcagcgggcgcttgcgcgcagccgcggcgatttctgccgccaaaccgtccggccgccgcgccctgggtgcctcggccggggccgcccccggccggccgacgatgcggtcggcgacctcgtcacgccggacccggcgtgagggttcccaccgcgccgggcgcccggggctgcccgccggcggcacatcacccgccgacgccagcccctggggcaccggcggcagcttcacctggggctgggcgggcggcaggggcggcggcacccggtcgcgggcggcgcgccgctcgatttcggccgccgccgcggccgacatgccgctgcgggtgcgctccgacaggccgcgcagttcgcggcccagcatctcaagctcgatctcgctgccgatgccgccgtcacgggccaggcgccaggtctccagcccgccgatcagcgcgttcaaccggtccagctccaggctgccgagcccagcccagaccgtttccatgaagcgctccaccacctgaggcagcggccggagcttcagggtcgctgcgtcgaccctgagcaggtcgggcgcgcgcggaccgacatcggtgacgacgaaaaccgccggcatcagccggccgcggccggctgcggcgaattgtccgagggccaggaacagcagggcgtgaagcttggccggggccaggacacggccgtcattgcgggccctctgcatcagccagccggcgacgtcgtggctgctctcgacagcgatccgcatggtctcccgcccctctgcagtttccgcaggcttgcccccttgcagggtcagtatagggtgcccaacttaaccgcgacttaaaattcgcagcgaaacgggctgacccggatgccggggctgccgcccgcccggcgtgacagtttttagaattcttctaaaaaggctcttgcgctgccccgcaccgactgatatacccggttcgacatcgattggaaccgttctaaaacgaaccgggcggttccaacgatcaagaccccgagttgccgcccccgggccggatgtccgggggcatcctccagaaacgagaggcaggatccatgctgaccatcggtgataagttcccgtcgttcaaggtcaaggcgaccgtgtcgaccgacctgaagagcgccttctcggagatcgacgagaacacctatgggggcaagtggaaggtctacttcttctggccgaaggacttcaccttcatctgcccgaccgagatcgcggccttcggcaagctgaacggcgagttcgaggatcgtgacgcggtcgtgctcggcggcagcaccgacagcgagttcgtgcaccatgcctggcgcgtccacaaggaagagctgaacgacctgcccttcccgatgctggccgatgtcagccatgcgctgtgcaatgcgctcggcatcctccacaaggaagagggcgtggctctccgcgccaccttcatcgtcgacccggacaacatcatccgtcacgtgtcggtgaacgatctcgacgtgggccgcaacccgcaggagatcatccgcatcctcgacgcgctgcagaccgacgaactgtgcccctgcaactggcagaagggcgaggacaccctcaaggtggcctgatcctgcggatccggtcggcggtgcgggatcccgcaccgccgacccccgtcttgcccttgcctgccccggcgtccgtcgcccctaccttccaccccccctttccccaccacccctttccatcctcccggacagccgcgtcgagccccggccggattgcgcatgcgcatagatcgcgcgcaatctgatcgtgatgaagatatctggctccgcagctttccacccgtcccaagagcgccgcgcctccggccgcgctgaagccccacccatctgaaatccccaggagagtcgagatgtcgatcgagcagctgcgcggcgcgcttccggattacgccaaggatctgaagctcaacctcggcaacgtgctgcagtcggagaatctgaccgcacagcagctctggggcaccgccctcgcctcggcgctcgccgcgcgcaacgccaccgtgatccgcgcgatcgcggccgatgccgacgcccagctcagccccgaggcgcagaaggccgcccgggccgccgcggcgatcatgggcatgaacaacatctactaccgctacacccatctggtgtcggacaaggaatacgcctcaatgccggcgaagctgcgcatgaccgtgatcggcaagcccggcgtcgaccatgccgatttcgaactgtggtcgctggcggtctcggcgatcaacggctgcggcatgtgcatggacagccacgagaaggtcgtccgcgacaagggcatcagccgcgacggggtgcaggatgccatccgcatcgcctcggtcgtccatgccgtggccgccaccttcgacgccgaagaggccctggccggctgatcccggccaccgcccgccccggtttcagccccccgcccgccggtgcccccgcatcggcgggcgggggttttttcgtccctgaaggttgacattcgcggccgaagccccaagtctgggacacgtttttcggacgaaccgctcaaggacaatctgtggcgcgacaatcccggccgatcaattcggcctgcatatgtcacgctcatgacacgtgaacctgccatgatcttccactagtctctgtggggatcgggcagtgatcgtctttgatcagctcgcccgaagctctttgacgctttggaccgtcggaccattgccggacatctttggcagtggccgcgttgctacacgtcgggttcctggcagacgccctgtcgccggaccgaacgtgcggggcccggcatggcccggctcacattctcgcgcaccggtgcgccccgtcttcccttcccgtccccgaccaccggcaacggtcccgcccccagcgggaaccggtccgtccgcgtcttcggatcataggaggatggagacagacatgtgcggcttcagcggcgagatcaggttcgacggcacgacggcggatgtcggggccgtggcacgcatgaccgccgcgatggacaggcgcggcccggatgcgtccgggatccacgcccaggggcggattgcggtcggccatcgccggctcaagatcttcgacctcagcgaacaggcccagcagccgatgatcgatgccgggctgggcctcggcctggtctataacggcgccatctacaattaccgcgaactgcgcgccgagctggaggcgatgggcttcgccttcttctccaccggcgacaccgaggtcatcctcaagggttatcgcgcctggggcccgaaggtcgtcgaccggctggccggcatgttcgccttcgtgctgtgggaacgcgataccggccgggtgctgatggcccgcgaccgcctgggcatcaagccgctctatatcgagaaccggggccgcacgctgcgcttcgccagcaccctgccggccctgcttgccggcggcggtgtcgacaccgccatcgacccggtggcgctgcagttctatctccagttccacgccgtggttccggcgccgatgaccatcctgaagggcatccgcaagctgccgccggccacccgccggatcatcgagcccgacggcaccgcccgcgacgagatctattgggcacccgattacggcccgcgcgccgatgaacgcgatctctctttccaggactggcaggcgaaggtgctcgacaccctgcgcaccgccgtccgccgccgtctggtcgccgacgtgccggtgggcgtgctgctctcgggcgggctggacagcagcctgatcaccgggctgatcgccgaggccgggcagaaggacctcaagacctattcgatcggcttcgacgccgccggcggcgaagagggcgacgagttccgctggtcggatgtcgtggccgcccatttcggcaccgatcaccatcagatccgggtctccgcctcggaaacgctcgaagccctgcccgattgcgtggcggcgatgagcgagccgatggtcagccacgacgcggtcggcttctacctgctgtcagaggcggtctcgcgcgatctgaaggtggtgcagtcgggccagggcgccgacgaggtcttcggcggctatcactggtatccgccgatgctggccgccggcgacgaggccgcggtcgagacctatgcccgccatttctgcgaccgcccccatgacgaatatctggggctggtgcggcccgaacaccgggtcgacgaggaccatgcccgccgtttcgtggccgagcatttcgcacagcccggcgccacgcgcccgatcgacaaggcgctgcgcatcgacagcaacatcatgctggtcgacgacccggtgaagcgggtcgacaacatgaccatgagctgggggctggaggcgcgcgtgcccttcctcgaccatgaactggtcgaacttgcggcccgcgtgccggccgagatgaaggtgaagaccacccccgacggccgccatctggcccagggcaaatatgtgctggcagaggccgcccgcgccgtgatcccccatgcggtgatcgaccggcccaagggctatttcccggtaccggcgctgaagcatctggaaggcccctatctggagatggtccgcgccagcctgggcagcgagggcgcccggtcgcgcggcctgttcgatcaggcggcggtcgaccggctgctggccgatcccaaggcgtatatcacgccgctccggggctccaagctctggcagctggccctgctcgaactctggctcgacacccacggcatccgcgggtgacccgaccatggccgacgcacccgcatccaccggtcccggcctcccccgccgctccgagatgaccagaaaggctccggtcgacatgacgcgccgccagaaccgcgacacccgccccgcgcgggatacccggctggatcgacgatccggcccctcgctcgccggccgccaggcccatggcaccgccttcagccgccaggaggcgacggtggacatgggctggggccggctgatcttcggccagaccttcgacgacaaccgccacctcgccgatgccatccgcatggaagaggaaggcaagcgcgatgtggcgctctatctggccgagccccatgtcctgctgtcgcttgccccgcaggagctgttcctcgacccgtcgcacacctaccggctgtggatggaccgctatcgcccggccccgccgcggcggcgcggcttcaccatccgccgggtgcgcacggccgaagaggtcgccgaggtcaaccggatctatgccgcgcggcgcatggtgccggtgcccgaagacatggcgctggccttccgccggtctcgcaccgtcacccagctggtggcggtggagacggcctccggggcgatcatcggcacggtgatgggtgtcgatcacgtccaggccttcggtgatccggaaggcggctccagcctctgggcgctggcggtggatccgcaggcctctctgccgggggtgggctcggcgttgacgctgcatctggccgggcatttcctcgcccgcggccgcgcctatatggatctctcggtcatgcatgacaatgccgaggcgatcgcgctttacgagaagctgggcttccagcgggtgccggtgttctgcgtgaagcgcaagaacccgatcaacgagaagctgttcatcggcccctcgccctcggacgcgctcaacccctatgcccggatcctggtcgacgaggcccggcgccgcggcatcgcggtcgaggtgctggatgccgcccgcggctatttcaccctcaccttcggcggccgcgcgatcacctgccgggaaagcctgaccgaactgaccagcgccatcgccatgagccgctgccaggacaagcgcgtcacccgcgacgttctggccgaggcggggctgtcggtgcccgaacaggtcaccgccgccgacctcgcccgggccgaaaccttcctcgccgcccatggccgggtggtggtgaagccggtggatggcgagcagggccgcggcgtgcaggtcgacatccgcgatgccgacaccctggcccgcgcctgccgcgccctgtcggaacagggtgtggcgggcgtggtcgaaaccttcgtcgagggcgaggatctgagaatcatcgtgatcgacggcgaggtggtggcggcggcgatccgcaagccggccgaaatcaccgccaacggcaccgataccgtgcgcgcgctgatcgaggcgcgatcgcgccgccgggccgccgcgaccggcggcgaaagccggatccccatggatgccgaaaccgagcgtgcagtgaccgaggccggctggaccatggacgacgtgccgccggcgggcgaggtgatccgggtgcgcaagaccgccaatctgcacaccggcggcaccattcacgacgtcaccgccgagctgcatccggccctggccgaggcggcagtccgcgccgcccgggcactggacattccggtggtcggcctggacttcatggtcccggccgccgatcagccggattattggatcatcgaggcgaacgagcgcgcgggccttgccaatcacgagccccagccgaccgccgaacgtttcatcgacttcctgttcccacagacggccacccgccggcgcagcatgccggcccaggccgaggagacggcatgaacgacgcgacccgacgccatcgggatggacatggccccgaggccggcatccgcatcgatcgcgactacctgctcgacaccctgctggccctgctgaacacgcccagcccctccggctataccgacggcatcgtccacatggtcggccaggaactggagcggctggacatcgaattcgatctcacccgccgcggtgccatccgcgccgtgctgcgcgggcgtgaacgccatccggcccgggcgctggtcgcccatctggacacgctgggcgccatcgtgaagcgcctgcagcccaatggccggctgtcggtcgtgccgatcggccactggtcggcgcggttctcggaaggcgcccgctgcaccatcttcaccgatgacggccgccatcgcggcaccatcctgccgctcaaggcatcgggccacaccttcggcggcgagatcgacaagctgccggtcggctgggactatgtcgaactgcgcgtcgatgcgctggtcgacaacgagcgcgatctcgaagccctcggcatccgggtgggcgacatcatcgccgtcgacccgaaccccgaaatcggccccaatgatttcatcaacagccgctatctggacgacaaggccggtgtcgccaccctgcttgccgccgccgaggcggtgcagcgctcgggcgtgaagccgccggtcgacacctatctgctgttcaccatctcggaggaagtcggctccggcgcctcgtcgatcctgcatggcgagatcgccgagatggtgaccatcgacaacggcaccaccgccccgggccaggccagccgcgagaccggcgtcaccgtcgcgatgatggacagcgccggccccttcgacttccacctgacccgcaagctgctggccctctgcgccgataacggcatctcgcatcagcgcgacgtcttccgccattaccgttccgacagcgcctcggccatcgaggcgggcaacgatctgcgcacggcgctggtctgtttcggcatcgatgcctcgcatggctacgagcggatccatcgctcggcgctcgacgatctggcgaagctcgaagcgctctatatgttgagcgagccgaccttcaagcgcgatgccaagccgctcggcccgctgaccggcttcccggtgccgcccgactgggacgaggaggaaacggccgaacgcctcggcacccccgccccggcagagaaagccgccgagccccacaagtgacggccgtaagatgacgggtgcacccgacgccccgccctttccccaagggcggggcgttcttatattccgaaacaacacttctgccatgacgaattgccgggcgccccggcttgatccccatcgatcgccattggtaggatgcgacagaaaaattttccggcgtcgcgccgcagaatgtgccgcggcgcagaacagacgggatccctcagatgaccatcatgaacggcttcgccgatgccatcggcaacacgccgctgatcaagctgcgcaaggtgtcggagcgcaccggctgcaccattctcggcaaggcggagttcatgaaccccggcggatcggtcaaggatcgcgcggcgctctatatcgtgcgcgatgcgctggagcgcggggccctgcgcccgggcggccggatcgtcgagggcaccgccggcaataccggcatcggcctggcgctggtcggcaattcgatcggctgcaaatcgaccatcgtcatccccgagacccagtcggaagaaaagaagcagaccctgcgcatgctgggcgccgatctggtccaggtgccggccgtcccctacaaggacccgaacaattacgtccgcgtgtcggagcgcctggcgaacgaactggccgagagcgagccgggcggcgcggtctgggccaatcagttcgacaatgtcgccaaccgccgcgcccatttcgagaccacgggccccgagatctgggagcagaccggcggccggatcgacggcttcgtctgcgcggtcggcaccggcggcacgcttgccggcatcaccatggcgctgaaggagcgcaacccggacatccagtgctggctgggcgatcccatgggttcggcgctctattcctggatcaccaccggcgagttgaaatcgtcgggcagctcgatcagcgagggcatcggccaggggcgggtcaccgccaatctggagggcgtgagcttcgacggcgccgtgcaggtgaccgatgaagaaagcctgcccatgctctacgacctgatctcagaagaagggctgctgctcggcgggtcttcggcgatcaatgtcggcgcggcggtgaagatggccgaggcgctgggccccggccacaccatcgtgaccatcctctgcgacagcggccagcgctataccagcaagctgttcaacgccgaattcctgcggtcgaagaacctgccggtcccctcctggctggaccgctgagccgtctcgcggcaagctccggtttcccccgttcgaaaccggagcgtgtccatgcctgccaccgatcctgtcttccgtaacgatccctacgcccgaagctgcaccgcccgcgtggtggccgtcaccgaagacggcggggtgatcctggaccggagcgtcttctacccgaccggcggcggtcagccgggggattcgggccggctgaccgatgcggtcggccgggtctggacggtgaccgaggcggtgaagggccggaaacccgagaccggcggggagcccgacgagatcatccatcgcctggacgcgacaggcgccgaggcgccgcccgccatcggcaccgaggttaccgccgaactcgactgggagcgccgccacgcccatatgcggctgcacacctgcctgcatctgctctcggcgatcgtggtggcgccggtcaccggcggccaggtcggcgccgatcgcgcccggctcgatttcgactggcctgatgccacactcgacaaacaggcgatcaccgacgcgctgaacgatctgatccgggccgatcatgcggtcgaaaccgactggatcaccgatgccgagctggatgcggcgccgcatctggtcaagaccatgtcggtccagccgccgcgcggtgccggccgggtgcggctggtcaggatcggcgcgggcacggccggcgccgacgcccctcatgtcgatcttcagccctgtggcggcacccatgtcgcccgcgccggcgagatcggtgcggtagaggtggtgaagatcgaaaagaaggggcgccagaaccggcgggtggtgatcgccttcgccggctgatcaaccgacggccgcggtgccccgcgccacggccgccaactgcggatcttcaaggaattcggcattgcgcgcccggatggcggcgccgtcgtcgtcatagaggaagggcaggcaggcgaagcggcggccgcgggtcacggccagggcctcgtgcagcaggctgcacgagaacaccaccgcgccgccggtgggcgcccgatagcggcggtcgccgaattcggggaagcgcagctcgccgccctcataatcttcggcattcaggttgatggtcaccgcgaagcggcgatgggcggtgccgcgggtggtgttgtcgcggtgcgggcggaaatagccgcccgccccgtcgccgtcgtaacaggcgacgatatagcgctcgatccgcgtcgccttgtactggaaggccttctgcagctccggcagcagccggcgctcgatccgcgcccggatgccggcgcgcagcgtctcgtcttcgatcagacagtcggcgcggcgcttgtgaccgtaatcgcgcatctcgaccgtgcggccgccgacctcgcgcatgaagccgctctcttcgccgcccagccggtcgtattcggccatcagccggcggcagaaggccggctcgaagacgcgcggcaccgccagcaccggcgcccagggctggccggcatcgtcggccggcgccacggtcaggatccgcccgtcttcggcgaccacactgccatgggcggccggcgccggcagttgcgccaccagatccagcagccgggccgtgtcttccatgccgccggccgcaaccacacgcagggtggggtcgagcagcagccagtagggccggtaggcgacatggccgctgcgcggatctgccgcaggatcgatcgcccgatagcggcgcgagatttcgccatcggcatccgcgaaggcatagaagcccggcagatgcagcggcaggcgcgcaggctggccgacccggtcggccgcatccagcgtcacgaagaaacaggtccgcccgggatcggcaaacagcggcgcagccccggcgatcgtcgccacggcggcctgaagctgcggcaccgtagccgatcccagcagcaccagcaccgaccagcggccggcaacggtggaaaaggcgaagttcggattgccggcacaatccccctggaaccagggcaccgggtcgccgggcaggaagggtaaagtacgggccgcggcaacagcggtgtcggacatggtgcaggtctccgggggggccgtgaacgtgtgacgttcagaatgcaggagcgtcccatcgccgtaaagcgggtgcaagagccgcgggcggctgtggcggtgccgccgcgggtccggtatcatgtggccgacgaggtggcgggacgcagctccgcacgggccgcgacacctgcccaagattgattgagcaagatcagacgagaccggcgccggccggggtcgggccaggcgccatcgaccgatccggcccgggaagaaccacggaggacgctgcccccgatgccctacgccaagcccgacgccctggtcagcaccgcctggctcgccgaccacctcgatgcgcccgatgtgcgcgtcgtcgatgcgtcctggtttttcccgcaggagggccgcgatccgcgtgccgagcatgcgaagctgcgcatccccggtgcggtgttcttcgacatcgacgagatcgccgataccaccagccatctgccgcatatgctgcccgcgcccgagaagttctcgtcgcgggtccgccggctgggcctgggcgacggcgtgaagatcgtcgtctatgacgcgatcggcctgcgcagcgccgcccgcgcctggtggatgttccgcgtcttcggccatgacgatgtcgcggtgctggatggcggcctgcccaaatggctggccgagggccgaccggtggtcgaggaacgccccgaaccgccgcgggaacggcatttcaccgcccgggtcaacaacctgctggtgaaggaccgccatcaggtggcccgcgccaccggcgacggccgcacacagctggtcgacatgcgcccggccgaccgcttccgcggcgaggcgcccgagccgcggccgggcgtgcgggcgggccatgtgcccggcgcgctcaacctgccctataccgacctgctcgaccccatgtcgggcacggtgctggatgccgaacggctggaagcgcggatcctggcggcgggcgtcgatccgtcgaagccggtgatcgccatgtgcggatcgggcatcaccgccggcatgctggcgctggccatgtatctgctgggcaagcgcgacgtgccggtctatgacgggtcttgggcagactgggggtcggacgaaagcctgccgatcgaacggtgatctccgcccggaccataagggtgccgaccggcaccgcaccggctgaactcatggtgccggccagaataaccgcaccggcgggcaaagccgccgccggtgccggtgctcgtgtcccccgctcacgctgccaccgaccgcaggccgcatccggcctgcggcggttcgtcttcgttccgatgcccgcaagggccgacggaacctgcggtttccgataccgcccgtccgaccggcctggtctgacggctggcctgaccgggtcgcggggcgatggtcgccaccgcgcgtggagaaagcgtcgatgacggaacttgtcgtcacctacttcgaaatgacctcgccgccggaccgccatggacgtggcaagctgccctcggggcagtatgccctgctccgggcctggaacatgccggtccatttctaccgctatctgcatgccggcgcccgggcaaacctgcttcgccccgaacgcctgggccttgacgacgaggccatcggccagattctcgccgacgagaagatcgagatcttcgtgctctatgtcgccggcgtgcctgcgggcttcgccgaactcgaccgtcgggccgaggacgattccatcgaaatcgcgtatcacggactcatgcctgaatatgtcggccgcagcttccgcggcttcctgctcgaccaggtggtggacatcgcctggagctatcatccgacacggctctgggcgcgctgctccaatctggaccaccccaaggccatgcagacctatcagcgcggcggcttcggcgtgttccggcaggaacgcagccccatgccggccgatctggccctgaccggcagcgatcgcggccgcaatgccggcaccggcggcctgctgaccgaggggacggatctgtccaacatcgtgcccggcccggtgggggaggccccgacatgaccatcggcgaaaccttccagacgggtcctgccccggcgggccgccgggtggtggtgatcggtgccggcccggccggtctggccgccaccgaaaaactgctcgcccacggcctccagccgatcgtggtcgcgccggccgacgactggggcggccgcgccttcgtcggcgcctcggaagccgatgccggctcccccgccggcgatgtcgattttctgcgcttccgcggccgcgccgcccgcatccgcagcgccgtgcgcctgatcaccggccatgtcgcctgggccatcgaggatggcgcggtgctgctggccggccgcgacggcatttcgcgcctcgccttcgaccgtctggtgctcgccaccggtgccgagacccggccgatcccgctgcccggcggccagctttccggcgtcaccgatctgggcacgctctaccgcgcccccgaacaggccggcaacaccaccatcggccagcgcccggtgctgatcggcggcggccccggcctttacgaggtcgccgaccggctggtgcgtgccggccgccggctgaccgcggtcatcgacctcgatcccgacccgtggcggcgcggcccgatcggtgccgaaagcggccgccctggcaccgggctcggccgctggctacgcctggtaggccgcgacgtgccggtcctgaccggcatcacccgtctcagggtggaaggcgacggccatgtcgagcggatcatcgccaccgacggccgcggagagacccgcgacatcgtctgcgacaccgtgggtgtcggccatggcatgatcgccgatcaccgcctgctcgcctcggccggcgtggcgctggctttcgatcccgaccgccgggccttcctgccccagctggacgccgaaggccgggtgccggaatgccccgggctctatgtcgcgggcgaggccggcccccatccgcgcccggcagtcgccgaccggcttggtgctgcggcagggcttgccgtcgcctcggatctgggcattgcagaggcccggatcgaactggcgcggatgacgccgctgctctcgcacgaccggcgcaccggtgccgagatcgcggtcgaccatccctaccccaccggctgggttctggcccaggatgacgacgccccgatcgatccggcaagcgggctgacgctcggccggctgaagcaggtggcggcgcgccatcgcctggaccggctgggccgggccgcggcggtgctgggcgtcgatctggcccgcgccggcggcctgggccgggccggcgttctggccgaactgatcgccgccctcggcgccctgccgctcgccggcctcggcaccagccagggcgaaagcccggccatgcccgtgccgctgggcatgctggccgcagccggacggggacaagtcaacgacatcacggagcgtgcaggatgagccggctggtggattgcgacgtcgtcatcgtcggcggcggggtggtcggccttgcagccgcgatcgggctgcgccggcaggccttccgggtcacggtgctggaagcgaccgccggtgccggccgcgatctggacggcatctgcgggctgatcggcaccgagggccgcgccgcccttgcccgcctgctgggtgcggacgaagccgcggccctggtgaccacggcgacggtgcccgaaggcgcggccgacaccctgcccgaaggcctgggcgttctggcccccggcctcttcgccgaaacgctcagccgtcgcgcccgggaacggggcgtggatctgcgcgagggggtggccgcgatcggggccgaggaaaccgaagccgggttccgcgttgcctgcgcccccggctatggcatcgccggccggctgatggcgatcgccgccggccccgcccgcgatacggccggcagctggctgaaggccgatctgccggtccgtccggcggtgtcgctgcgcctgaagcttcgtcccgaccggatcacccccgaaacctgccgcagccggcccagtgacgtgatgctggccgaagacggccgggcggtgctgcgcggtaccggcgacggcggctggctggtcgccctgcacgaagacgggtcggtcgcgacctccgcctcgggtgctgcggcccgcgcagccgccccggccgccccgctgtcgcccgacgaaatcgccgccgccgccgcccgggtcaccgccatcctgcccgacacggccgggcagttgttgacccgcatgtggcgggtggccggtcaggcgccggatgccgccgccatggccggggccgtgcccggccgggcggggctgttcgtcgccgatggcggcggcgactgggacatgggcgcggcgctgatcgcgggcgagcgtctggccgggctgctcgccgcctgaccttgtcaggatcagccgtaaaggaagggtcgggccagatcgaccacctggtccggcgcttccatcggcgccagatgggcggtgtcgagcgtgacgaaatcgcgggtgcccggcatgtgccgggccgcgatcgcagacatgttctgaaacaccggatgcgaccgggcggtcttggccaccagcaccggcacatgctggtcgtgcagcagcaggaaggggtcgcccgccgggtcgccgctattggcattgcccatggcacgcgcgatcggccccagaatgtcggcctcggtttccggctcgcaggccagcaccagctcggcgccgtcgcggcggaacccccaatccagataaagatccagcgccgccggcgtcaccacgtcgaagggcgggcgcgaggcgaagcgcgcccgtgcggtctcgcggtcggtgaagcgcggcttgcgccgaccggcggcctccaccaggccacggccgaaggcccagccttcgggctcgggttccactccggcgcccggttcggaaatcgtgggctcgatcaccaccatccgccggaacagctcgggccggagtgcggccgccagcagcacatcggtggcgccggccgaatgggccagcacgtcgatcccgcgccagcccatggcatcggccagcgcgatcagatccaacgcgaaggcccggaacccgtaatcgccgggggtacggcccgacgccccatggccgcgacggtcatagctccacacgcccgaggcatgggccgaaaggttcagcgccaccggctccagcgtcgcgccgcaatagccggtgccatgggtcatcagcaggggccggccggccggatcgccgccgggccaggactggacatgaagaaccgggccggaaccgggatcgaaccgtccggaggtgaagctgcccgaaagcggggacccttcggcagccatgccgggctcggccggcctgtcatcaaccatggcgcgcatgcacttagtatcgcccgaagccggatggctgatcaagcgtcggaaaattctcccgtctcttcaaagacaaacccccggcctggaacaggccgggggtctggatacagccagaggttgcagatcgctcagtgatgcaggatctgccccaggaaggccttggtccggtcgttctgcgggttgaggaagaattcctcgggcacgttctcttccacgatctcgccgcgatccatgaagatcacccggtcggcgacggtgcgggcgaagcccatttcatgggtcacgcagagcatggtcataccggtctcggccagctcgatcatcacgtcgagcacttccttgatcatctcggggtccagcgccgaggtcggctcgtcgaagagcatgaccttggggttggtgcacagcgagcgcgcgatcgccacgcgctgctgctgaccgcccgacagctggcccggatatttgttggcctgatccggaatccgcacgcgctccagataggacatcgccgtcgcctcggcttccttgcgcggcaccttgtggacccagagcggcgccagggtcaggttctccagcaccgtcagatgcgggaacaggttgaagtgctggaacaccatcccgacctcgcggcggatgttctccaccgccttgacgtcgttgctcagctccacgccgttgacgacgatgctgcccttctggtgttcctccagccggttgatgcagcggatcatcgtcgacttgcccgaccccgagggtccgcagatgacgatgcgctcgccgcgcgcgacatccagattgatgtcgcgcagcacgtgaaactggccgtaccacttgttgacgtgatccagtcggatgatgctgtcggcaccgcgggcagaggcgacccgcggcccggcggcctcgggcatctcgccggcggccatgtcggtctgattggtcatcggatcgatccttccctcaacgatgggcaccgcgacccagataccgctccagccactggctgtagcgcgagatcgcgaagcagaagacgaagtagaccagcgccgcgaagacataggcctcggcgaaataggtccgccagggcgcgtcgttcagcgccgcacgggtcgccagcatcaggtcgaagatgccgatgatgaccaccagcgaggtgtccttcagcgtcgacaggaacgaattcacggtcgacggaatgctgatcttcagcgcctgcggcagaatgatcagccgcatcttctgccagtagccgaggccgagcgcgtcggccgcttcgtactgccccttggggatggcctgcaggccgccgcgcaccacctcggccagataggcggccgcgaacatgatgattgcgatctgggcccgcagcagcttgttgatgttgagcccttccggcaggaagagcgggatcatgaccgaggccatgaacagcagcgtcaccagcggcacgccgcggatcagctcgatataggtcaccgacagtgccttgatgatcggcaggttcgaccggcgccccagcgccagcagcaccgcgatcgggaaggcgatgccgcagccgaagaccgacagcaccagggtgatcatcaggccgccccagagccgggtctcgaccagcggcaggccgaagacaccaccccacatcagcaggcagatcagcagcagcgccgcgatccacacatagaccagcttccggctccagaacttccggtagccgctggcggcgaccagggtcacgaagatcaggatggaggcgagcggccgccactgttcctcgtaaggataggtgccgaacaggatcaggcggtacttctcgcggatgaaggcccagcaggccccttccgccgccttgcaggcctcgggcgcagcacggccccagaccgcatcgacgaaggcccagtcgatcagcccgggcagccacgaaatcagcgcccaggcgatggccacggtgatcagcgcgttgtaccaggtgttgaacagattgccgcggatccaggcgatgggtcccaccgtcgccgcgggcggccgttctgcggccgtcttttccggtatggtctgagcggtcatcggcctagcgctccaccagcgcgatgcgcttgttgtaccagttcatgaacgccgagatcgacaggctgaccgtcaggtatgccagcatgatcagggcgatgttctcgatggcctgaccggtctggttcagggtcgtattggccaccgacacgatgtccggatagccgatcgcgaccgcgagcgagctgttcttggtcaggttcaggaactggctggtggtcggcggcacgatcacgcgcagggcctgcggcaggatgatcagccgcatggtgacgccgggcttgaggcccagtgcggcagccgcttcccactggcccttgccgaccgcctgaatgcccgaccgtacggtttcggcgatgaaggcagcggtgtagagcgtgaggcccagcgtcagcgcggcaaattccggcgagaccgagacgccgccctggaagttgaagccgcgcaattccggcatgtcgagcgcaagcggcgcgcccatcaccgcccagaccgcgaccggcaggccgatcagcagggcgagcgaggggatcagcgtcttcggccggtcgccggtcgccgcctggatcctgcgggcacgggccagcaggaagcgcacggccaggatcgcgacgatgagcgcgatcagcgccccccaccaggcaggatggtcggccggggccggcatcttgaagccgcgattgctgaggaacacgccctcgatcggctgcagcgcctggcgtggcgccggcagaacctcggtgatcagcccgtaccagaagaacagctgcagcagcaccgggatgttgcgcaacgtctcgacatagatcgtcgccagcttggcgagcagccagttgctcgacaggcgggcgacaccgatcaccacgccgatcagcatcgcgaatacgatgccgatcagcgacaccttcagcgtgttgaccacgcccacccaaagggcacgggcataggtgtcggtcgcattgtacggaatgagagactcgccgatcgcaaacccggcctcgcggctcagatagtcgaagccggtctggatgttgcgggtggcgagattgtgcagggtgttgcccaccagataccagccgatggcaatcacgattgccatggcgatgatctggaacaacaccgcacgcacgccagcgtcgttcagcatcgaacgacggggcggcgtgccgtccggggcggaggtgcccggacggcggctggtgtcggtcatcggctctggaagcccttcgctcgtcgcggatgcgttacggcggccggggtccaccggtggcacatcacgaacagcagcccgagacggccgagggggccgtgatcagccgatcacgccccccctcagacctgttgggtcgccggccctcggcggtcgccggcgccaccatgcaggcgatcagcggatcgggtcggcgtacagcacgccgccgtcgctccactgcgcgttcaggccgcgctccagcttcagcgggctttcggggccgacattgcgcgagaagatctcgccgtaattgccgacctgtttgatcgggcgataggcccactcgtcgtccaggcccagcgtctggcccatgccgggcgaggtgccgaggatgcggcgcacgaccgggttctcggacgaggacttcatctcgtcgacattcttcgacgagatgccgtattcctcggcctcgatcagggcgttgcggacccacttcacgatggtgaagtactcgtcgtcgccacgacgcaccgccggtgccaggggctccttcgagatcgcctcgggcaggatcacgtgatcttccgggttctgcgcgttcaccgaccgcagcgccgcaaggcccgagatgtcggtggtgtaggcatcgcaccggcccgagaaataagccttgtaggattcctcgaagctctcgaacaccaccggctgcagcttcatgccatgggcacggaagtagtcggtgaggttgagctcggtggtggtgccggactgaacgcagacggtggcgccgtccagttccttggcgctgctgacgcccgcggccttggtgatcaggaagccctggccgtcgtagaaccaggtaccgacgaagaacaggccgagcgaggcgtcgcgggtcagcgtgttggtgctgttgcgcgacaggagatcgatttcacccgactgcagcgcggtgaagcgcgcctgggccgacagcggcacgaactggaccttttccgcgtcgccgaggatggtggccgcgaccgcacggcagaagtcggcgtccatgccgctccagcggccggtgctgtccggcgccgagaagcccggcagaccggtgttcacgccgcagcgcagcgtgccgttcttcttgatcgcgtccagcgtcgcgccggcatgggcgggcgcgccaagcgccgcgacggcgacggtagccgcaagcgcggccacgaaggtcttgatcgacatgtgtatcgcaaagcccctcatctgcaggtcgatgccgcctgatcggcggactccggacgcacacatgcagcccccagggcccgcgatgcaaaacgtccgtccgacatgcgtcgtttcgagcggagcacggttgtccggcggccctcccgccggatccgcggagcgcgcccccccggacgcgttcctgaaagctccacatcttcccctgttcgttggtagcacaccggtcaatcgtcatgcaagcgtgcgccctgaggcatcgagccgggttgtcagcggcggctgcgcgcgttgaaatgcgcccgacggcgcaaggccgcgccgaatgcacggatcgaggagagccggaaccatgtccgacgagacgcgtcccgacgcgacaggggcacacaggaacgaagatccccacgggatcgacacccggatcgttcacgtcgggcgggatcccttcgccaatcacggcatcgtcaacccgccggtgcatcacgcctcgaccgtgctgtttcccacactcgacgcgctggtgaaggccgcggccgaccccacccgcggggtctattacgggcgctacggcacgccgatcacccatgcgctggaagatgcctatgccgagctggcgggcggtgcgcgcggcatcgcgctcgcctcgggcaagacggcgatcctggcgatgcttaccgcctttaccggtgccggcgatcatgtggtcgtgctcgacaacgtctacgaaccgacccgggcgctggcggaccagttcctcggccgctacggcgtcgaggtcacctatgtcgacccgatggcgggggctggggttgccgatcatttccggccgaacacgaagctgctgatgctggaagcgccgggttcgctcaccttcgaagtggccgatctgccggcgatgatcgccgcggccaaggccgcgggcgtgcgcaccgcgctcgacaattcctgggcgacgccgctctatctgaagccgctcgccatgggggtcgacgtggtgatggaggccggaaccaaatatctggtcggccattccgacgccatgatgggcgttctgtcggccacggaagaggcctttccggcgctgcgccgggcggccagcgagatcggcgcccctccgggaccggacgactgctatctggcgctgcgcgggctgcgcaccctgtcggtgcgcatggcgcggcaccgcgaaaccggcctggcccttgcccgacacctggccgggcacgacatggtgcgtcaggtgctgcatcccgccctgcccggctgcccgggccacgaggccttcctgcgcgacttccaggggtcgagcggcctgttcgcggtggagcttcagccgggcagccgcgaccggatcgcggcgatggtcgaccacatggccctgttcaagatgggcttttcctggggcggctatgaaagcctgatcctgccggccgacccgcgccgggcccgcaccgccacccgcgaccgctggaccggccgcggaccactgctgcgcatccatgccgggctggaagacccggccgatctgatcgccgatctggacgcgggcctcgcccgctatgccgccgccgccgacgcctgacgaacgggcggcggcaggcggcccccgagacgagggagacgtcatgaccgccgccattcccatcgccccggctgttcttgcgctcggccttggcctgagcctcagcctggcaggccccgcagctgcaaccgatccggcacccggaacccggctcagggtcgatgccgaccgcctgccggccccgggcaatgccccgagcccggccaattcgccgcagacggtcgaccggcccgcggccgccaccctgcgcgttcccgacggcttccgtgccacgctcttcgccgaggggctggcgcatccccgggtcatggcggttgccgccaatggcgatgtcctgctggccgaaagccgggccggcaagatcaccctgctgcgcgacgcggatggcgacggccgggcggaggtccgcgaaaccctgatcgacggcctggcccgcccgcatggcatcggcttccgcgagggcacgatctgggtatcggacaccaacggggtctggcgctggccctatacgcccggcgacacccgcatcaccgccgaacccgaagccgtgaccccgcccgacgctctgggcagcgccggtggtcactggacccgcggtcttcaactcgatcccgaaggggaagggttctgggtctccatcggctcccgcgggaatgtgggggtggagcccgagccccgggcgaccatccgccgcttcgacgggccgggcgatggcggccacagcttcgcgaccgggctgcgcaatccggtggggatggcgatccaccccaagaccggcgcgctgtggaccgtggtcaacgagcgcgacgggctgggcgacgatctggtgcccgactatctgacccgggtccgggagggcggcttctacggctggccctatggctgggccggcgccggcggcgacccggtggtccagcccgggctggaggggcaggacgaaggccggctggcccggctgatcacccccgattcgcgttttcaggcgcattctgcaccgatcggactgacgttctacgatggcacaatgttcccggaacgatacagcggcggtgcctttgtcgccctgcgcgggtcctggaatgcggcagagccccgcggctatgtcgtggccttcgtgcccttcaatgccgatggcgcaccggcggatggcggggtctacgaggttttcgcttcaggtttccgcctcgatgacggcgggcgtggggagcctgcgcaggtatggggcaggccggccggagtggcggtagaccgcgccggcgccctgctgatcgccgacgataccggcggcacgctttggcgtgttgtcacaacgggaaactgaccggattttcaagctgattgcgcagtgatgtgccggcggcatggcacggagcttgccagaagagaggcaaccgaaccggatggttcgccccttttctcgagcgagaccccccatgagcgcgctgatcggcattctgaacggcaaaccggtcggtgaccgtttgcattctgcactggacaagctggacccggcacgcatcgtgcggcgtgacacccgtatgttcgcgacccacggtgccgccgctggtctggcggcgatcgggcccgagattcccgaacacgtcgccgcacgccaggatgtcatccgccccgatgcgcggctgatccggctgggccagacgacgctgggtatcgtgggcccggcacccgcgatctgccggcttggcctgggcgacggcgcggtggagccgacctccgccgatctgcgccgcaacatcgccctggcggcgctgctggccgatctggaccggcccggccaggatacggagctggcactgcgccggctgatggaccgcaccggcggcgacatgtccttcaccctgctgatcgacgaggatccgcgccggatgttcgtcgcccgcggcgagacggcgctgtgctttgcggcaggcgatcacaccggcctggtcgccagcgacgaacgcctgctgagcggagcggatccggtgtcggtggggctccggcccggcgatgtcgccaccctctcggccgaccgggtgcgggtcgccgatgcctgcggccgggtgatcgcccgccgcatcggcccggccgcccggccggccgatgtgccgccgatgccggctgccggccgcgatcttaccgcacatgatctggatcatctggcccatgcggtgcgcctgggggccgggctgaccgcgccggatgcggcaccgctgccggtgtcggctgcggccggcatccatggccgcatcgccttcagcgcagccgccccgctgatgccggccgcagccgcagccgcggatctctggcggcgctgctatgggctggaggtgatggtccggccgatcgaagacggcgcccgcccctatctgccggtcgatcttgtgatcatcctgccggacccggccgatctggccggcgggacggatctgccgcgccggctgcgccagggcggcgcgcgatcggtgaccatgctggtggccgatgccggtgccggccccgccgcttccgggctggatgccgtctggcgcctgccgctgccgcgcgaatacggcgtggcccccacgctttcggccctcggcctcatctcgggtctggccgccatcggctcgcgcatcgccgccctcggcaatggcgccccccggccgcggcccgggctccatgatgcgggcatcgccccccgggtcgtcgcccgcgtgctgaacgcgaccgccgaccgcctcgccgcgccccagccggcggcctttgccgaggcggcgacggcccagatcgaccggatcgccgcgcgcatgatcgcgagcggtcagcgccggctggatctggagctggcggggccggtgctcgacccgcgtgtctcgggcgggatggccgagcttgcctgcacgctcttcgccgaaatcgcgcaggtgatctgcctgccggcgcaggaccatgatccgttcggccacccgtcatcgggggcggcacctgcgcgcgccctgccatcggcgccacgcctcgatcccaccacggcgatcggcgcggcagccggcagcgagaacgccaccacggcggccgggcttgccggtgcgatgatcctggccgccgcaggggcgatgcgcactgcccatgccttcgcccgggccagtggcgccacgctcggccgtcctcgctgcctcaccggtctgcgcggcagctgacgccgaccggatcagggatcggtcggcgcctccgaccaggcctgacgcttgcgatagatggtggaggcgctgatgccgagcagggcggcggcccggggcacattgccaccacaaagctcgatcgcgcgttcgatcgccatccgctccacctgccagagcggccggatctcaccctctgcaccatagatgccgggagtgtccggatcgcgcccgccgccgacctcgtccacctccccatccgcgaccggttcgaaatccagctcgggcggcggcgcgccggtcgtcgcgggcttgagcaatcgcgcctctgcctcgcgcagctgggcgggcagcatgtccagggtcaggacctccccgtcattcagcaccaccgcgccgtgaagcacgttgtagagctgacggatattgccgggccagcgataggccgcgagcgccgcctcggctgcagcgtcgatcctgcggaagcccttgccttccagggacgccagatcgtccagtagatggcgggcgatcagacgcacatcgtcgccccgctggcgcagcggcggcaggtggatcggcaccacatgcagacggtagtacaggtcctcgcggaagcggccggcctccacctccaccagcgggtcgcgattggtggcggacacgatgcggatgtcgacccgctcggtcacgcccgagcccaccttctggaaggcgccggtctgcaggaaacgcagcagcttgctctgcagcgccagatccatctcgcagacctcgtccaggaacagcgtgccgccatgggcgcgggtcgccgcaccgtcgcggtcggtatgggcgccggtgaaggcgccgcggacatggccgaagatctcgctttccatcagatcgcgcgggatggcggcgcagttgagtgcgacgaagggtccgcgggcgcgcgggctgcgggcatgcagcgcctcggccgccagctccttgcccgtgccgctctcgcccgtgatgaagaccgaagcccggctttgtgccgccccttcgatgatccgatagatgccctgcatgaccagcgaccggccgatcatgccgcaataggcttcacgctcgccgatgcggtcgaccagccgggtgagcgtgcccagcgccagtgcgttgcgcaccgtcaccaccagccgttcgggcgggaaaggcttcaccaggaaatcgtgggcgccggcgcgcatcgcctcgacggccacattcaccgagccatgcgccgtcaccaccaccacatcgcagccgccccggcggcgcagatcggccagaatgtcgagcccgttggcgtcgggcaggctgagatccagcagcaccagcgccgggggcgtcgccgcaatccgttcgaaggcggctgccgccgtccccacggccacggcaggaatgccggcgccacggagctgttccgcgtaaaggcgggccagaagggcgtcgtcctcgatgatcagaacttcggatgcactctcgtccgccaccataccgccacgtcaccatactgcctgatgcggtgaccatgggtccccccggccacccgcaaaacaaggctagcagaagaccggggcgcggtcagcgtccacgacgacacccgcatcaggtgtagggcgcgccaatcggcgccggtgtcagttacccggcgtatcgagcaccggctcccgcgcggtcgcagcttccaggagcccgggatccgcggcagccgacagctgatcgagcagagcacgcgccggcgcatatccgcgcgcaacggcgcggcggcatcgggccaccgcttccaccatgtccggcggatcccccacgagcgcacgcagcgccagggcgtgatcggcggccccgtcgccggcacgcgccgcgcgcagcaggcgggaccgcgcagcagcggcatcgcccccggcggcacggccgtcgagctgcatcagggcaaggccggtatcggcggcgacgatgccggcacgcgccgcctgttcgtacagcatcgccgcccgcaccggatcggccggcagagccgggcctgcgccctggtccagcaggcgcgccaggttgaaggcggcacgcgcatccccggcatcggcggcgcggccgtaccaggaggcagccgccgccggatctgcttccccgccctgcccctgctctgccatcacccccagataaaaggcggcgcgggcgtcaccagcctctgccagcctgccgaacaggttacgggcggtggcatagtcgccggtctcccaggcatgggcagcggtggcgaagccctgcggcggcgtccaggcctgggcaccgaccggcatcatggccgccagaccgatcacgaccgccctgcggagtgccgtctgcaccccacgccccttcaccctggccagcctcatgtcacccccgatgcgcaccccgcccggtgccaataagtactctcccgcgcagctaatattccgcaagcggccgaggggatgcaagccggagcaggtaccgtcggtcaacctgcgcggcacggccgcgggagcgccacccggctcaccatcaatccgaccagcgaccagaaaaccacaccattccagttgttgaagaagctgccatgcggaacgaccggccagagaatcaacaggatgccgagcccggcccctacggccaccggatccatgcgctgcggcaggaatgctgcgacaaaaccaccgaccaatgccaggaagataaccaggccgataacaccgtgctccgcaaagaattcaatgtaagcgttatgcggatgagtcgaacaaaactccagatattccgagtagtcggtgccccgcagtctgatgttaggggatcggatttccgggcagacatcccgaaaattctttcctccggcgccaaccgcaggcgagagttcgccgacctcgacgccggactgccagagcaggccataggacgtcgtcgacagacgtgacagcgtccccagggtcgagccgatctgacggtcgaaacttgcgggagacaggatgtaggccaccaccgcgccaacaattgcaatcagcaacccataccgcatgaaacgacggagacctggcacgggcacgatcagagccataatcaacagaccaaggcctgccagcagaaaggcactccgctcgcctgacaggaagattgcgagcagcaccagaaacagcccgacaccgacgggagccagccgtcgcatcgatcctgcagctgcccaggccagggcgaaacccaggcatgggaacatcgtcttggtcagaaaaatgccgaccttgcgatcatcgaatgggccggtcagccgcaggggatgcgaatagctttggacaatcctggtgacccagtaccattccatcagcgcccagacggcactgaacaaaacgatggccagcaaaaccgccacgtagcggtcgcgccatttgggttccgtcagcagccagaaaccgagagccgctgcgagcatcggaaatctgatgaaagtcccggcccggctgaatgcatcagacacgctggccagcgcaaagggcgccgtagccagcatgaacacccatagaacaagcgccagacgaaaccaccaagcccgaagcgcaaccgtgtcccgattgacggcgccatggatgagaaacaaaagcgcaaccaaagagccaccgacatcagtcacccctggccccagtatcatcaaaatgggcaagatcattgcaatcatgcgtcccacggctctaagacgatcctgcgcctccgcgcccgcggaactcacattattttgggacaaggtcatcctctcgggcaaaatctggctggagagatatggaagatcttgccttatatcccgaatccgccgtcaacgcgacgttctgattgcttactttcccggattttacccggcagaagccgtcatgcccccagcttgagatcgccgagcccggcgccggcaatgcccagcccgtccatggcagcgaagccgaaatggcgcacctcgccgcccacccagactttcacgccggaacggctggcggcaccggtctcggagacgaccagttccgcccgggcctgcagggccaccaccggggcgttgaaacggccctgcgccacggcaaccgggcgcaggccgccggccaggccccgacgggccagagtgccgaccagggctgccacggcttcgggtccgggggtttcttcggtgcgcccggccagcgggtcgaaaaggcgcgcgatgaaatcggctccgcccatctcgccatgggccggcgcataggccagcaccggcgcctgctcgtgggcggcgctccaggcggcaagacgcgtgaaggcggggcggatggcgccgagggtcgcggcatcctcgatgggcaccagcaggatgcggcgctgcgtcgcggccagcccgaagggcatgttgccggggacccgcatcggcggtacgccaagggcagacagaacttcggccccgtcgaaatggccgacgatttcatgagagagcgtcgctcgatagcgcagccggccgtcggcctcgcgcagcaccgggatcacccggccgccggtttcgaagcggatcgggccgcggccgtcgcggccgagcaggacatgggcagccgccagcaggccggttccgtccacctcctggcgcataccgtcgcgccagacgtcgagccgggcatcggccttgagcgagggggtcacggcaacagccgtcgtcgccggctcatccagccgggtcgcaacctcgcaggcattgtccgcacccaggatcaccaccgcagatacgccgccctggccgctccgggcgtagagccgcacacgatgcaattccagcatgggaccgcttccccttgtgagagcgtggcgcattccgaccgctgacgctcgtccacgaatgccgtcgccgccgttgatcgcgttcattcgacacccgctcataataggcaagaaccagaccgtgatttcaactttcaatttaatggacatgacatgcagtgccggccacacgggctggccgccgcctgtcgacgcccgcggagggtgtaccatgccgcggaagtcatggctgtgatcgaaccattacaacttccggtcagatccccaggtcaccgatatgtcacggcgccggctcggccacgacgatcagcccgtcgcgctccaccagccggcggcgttccgtcagccggcggatctcgtcttcagtcaccgagcgcagcccggcactcagcgcgcggaagcccagcatccgggccagctggcgctgcagctcttcgcgggtgacgcccagattctcggcggcgatccgcatcagcccggcctcgatctcggctggcggcaacaattcgggcttgcgcagccccgccgaggttacggcactgcgatcgcggatgcgcaccggctctcccggcaggctcaggaaccagccttcgtcgaccagatggcggcgacgaatggcataggatgccgccgcccgcacggcggcctggatccgcgccccggcgcgccccagcccccaggcatcgcgcagccgcgccgtcacctcgtccagatgcaccggcccttcgaccttcaccaccgccatcaccatcggcgccagcttcgccggcgtcacctggtgcagctccatgccctgcagctcggccggcacttccgggtccgcctcgacataggcaggggtgatgtggtcatcctcggccggcgcctcgtcctcgccgccttccagccccagttccgcggccagcgctgcgtcttcgggcgacatggccgcggccgccgcggcgcggccgtcatcgcgagcctccagcatctcgcgggccccgacgatggccgcctccaccgccgccagctggccctcggggcgggcgaaccagtcggccgaccagatccggtggatgatccagccgtggtcttccagcaccgcctggcgcagccggtcgcggtcccgggccgatcgtgcggcatgatagccggccccgtcgcattcgatgccgagcagatagcggccgggccggtcgggatcgaccaccgccagatcgatgaagaagccggccagccccacctgttcgtggacgacatggccgcgcgccctgagcgcccgggcgacctgttcctcgaacacgctgtcggccggccggcccgaccggcgggcgacctccaggctgccggtgcgggcatagcgcagaaaggttttgagcgccgcgacgccgcggccgcgcgcccgctccagatcgatgtcctcgtcggtgatcgaggcgaagacccggcagaaccgtttcgcccggctgatcagcacgttcagccgccgctcgccgccctcggcaccaaccgggccgaagcgcatcgccatatagccctgggcattgcggccataggcgacggagatgaagatcacgtcgcgctcgtcgccctgaacgttttccaggttcttcacgaagaacggttcggccggatgggcgttgaagaagtcctcagtctcgggatgggcccggcgcagggcctccagcgcatccaggatcgcccggcgctggcgcaccgagaaggtggcgaccccaagcgagcgctcgggcgtggtgcgggcatgggcgatcaccgcctcggccacccgccgcgcctcggtcggattggtgccgctgccgccggtctcgaacacgccgtcggtcacatggacgaaatcgagccccagcccggcctcccccgcataggggctcggcaccacatgcagccggtcctgatagaattcatggttcgacaccgcgatcagcgactgatgccggctgcgataatgccagcgcagcatgcgctgcggcaggccgcgggccacgcagagccccagaatgctctcgacatcggcgatccgggtggtctcgtcgtcatcctccgcatcaggcgcatcggcggtcatgcgggcgaagaaggcggtgggcggcagctggcgctcgtcacccaccaccaccatctgccggcagcgggcaatcgcccccagcgcatccaccggctggatctggctcgcctcgtcgaccaccagcaggtcgaagccgatccgccccggctccaggaactgggcgaccgacagcgggctcatcatgaagaccggcttcagcgcctgaaccgcagggcctgcctggctcatcagctggcggatcggcatgtgccggcgcttcttggccagctctcccctcagaacgcccacagggcccagcccattcacccgcggacggctgcgggcatgttcggtccgcacttccgaccgggcgaggtcgatccgggcccggtccagcgccgcgaagctccgcaccagcccgtcctgggcggtgccgtcgaaaccggccagcgccggctcggccgcggtcatcgcctgccagatcgcctcgaaagcggccatctcgaaggccggcatcacgcccgcccggtccagccgcccatcctccagccggtcgaccagcggcgccagaccggcagcacgtgcggcccgcgccgcagccaggatcgcagcccaggccggcagcccctcgggcgccgccagccaaccgcgaagatgggccgccagcgcatcgagatccagatccgggatgccggtctcgccgaacatggcccgcggatcgaaggccagcctggaccacagcccgaccacctgatcgacgatgccgtggccggcttccaccagcgcggccgtgcggccacgaagcgcggcacgatcgggggtgcgggccgccagcgcccgcaagtcaggctccgccgtcagccaggccgccgcccgggcgatggtgtcccaatccgccgccgcgcggtcgccggccggccagagcggcccgaaagcggcgcggccggtgaccgcggcatcggcgagcacggcctcgcgccgacgcatttcgagcagatcgtccagggccgccagccgctcgccggccaggatggtcggagcgatcagggcggcgaaggccgcatcgaccacggcctcggccgcaaccaccggcgccagagcggatgccgccagcggcgcccgttctccgcccagatcggtgccgagcagcgccggggccgccggccccacgatcctgggccagccggtccagatcatccgcgaccgctgcaaccgcagccccgagacgcgcggccagatcgcccgcaagcggccggtcggcacaggccgcggccgtgcggcgggtggcggcgtcgccggccgggccgttcacccaggccagcatcgcctccagccgctctggcgcgctgcgtgccccgcgccagaccgggccgaaagcggcacggcccagggcgtcgcccgcttctgcccttgccgccgccgcctggccggcgatcacccggtcgagcagctggatcagttcgccatcttcgggcttcggcccggtcaggatcgatttgaccagccggttcgcccgccgccagcggccgctgaagatccggaacaggctgccgccggtctcggcgatcgcctggcgggcctcggccagcccggtcgaccaggcggcctcggtgacgcggtcgccggcggcaagccgtgcatcatgggcggcccgcaccgcctcgaccagatcggtgagcgcggcccgctccgcctcccagctctcggccgccagctgctccgccggcaggtcgggggccgcggccacggccgcgccgcagcggatcagcgccccggcctcgcgcagggtttccggcgccggcagccccaggtgaccggccagacggctgcccgcctcgatcaccgccggcagcgccgccaccacccgggccagccggtcgcgggcggccgcatcgaagcctgcgggcaggaccgccagccggtcacgggctgcctgaagatcggcggtcgccagcccgtccgccccgggggcaagccccggccgcagccgtgtcgcctgatcgcggagcgcaagcccggtctcgaccagcaccgccacatcatccgcggccaccgaccagaccgggtccaggaacaccgcgggcggcagatccggtgcagccgccagccgctcggcccgggccagcagccggctgctgccgtccagcgtggcgggggccggcaggtccagcaggcccgccaccacctccgcctcggcgcgccagccggtaagtccgcgctccagcgccgcaatttcggccagccggcggtcggcatccagcgggctgatcgtatccagccccacgccgcgccagggatgggatgcgggcggcccctccgcttcgatccggcgggcgagatcgtccagcgtcgcggccagggccgtccgctcgggcgcagtccagccgggggcggcctcggccagatcgaaatcggccggcgccacaccggccgcgcgcaggcgcaccagctcgccgatcacctgatagggtgtgagcccggtcggctccagcgcgcgatgcagccgttcggcatgggcgttcagctgcgcccggctgcgacccaggcgatggaacagggtctcgtcatcgccgatccggggcgtgcccagctcccagctgcgcttcagatcctccagaaccgcccgttttgtcgccttgtggctgtgcagttccaggcagacctcgcccacgcccgcctgatccagccggcgcttcaccacctccagcgctgccatcttctcggccacgaacagcacggtcttgccgtcggcgaccgcggcggcgatgacattggcgatggtctgcgacttgccggtgcccggcgggccctggatcaccaggtcgcggccgcgccgcgcctcgtggatcgccagcgtctgcgaggcatcggcatcgacgatatgtaccagatcctcgggcccgatcagcggatcgaccggcacgtcctcgtcgaaatcgacatcctcgaccccgaaaccctcgtccagcaggccgcggatcagcggccggtcggtcagcggcgcatccgccggccagaccgccggatccaggtcgcgatacatcaggaatttcgagaacgagaagaagccgaggatcacctcgtcgggccgcacctcccagcccttgcggccgtgaaccgcctcggcgaccgccgtcacataggccgtgaacggatcggtctcgctctcggcttccgcgtcgaaggccggcagggtgatgccgtgttcgcggtccaggaaggcttcgagcgacaggttggtcgcgacgtcctcgggccgtgcggccaggcggaaacgctcggtggcgctgccgcgctccagctgcaccggcaccagcaccagcggcgcccggcgcagctgaccgcccgcggcggggtcggtccagaccagcgtgcccagcgccaggaacaggatgttgacgccctgctcttcctccagcgtgcgcgcatccagatgcaggtccagcagacgacgctgcagcccttccgagccgagacgggtctggagcttcgtgtcggtgtgacgcgcggccagcccccgcgcatccaccgcctcgtcctcgggctgcgccaaggcctcgccggctgcagcacccccttccgccccaccctcttccacctgctcctcttcggtctcgcggccgggcaggaaagtgaagcgccgcccctcgcccaccagcagccggtagatttcggtcgcgcgctcgtcgacgatgtcgagcatgcggctgcgccgggcctgaggcaggttcagcaggcgattgcgcgccgagagatcgagcaggtccatccgcgcccggtcgagcttcgctgccagcggcaatccgctccgcaggactgaaggctcggtcgccgcggcggtgacgggctcgttctcgggggacaccgtttcgctcatctccgctcaccatccgacggggaagggtaccgcggacgggccgcggcggggctcggctcaagctgtagaaggagcgccggcaaaattcaacgccgcagcgggttcctggtcaacgcccggcgcgtccccggccaaccgaccgcgtaccggccttcccatcgggtaccgccccgcgccatgatgtcagcgcccgccgcaccgcccccgggagcccgacccgcatggccttctcgctgcgccagctgcagtatttcgtcgcgatcgtcgagcgcggcagcatctcctccgccgcccaggcgctgtcgatctcgcaatcgacggtgaccgaagcgctgcgcgggctggagatcgatctgggctttccgctggtcgaacgtcatgcccgcggtgtcgcccccacgctcaagggccatcagttcctggcccatgcccggcggattctggccgatgtcgccgatgcccggcgtgcgatccgcggcgagagcgccgtgctgaagggccagctggcgctgggggtcacgccgctggtggcgggctatgtcctcgccgatctgctcgcccgcttccgccgcgccttccccgatgtcgatgtccagacggtcgaggacaatggcgactatctggaacatctgctggtcggcggcgaactcgacgtggcggtgatggtgctggcgcccgggcgcagcagttctgccctgcagatcgaggtggtggagatttcgccctatcgggtctggctgccgctcggccatgccgccactgccgaagagcgggtcagcctgcgcgacctagccgccgagccccatgtgctgctcaccatcgacgagatcgccgaggcgtcggaggtggtctggcgccggctcggcatccgcccgccggtcgccttccgcacccgctcggtcgaagcggtgcgcagcctggtcgccaccggcaccggcgtcgcgatcctgcccgacctcacctaccggccctggtcgctggaaggcgacaagatcgaagcgcggggcgtggccgaggatctgcccgccatccaggtcgccaccgcctggcgccgcggatcgccgctgtctgccgcggccgccggttttgtctcggtcgccgcaacccgccaggccgcccggcgttagggggggccgatgccatcagagatcacccgggcagaaagcgggggatcgcctcgcgcagcagggccaggatcatgtcgtgcttctcttccagccggtcgaccgggccgccgacgccgaccgtgaagcggcggccatagctctgcggcggcagcagcatgccgatcaccccggcgcccggggtgacagtgtggcgggaatagacatggcccagctgccggacctcggtcacgggcaccatcagctcgtccagcgtcatccgccgggccgggtcgctctcctcgatgttcactcgccggagcagcttgtcgatctcggcatcgggcatggcgctcaacagcagccagccatagccggagtgggtcatcgaacgcacggtgccgggccgcacgcggtattgcagaccctcgcgcgagtagagcacgtgaacatactgcatgtagatgtccgactgggtgccgaggctcaccatctcgccggtcatctcgttcagatactgcatcagcctgaggatccggccctcgccgaacagcgatgcctggatccagtcgcccagcatggcgacgcgcatggtcggcatataggtgcgcgtcggccggttgaaatcgacatagcccagctgcagcaggctcttgagcagggcggcggtgctggacaccggatagccgaaatgggccgagacctcgcgcagcgtcagcggccgcttcacctcgtcgaaatattccagcacctcgaagacccgccgggcggtcttgatcgcggccgtcgacatgatccgtcgtctccttccctggtcgtcctgtcccggatgtctgccgtcacggaccgtaccaccagccgggcaggccgagcgagagcgccgggaacagcagcagaagcagcaggacgatcatgtcaccgatcagcagccgccacacgcccgagaaggtcttctccagtggcgcatcggccgaggccgagaccacgaaactgttcagcccgagcggtggtgtgaccaggccgatctcggaagtcttggtcagcacgatgccccaccagatcgggtcgtagccaagcccgaccaccagcgggaaggtcagcggcagggtcagcagcatcaccgccagctggtccaggaaacagccgagaatcagatagatcacgatcaggatcgcgatgatcgcccagccgggaatgttcagcgccacgatcgtctccagcagatcctggggcagccgggtgatggcgagatatttcccgaagatcatcgcgccgatgatgatggtgaagatcaatgcggtgctgcggatcgaagcacggaaggcggccagcatgccctccccgcgcagccccccgaagacgacgctgatcaccagcgccgccagcgcaccgatcgccgccgcctcggtcggcgtggctgcccctgaatagatcgagcccgcgacgaacaccaccagcagcatcgccgggccgatcgcggtcaggctgcgcagccgctccggccaggcggtcctcaccacctggggcgcgatggtggggtcccggcgcacccagatcatgatcgagatcacgaagccggtggcggagagcaggccgggcacgataccggccacgaacagtcggccgatcgagctttcggtcaggatgccgtagatgatcagccccaggctgggcgggatcatgatcgcaagcgtgccggcgatcgcgaccgtgccgagcgacagccggtcgtcatagccgaagcgccgcatctcggggatcgagatccgcgccatcgccgccgcggcggccgtgctggagccgctgagtgcggcgaaaccggcattggcccccaccgccgccagcgccaacccgccacgcagatggccgacgaaggcataggcgcagcggaacatcgcctgcaccaccgtgccacgggccagcagttccgccatcaggatgaacagcggaatggtggtcagcagaaacgacgaggcatggcggtagggctcggcccggaggatgccgagcaggggcatccagccggcattgatccagatgccggcggcgccggcgacgatcagcgagaagccgatcggcatgcccagaaccagggtcaccaggaacaggacgatcggaaaggcggtgtcgaacatgggggcgatatcccgtgcggcaggggcttccggagccccggccctcaatggatggcactgtccgtctcttcgaaggtctccgcgtcgggaacctcgcccgagatcaggcatcgcaaaagctgcagcgccatgcgcagccagagcaggatcaccccggccgccaccagcacccaggacggccagaccggcatcggcacctggctgaacgggaagggcgtcgcgatcacccggtcgcggatgatgttcgtcgagacctgttccaccgccatccagccaatgccggtgacggccgcgagcgtcgccgccaggaacacggcctccagcagccggcggaccggacgcgggaagttgcgcgagacgaaactcacagcgacatggccgcgcctggcctgcaactgggcgatgccgaggaagaccacgccaaccatcagatagaactcgacgaattcatgcgtgccgaagaccggggccgcgaacagatagcggccgccggcatccatggtgatgatcagcatcatgatcgcgagcagcgcgatggcgacgtattcgaacagggtctccagccggccgatcagatggtcgagcgtgtccaaacccccgccctccctcaggcccgggcgtgcttcttgagcgccgcgacccaggcatcgaccacgcgctcggccggcaggttgcgggtctcgtacagctccgcccatttctgccggatcggcgtcagccgccgggtggtctcgtcgatcacctcgggcgccagatcgtagacctcgatcccctgtttgcggaattccgtccgccaggtatcggactggcgcgagatggtgtcgccctcgaacctgatcaactcgcggccgaccttgtcgaacacggcctggatatcgggcggcagatcgtcccaaaggtcgcggttcatcgcataatagctgttgaacacgcccagattgaggttgtcggtgctgtaacgcaccagatcgttcagcttgtaggaatggatgctcggaatgtggaagacggtgccgtccagcgtgccgttctgcatggcgttgtagatctcaggcggggtgacggtgaccgggataccgccaagcgccgtgatcgcctgctgctggacattgccgccgacccggatcttctgacccgcgaggtcgtccagggtcacgattttgcggctgaccatgtgcaggttgtaggcctcggtcgacgaggccctgagcgcccggatgccggcatccctgaactccacctcgtccagaatgcccaggccgatctcgtaataggcggcttcaagcgcgtagatatcggccttgatctcagggatcggcaggctgccgaccgtcgccatcggcagcttctcggaaaaatactgcgcgggaatataggcgacgtcggcgatgcgggtctgcaccgcatccagcaggtcccgggcgctggcgagctgttcggcggggtagtgctcgaacctgatccgcccctcggtcccctcctcgatctgcttgatccagtgtttgatgatcggcatcgagtaatgggtggtcggcagcgaatccgccagtttcagggtgatcggcttcgccgcacgagcgatccagggcatgccgaaactgcccgcggccgcgccggcggcggcgagcttcacaaaactgcggcgattgatcatccgttgtcctcccttgtctgatgcagggcgcaaggatcctgccgccgcgatcttgagcgtcgcgtggagccggcagatccgggtgaggtgtctttggtcagcgggcgacgaagcggcccgggcgacgttcggcgacggcgcggatgccttcgcggtggtcttctgtccgggcgagccatttctgctcgacgaattcgtgatcggtctgggcctgcaccgcatcggccaatccccggcgcagggtggcgcgggtcgactgaaccgcaagcggtgcgccctcggcgatctcctgcgccagggccatcgcctcggcacgcagccggtcggccgggaccagcagatcaacgaggccgacggccgcggcctcctcgccggtcaggcgccgcccggtcatgaacatccactgcgccttctggacaccgatcacccgcggcagggtatgggtcagcccgaagcccggatgaatgcccagcttgacgaaattggccccgaagcgcgcttcgggtgcggccacccggaaatccgccaccagcgacaagcccaacccgccaccgatcgccggcccctgcaccgcggcaacgatcggcttgcggttgtggaacaggcgcaccgcctcggaatagagggggttgcggtcttcaaccgccccggccagttcggccgggcggcgctggaaatcagcgccggcgcagaaggccttgccctccgaggcgagcaggatagcccgacagtcgctgtcctcgtccagcgcctcgaccaggctcgacagatcacggatgaggtcgaggtcgaagaaattgttcggtggacgccggatctcgaggaccgtgacatggccgtcggtcgagacgtggacgtctcccttctgcgtgatcgacatggttcggactgcccgtttttttgccggcggatcttcgatgtctccggcaggtggccggcagatccgcctcattcttcggcgactgcagagcatcacgctccggcgttcctcccgccttgcagcgtccaaagtataggcagaagggccgcgacccggcgaccgtttcgcagatgtgttttgtttttccatatatatgtctgcatgtccacatatgtggacgacggcgcggcctgcgctgcatctggattcacatatgtgtatctgatctccacaaacctgaaccgtcttccgcgtcctgtcggccgctgttatccagaaaaggccaaaacacgcgacaggacggggagaacggcatggccgacgcagcggagacgggcaccaacgccgaggtgctctatatggtgaccgggcgggttgcgacgctcaccctcaaccgccccgacaagatgaatgcctggacaccgcgcatggaggcggaattccgcgcggccatggaccgtgccgtcgccgacgacgcggtgcgggcgatcatggttaccggcgccggccgcggcttctgtgccggggccgatatggggcggctgacgcctgcggcaccgggggagagcaaggcggcaccggccgccgcccgtgactacacgcccgacaatttcggccagcgctattcctggctgctcgatgtgcccaagccgatcgtggccgcgatcaacggtgctgcggccggggtcgggctctgcatcacgctctattgcgacctgcgttacatggtcgaggacgccaagctcaccaccgccttcgcccgccgcgggctgatcgcggaacacggctcggcctggatcctgccccggctgatcgggccgatggccgccgccgacctgctgctgtcgggccgcgtgctgaccggacgcgaggcggcggcgctgggcctggtcagggcgctgccggccgaaggtttcatcgaggccgtacatgccgtcgcggccgaccttgccgagttctcctcgccacgctcgatgcggatcatcaagcagcagctctatgccgggctgttccaggacctcgccaccgccacccatcttgccgattcagaacaggtgaagtgcttcgcgaccgaggatttccgcgagggcgtcgcccatttcgtcgaacgccgcgccccggccttcaccggtcgctgaaggagccctgcccatgctgcccccggcatcaatcctgcccctcgacgggatccgcgtgatcgagatcgcccagaatctggccggcccccatgccggcgaaatcctggccaccctcggcgccgatgtgatcaaggtggaacgtcccgaaggcggcgacgatgcccgtggctggggccccccttcgccggcgacactgccgtcaccttccatgccatgaaccgcaacaagcgcggcatcacgctggatctcaaggatccggcaggtatggccgaactgcgccggctgctggccgatgccgatatcctggtccagaacatgcgaccgggcatgatggaacagatggggctggatgcggacagcctggccgccatcaacccgaagctcatctactgctcgctctgggccttcggcgcccgcgggccgatgcggctgacgcccggctacgaaccgatcgtccaggccttcgccggcattttcagcatcaacggcacacccgacgggccgccgtcgcgggtcggcatgcaggtactcgatctgggcacgggggtctgggcggcactgggctgcatggccgccctgcttcagcgcgggcagacagggcggggcaccacggtcgatgtctcgttgcttgaaacggcgatgggctggctgtcgatctatttcgccgccttcaaggtgaccggccggcaaccccagcgccatgccagcggcaatcccaatgtcgttgtcttccagtcgctgcccaccgccgacggcgaaatcgtggtcgccgccgccaacgaccggctgttcgcaaagctcgcccgcgcggtgggccgccccgactgggccacggatccgcgctatgccagcaacggtctcagggtcgccaacaaggcggtgctactgcccgagctggaggcgatcatgcgcacccgcagcaaggcagactgggccgaacggctggaggccgccggcatcccctgcgccccgatcaacagcctcgccgacatcgcggccgatgcccagctcgccgccctcgacatcgtggagaccatccccgaggccgggctggaggtggtgggcctgccgctctcgctcggcggtgaacggccgggcattcatcgccgcgccccgcaactcggcgagcacaacgccgacatcctcggccacgactgacccgtccgacgacatgccatccagggcatcggtttttccgatggaaacccaacgatgctttggtgtggcgcggtggagccacacgcgcgcagacttgttcccggacatcggaccgcggggagacggcggcagggcagtggcccggcgccgtgcggccggcttgcaccgtcagggagagttccatgcgcatcaagaggttggtcgcgggggccgtgggcaccgctttggccgcgggtcagatcgcaggcgccgacgccgccatgtcggccgagatgatgaaggccctgggcccgggggaaggccgcgtcgatatcgtcgcctggccgggctatatcgaacgcggcgacaccgacaagaattatgactgggtgaccgggttcgaagagaagaccggctgcaaggtcaatgtgaagaccgccggcacttcagacgagatggtggcgctgatgaacgagggcggtttcgacctcgtcaccgcctcgggcgatgccagcctgcggctgatcgcgggcaagaaggtccagccgatcaacaccgacctgatcccgagctggggcaccgtcgacgaccggttgaagagcgccgcctggcacacggtcggcggggtgcattacggcacgccctatcaatggggctccaacgtcctgatgtattcgaccgaggtgttcaaagaggcacccacctcgtggaaggtggtcttcgaagagaccaccctgcccgacggcaagtcgaacaagggccgcatccaggccttcgacggcccgatctacattgccgacgcagccctctacctcaaggcccacaagccggagctggggatcaaggatccttacgaactgaccgaggcccagtacaaggcggcgctcgacctgctgcgcggccagcgccagatcgtgcaccgctactggcacgacgccatggtccagatcgacgatttcaccaatgagggcgtcgtcgcctcgtcctcctggccgttccaggtcaacctgctcaaggccgagaacaagccgatcgcctcgaccatccctgaagaaggcgccaccggctgggccgacaccaccatgatgcatgccgaagcggcgcatccgaactgcgcctatatgtggatggagcattcgctctcgcccaaggtgcagggcgatctcgccgcctggttcggctcggtgcccgcggtgcctgccgcctgcacgggcaatgcgctgctgggcgacgagggctgcgccaccaacggcatgggcaatttcgaccggatcagcttctggcgcaccccggtttcgaaatgcgaaagccaggccgaaggctgcgtgccctattaccgctgggtctcggattatatcgcggtgctgggcggccgctgatcgcggccctcgcgaaggcacggtcatatcgccgtgccttcaccgccatcccccgcgcccttccgaacagctgaatggcacatgttcacgatgccctcttctcccgacagctcggccgccggggccggtccggccgtcacggccgttcgcttcgccagggtctcgcgccatttcgggccggtgcgggcggtggatgcggtcgatctcgaggtcggcgcgggcgaattcttcgccatgctcggcccctcgggatcgggcaagaccacctgtctcaggctgatcgccgggttcgagcagccgacctccggccatatcgagattttcggcgagacggccgagggcgtgccgccctatgcccgggcggtgaacaccgtcttccaggattacgccctcttcccgcatctctcggtgctcgacaatgtcgcctacgggctgaagatgcgcggtatcgaccgccgccgccgccgcgacagcgccgcccgggccctggctctggtccgtctcgacggcttcggcgaccgccggccggcccagctgtcgggcggtcagcgtcagcgcgtggctctggcccgggcgctggtgctggagccgaaggtgctgctgctcgacgagcctttgggcgccctcgacctcaagctgcgcgaagagatgcaggtggagctgaaagccctgcagcgccggctgggtctcaccttcgtcttcgtgacccatgatcagggcgaggcgctgtcgatggccgaccgggtcgccgtcttcgaccagggccgcatcgttcaggtcgacacgcccgaggcgatttacgaacgcccgcgcacccgcttcgtcgcgggcttcgtgggggccgccaatgtgctggagccggcaaccgccggggccgccggcggccccgcccggctcgcctcgctccgcccggaaaagatcgaggtcctggccggcgccgcccccgtgcccccgggccggatggcgctgccgggcgtcctcaccgacatcctctatcaggggcccgtgcgccggttgagcgtgcgcaccgatgcgggccccgtactcgccgccgccgtgcccgccggccgggcggttcccgcaaccggcagccgggtcaccctcgccttcgatcccgcggcgctggcgccgatggaggaggcatgagcaccgccgccgcggccgccccgccgcccgccatggcaggcggtcccgtccgccggctttcggacctgctgctgcgtcgcaggcgcctgctgctgctctctctgctggtgccgccgctgctctggctgggcgtggtctatctgggcgcgctcttcaccctgctcgcccattcgctgttctcgatcgacgaattcgccggcacgctgatctacgagccgacgctcaagaccttcggcgagctgatgcgcccggccaatctcgacatcgtgctgcgcaccatcacgatcgctgccgtggtgacggtgcttgcagcggtgatcggcttccccgtcgcctggtatgccgcccgctatgcccgcggccggatgaaggccgccttctatctggcggtgatgatgccgctctggtccagctatctggtcaagctctacgcctggaagctgctgctggccaaggaaggcgcgatcggctggttcgcggaccggctggggctcgcgggcctgctcgatgcctggctgtcgctgccgctggtcggcggcccgtcgctttcggtcagctataccggcatggtggtggtgttcctctatctctggctgcccttcatgatcctgccgatccaggccgcactggaacgggtgccggccagcatgatcgaggcctcgtcggatctggggggcacgcccggccagaccttccgcaacgtcgtgctgccgctggccatgccgggggtggtggcgggcggcattttcaccttctcgctcaccctcggcgactacatcgtgccgcaggtgatcggcacctcggcgctggtgctgggccaggcggtctacatgcagcagggtgtcgccggcaacctgccgctcgccgccgccttcgcggtggtgccgatcctggtcatggccctgttcctgaccgccgccaagcgcatgggggccttcgatgcggtctgacctctcccgcccctcgcgcgggctgaagctcgcggccggcttcggtatcctgttcatgcatctgccgctggccttcatcgtcctctatgccttcacgaccgaagagaaatcctatgccttcccgccgccggggctgacgctcaagtggttcgcggtggtctggcagcgtcaggacatctgggatgcggtcggcctgtcgctgaaggcggccgccatggccaccgcgctggccctggtgctgggcacgctggccgcaggcgcccttgcccgcttcgccttcttcgggcgcgagccggtgaccctgctgctgatcctgccgatcgcgctgcccggcatcgtcaccggcatggcgatgcgcaccgccttcggcgtggccgacatccccttctcgttctggaccatcgtgctcggccacgcgaccttctgcatcgtggtcgtctacaacaatgccgtggcccggctgcgccggctcaacccgtcgctgatcgaggcctcgatggatctcggcggcaacgccttccagaccttctttcacgtgatcctgcccaacaccgcgacggcgctgctcgcgggcggcatgctcgccttcgcgctgtccttcgacgaggtcatcgtcaccaccttcaccgccggtcagcagtccaccctgccgatctggatgctgtcggaactggtgcgcccgcggcagcggccggtgaccaatgtcgtcgcggtgctggtcatcatcgtcaccttcctgccgatcctcgccgcctattacctcacccgcggcggcgaagcggtcgaaggctccggaaaataggagaccgtccgatggatgcgaacacgcccctggacacgcgcatgctgatcggcgccgatttcgtcgcgggcaccgacacgcccgagacgatcctgaaccccaagaccgaagaggttctgctcgacctgcccgaggcctcccccgatcaggtggatgcagcggtggcggcggccggccgggccttcaccgcctggtcgcgcaccacgccggccgaacgtgccgccctgctgctgaaactcgcccagcgcatcgaggacgaggccgaaggcttcgcggcgctggaagccctgaattgcggcaagccgcgccatgcggtgctcgccgatgagatcccggcgatcgtcgactgtttccgcttcttcgccggcgccgcgcgctgtatgcacggcgcggtggcgggcgaatatcttgccggccatacctcgatgatccgccgagatccggtgggtgtggtcgcctcgatcgcgccctggaactacccgctgatgatggcggcctggaagctcgccccggcgctcgccggcggcaacaccgtggtgatcaagccctcggaacagaccccgctcaccatgctgaaactggcgggtctgatcgccgaaatcttccccgaaggcgtggtcaatgtggtcgtcgggcgcggcgaaagcgtcggccagcggctgatcgatcatccgggcgtgtcgatggtctcgcttaccggcgacatcgccaccggcaagaaggtgctgaccgcggcggcgcgctcggtgaagcgcacccatctggaactgggcggcaaggcgccggtgatcgtgttcgacgatgccgatctggaagcggtggtcgaaggcgtgaagatcttcggctactacaatgccggccaggactgcaccgccgcctgccggatctatgccgggccgaagatctacgaccggctggtcgccgatctgtcctcggccgtacaggggcttcggttcgcacaggccgacgacagccagaacgatatcggcccgctgatctccgcccgtcagcgcgcccgcgtcgcctctttcgtggagcgggcgagcgagctggatcatgtggagatcaccaccggcggccgccaggcgccgggccgcggcttcttctacgaaccgacggtggtcgccggcgcccgccagtccgacgagatcgtccgccgcgaggtcttcgggccggtggtctcggtcacccggttctcggatgtcgacgaggcggtggcctgggccaatgacagcgattacggcctcgcctcttcggtctggtccagcgacgtgaagaaggcgctggcgacggcctcgcgcctgcaatacggctgcacctgggtcaactgccacttcatgctgaccaacgaaatgccccatggcggcatcaagcagtccggctatggcaaggatatgagcatgtacgcgctggaggactacaccgtcgtccgccatgtgatggtcaagaccgtctgaccgctcccccggagccccggaccgaggcccgcaagcgcggtgtcagtccggggctccggccaggatcgccatcagcgcatcgcgccgctccggcacgacgaagcccagcagcaccgcggccgccgcctttcgggcctggaccggcagatcggcatcggtcagctcccccgccgtccagaaggacagcacgccacgaaagccgaaggccagctggtcgggcaggaccgtcgcggcatatgccggcgccgcaagcccggcgccggcgccgattgccgccgcccagagcgcacgggatgcggccagaaccgtgcctggttctgccgccggcgccccgatcgcgcccatcacggcacggttcaccgccggctgttcgagcatcaccccagccgcaaccccgaccgccgccagcacgcgccccggcgcatccgccggcggcggggcggccgcgaagcgccggtgcatttccgcgatcagcgccgccgacatcgcctgcatgatcgcaagcttgctgccgaactggttgaaaggcgtcgcgaagctgacaccggcttccgccgccagttcgcgcatggagaaatccggccgtcccgtccccagcagacgttctgccgcaatcaggatccgctcgcgcgtgctcatgacgccctcgggcttgcagagccgtatttcagatttatatcatgatatagtttttgatcgactggcggagccgacatgatgaacgacctctcgaaaaccttcctgatcaccggtgtcagttcgggccttggccgcgccttcgcggccggtgcgctcgccgccggccaccgggtgatcggcaccgtgcgccgggcggaagatgccgggcgtttcgccgccctggcaccggatcgcgcctgtccgctggtgctcgacgtcacggattacgacgccataccggaggcggttgcaagggccgaggctgcggccggcccgatcgacgtgctggtcaacaatgccggttatggtcatgaaggcgtgctggaagaatcgagcctcgacgatctccggcgccagttcgctgcgaacgtcttcggccctgtggcgatgatcaaggcggtgctgccgggcatgcgtgcgcggcgccgcggccatatcgtcaacgtcacctcgatgggcgggttcatcaccatgcccgggatcagcttctattgcggcagcaaattcgcgctcgaaggcatatccgaagccctgggcaaggaagtggcaccgttcgggatccgggtcacggcgttggccccggggcagttccggaccgactgggccggccgttccatggaccgcacgccgcgcagcatcgccgactatgacggggtgatggatccgatccgcgccgcccgccaggccaagagcggccatcagccgggcgatccggacaaggcggcacaggcgctccttgccctggtcgcggcggacgcaccacccgtgcggctgtttctgggcgcggatgcgctgggcctggtgacgcagaagctggaggcgatgcgggatgagatcgcgacctgggagcccctgtcccgatcgaccggctttgccgccgggtgacgctcagccctgggccagggcccgggcatagacgccgagcgtgcgctcgaccatcgcctcgaccgaatattcccgggcaagcccgcccgccgcctcggccatgcggcggcgggcgggttcgtcggcgagcagcccggccaccgccgccgccatcgcctgaacgtcgcccgcgggggtcacgatgccggcctggcccgtgccatggacctcgcgggcaccgcctgcatccatgaccaccgtcggcagccggcggtgcaaagcctcgatcagggtgtagggcaggccctgccagcggctgggcacgaccagcaggtcgaaggcggccatggcccgggcgccgttctgcacccccagccaggccatccggtcgatgccgcgccgcttcgcctcggcgcggatccggccggcatcgcggccgtcgccgaccaccgcccagacgggatccagccccatctgccgcaccgcctcggccagtgccggcagccggtcggcgcccttttcggcgaccagccgaccgacgaagcccaccaccagcgcctcctggggcaggcccagttcggtgcgggcctgggcgcgggtcaccggttcgggcggtgcgatgccgttcgccacccgctccagccggcggcgatcgatcttcagatattcccgggcatggacacgctcgtcctcggagacggcgatgatccgggtcgcgcgcgcggcaagcagccgttcccgcagcccggcggtgatccgcccgatcatgccccgatcggggtcgagcgtcgccaggccgtggggggtgtagacccttgcccggatccgctgccgccgggccgccaacaggcccagcagcccggccttggacccgtgaagatgcagcacgtccagcggccccgaggccgcgatgatcgcacggagcgccgccagatcccggcggtcgcccggatgcagatcggggcgcatcgacagctccaccgtctccacccgcccgcccagctggcgcagcccggccaggaaggggccgtcggcacgttcggccgaccagaccagggtgacctgatggccgcgcgccgccatgccctcggccaggtcgatgacattgcgcccggcgccccccagggtcgcctcaatcacctgcaggatgcgcaaggggcggtcgaaacggacaccggtcatggaggggagctttctggtacggcgcgatgtggctgtggatgaatggcggcggggatcttcggtcgccgcccggtctccgtcaatcccgggcgccgtcaatcccgggcgccgtcaatcccggggggcgcagcatgggcgcgctgcaggctggcagcgccgcccgtgccgggctatcgtcggcccacccattctgcctgtcttcgctgaggccgttccccatgaccccgatcacctgcatcgttctcgccgccggcaagggcacccgtatgcgttccgacctgcccaaggtgctgcatgccgtggccgggcgcgcgatggtgctgcatgtgatcgacggtgcgcgaagcctggcgcccgaccggatcgcggtggtggtgggtgccggtggcgatcgggtgcgggcggtgctggccaagaccgcccccgacgtcaccgtccacgaccagaccgaccagctgggcacggcccatgcggtgctggccgcccggccggcgctggaggcggccgccgccgacggcggcgacgtcatggtgctttatggcgacacgccgctgatccggcccgaaaccctggccgcactggcagaggcccggcgcgtgcaggatgccgcggttgcggttctgggcttccgcccggccgatcccggcgcctatggccggcttaagctcgatgccgatggccggctggaggcgatcgtcgagttccgggaggcgacaatcgaagaacgcgccatcggcctgtgcaattcaggcgtgatgtgcctggatgccgcagccgccctgtcgatcctggaccggatcggcaacgacaacgccaagggcgaatactatctgaccgatgcggtcgccatcgcccgggccgatggccgcagcgccgtggccgtcgaagccgccgctgccgacgaggtgctgggcgtcaatgcccgcagcgagctggccgcggccgaggccgcgctgcaggcccggcttcgtctgcgtgccatggatgaaggggcgacgctggtggcgcccgagaccgtcttcctctcggccgatacccgcatcggccgcgacgtgatcatagagccgaatgtggtgatcggcgccggggtcagcatcgccgacggtgtcgtgatccgcgccttcagccatctggagggctgcaccgtcgacggcggtgcgacggtcggtcccttcgcccggctgcggccgggggcagagcttggccggaacgcccatgtcggcaatttcgtcgagatcaagaatgcgacgctcggcgagggcgccaaggtcaaccatctgtcctatgtcggcgatgcccggatcggcgcgcgcagcaatctgggcgcgggcaccatcacctgcaattatgacggcgtcggcaaatggcagacggtgatcggcgccgatgccttcatcggctccgacagctgcctggtggcgccggtgacgatcggcgacggcgcctatatcgccaccggttcggtgatcaccgaagatgtggccccggatgcgctggccatcgcccgcggccgccaggtggaaaagcccgggcgcgccgcagagctgcgcgcccggttcaaaacccgtgcgggccaggactgatcggcagaggccgatcagtcctggccggccttccaggccttcacggtggcgaacaccgtgcccgacagcgccagcagggcgatgaggttgggcaccgccatcagcgcgttcaggatgtcggcgatcgtccagaccaggcccagatcggcgacggcgcccgcgaacagcgccgccacccaggccagccggtagggcaggatgaccttggggccgaacaggaactgggcgcagcgctcgccgtaatagctccagcccagaatggtggtgaaggcgaacagcaccaggccgatggtgacgatccagccgccgaaaccgggcagccccgcctcgaaggccgcggaactgagcggggcgccgctggcaccctcggtccacaggcccgacatcacgatcaccagcgccgtcatggtgcagacgatgatggtgtcgatgaaggtgccgagcatcgcgatcaggccctggcggaccggatcattggtccgggcggcggcatgggcgatcggggcgctgcccagacccgcctcgttcgaaaagatgccgcgcgcgacgccgaagcggatcgcggccatcaccgtcgccccggcaaagccgccggccgcggcggtgccgttgaaggcgccgtcgatgatcgtcgcgaacgccgccggcacccggtcgatgccgagcaggatgaccagcaacgcaccgccgatatagaacaccgccatcgccggcaccagcttctcggccaccgccccgatacggcggacaccgccgatcacgaccacgaagaccaggaccatcatcaccagcccgctgacccagagcggcacgccgaagctgtgctccatggcggtggagatggaattggcctgcaccgtgttgccgatgccgaagcccgccagcatgccgaacagtgcgaaaagcagaccgagccaggcccatttcgcgcccaacccgttgcggatgtaatacatcggcccgccgacatgggcgccggacaggtcggtttcgcggtacttcaccgccagcacggcttcggaaaacttggtcgccatgccgaaaagcgcggtgatccacatccagaacaccgcccccgggcccccgagcgcgatggcggtggcgacgccggcgatattaccggtgccgatggtggccgacagcgccgtggccagcgcctggaaggggctgatctcgcccgccacggccgtatcgcccggtttgcgccgcccgaaggccagcgcgaagccggtaccgatgcgccggagcggcaggaaacccagccccagcatcagatagacgccggtgcccagcagcagcacaagcgtcaccggcccccagacgacgcccgagacggcgcccagcaattcgttcaactcggtcatcttcacctcttcttccggcgcgggggcggccggcgcgggtcgaaagccccccgcgaggttcatcttgccgccaagattggccgctgaccggtgatgacgcaacctttccgcacccgaacaccgttcaattccgcagattcatgcaggaccatacgtccgctctgcgaccgcagggattgcacgccagctcggtgcggatcatgcttggcgccccgcccgtcctcgccggatcgcccgatgaccgagaccttccttgccctgctgcccgtcttcgccgtcatcctgctcggcgccgggctcaggcgggcgaagatcccgggcgatgccttctggccgatgatcgaccggctgacctatctggtgctgtttccggccctgctgatcaccagcaccgcccgcggcgcctttcctgccgccagcgccgtgccgatggcggcggcgctcaccggcggcatcctgatcatggcgggcgcgctggtcctgatccgccgcctgctgccggtggacgggccgggcttcagttcggtctttcagggagcgttgcgctacaacacctatgtcgccttcgcggccaccaccgccatcgccggcaagcagggcatggcgctcgccggtcttgcggtggcggcgatggtgccgctgctgaacctgatttcggtgatctgcgtggcggcctgtgccgtcccgccgggcgaggacgcgccgccacgcccgcctctgctccggctgatcgtcaccaacccgttgatcatcgcctgcgcgatcggcattccgctcggtgtctcggggctgggcctgccgccggtggtcgacggcgtgctcgacatcctggcccgcggctctctgccgctggcgcttttgtcggtgggcgccgggctgtcgctgcatctggacggccgggcggccttcgcgatcgggttttcgggcgccatcaagctgctcggtatgccgctgatcgccctgctgatcctctggcccttcggcgccgacgacaccacccggaccgtggcggtactctttgccgcatgtccgacggcgacatcggcctatattctcgcccgccagcttgggggcgatgcaccgctcgccgccgccgtcatcaccgtcagcaccttcgcggcgctgatcaccatgccgctgatgctggccctggtcgtgccgtgacgccccgcacagctttcggcttgacctcgtgcttccaaggcgttaccgccaagcccaaaggcgccaccgcgtgccggaacgagacgatcatccgccgcagggacaggaaaccgtgagccagccgagacagtccaggtccgtcgccgccaccgatcccgcccgccgcagcgccacagccgatgtggccgcggccctgatcggcgtgaccaagcgttatggcgcgatggccgcgctggacggcatcgacctgacacttcaccgcggcgaggtgctggccctgctcggcccgaacggggccggcaagagcacggcactttcccttctgctgggtctgcgcaggcccgatcagggccgggtagagctgttcggccgcagccccgacgatccggcggcacgcgccatggtcggcgccaccccccaggacaccggcttccccgaaacgctgaaggtgggcgaggtcatcgatctggtctcggcccattatccgaacccggtgcccaaggcggaactgctcgaccgtttcggcctcaccccgcttgccgcccgccagaccggcgggctgtccggcgggcagaagcgccggctggcggtggcgctcgccttcgccggccgcccggccgcggtcttcctcgacgagccgaccacgggcctcgatgtcgaagcgcggcgtatgctctgggcggccgtcgacggttatgtcgccggcggcggcacggtgctgctcaccacccattatctggaagaggccgaggcgctcgcccggcggatcgcggtgatcgatcaggggcgcgtggtcgcggaaggcgcgctcgacgacatccgcggccgggtcagcctgcgccgggtccgcttcactgccgcccatctgccgccgctcgacgccaaggcgctcggcatcgaacgggtcgagcgctcgggcaccgaaatcgtcctggtcaccgcccgcgcagacgacacggtccgcgccctggtgatgagcggggcgcccttctccgatctcgaagtccgggcggcaacgctcgaggaggcgctgatgtcgatcgtgcgcaccggccgtggggaggctgcgtgatggccggaaccgaaaccacccgcccgcagcaggccggtctcgcccaggtggcgacggcgcccgccgcacccggtttcggccggctgttcggcgcgcatctggcggccaatctcaaggaactcggccggtccagctcgttcgccatgtcgaccgtggccatgccctcgctgctctacctgttcttcggcgcaaccaacgcctccaacccggccgaggccgggcgcctcgccgccgcctgggggctgttcggcgtgctgggggtcgccttcttccagttcggtgtcggcgtcgcccagtcgcgggaacggccctggttcacctatctgcgcaccctgccggccggcggcggcccgcgcatcgccgcccaggtggcgaccgcccttgccttctcgctcgcggccgtggccccggtcatcctgctcgcggtgctgatcaacggtgccacgctcacctttctcgcctgcctgaaactgctgctggtgctggtgctgggcggcgtgcccttcgccctgctcggtctcgccatcggcttcagtgtcacggcccgggccagcgtgccgatcgcccatctggtctatttcccgctggccttcctgggcgggctgtggctgccgccggacatgctgcccgcgatcgtcaaccagatctcgctgctcacccccacccggcactatgccgaactggcctggagcgccattgccgacgggccgctgccgctggtgcactgggcctggctgctgggctggggcatcgtcttcgcctgggtgacgctgatggcctatcgccgggaccgcggccggcgcttcgcctgaccggccacacgctcatcagggtttgcaccgggcttgcggaagcggtcccccctcccgtatagtccgccgccgaggtgcggaagggtccttccgcgcccgccgtcgcacgcgcacggccggcgacagccgctcgccgggccgtcgggtcaagggactgccacatggacaccggctacgcacaccgccacctgctcggcatcgaggggctgaccgccgacgaaatcggctatcttctcgacctggccgacggctatgtcgacctgaaccggcaggccgagaagaagcggtcgacgctgaagggccggacggtcatcaacctgttcttcgagaactcgacccgcacccgcacctcgttcgagctggcggcgaagcggctcggtgccgacgcgatcaacatgtcggtggcgacgtcgagcgtgaagaagggcgaaaccctgatcgacaccgcccagacgctgaacgccatgcatcccgacatcctggtggtgcgccatggcgacagcggcgcggtgaagctgctctcggaaaaggtccatgccggggtgatcaatgccggcgacggcaatcacgagcacccgacccaggccctgctggatgcgctgaccatccgccgccgccgcggccggatcgccgggctcaaggtcgcgatctgcggcgacatcctgcacagccgggtcgcgcgttcgaacatccatctgctgaacgccatcggcgccgaggtgcggctgatcgcgccgccgaccctggtgccgacggcgatcgagcgcatgggtgtcaaggtctacaaccggatggaagaggggctggaaggcgtcgacatcgtgatgatgctccgcctgcagctggagcgcatgcacggcgccttcatcccctcgatccgcgaatacttccacttctacggcctgtcctaccagaagctggcggtggccgcccccgatgcgctggtcatgcatccgggaccgatgaatcgcggcgtcgagatcgacagcgagctggccgacgacatcgaccgcagcgtgatcctggatcaggtggagctgggcgtcgccgtgcgacaggcctgcctggacgtgctctgccgcaacctgccagcctgatccgccgccagatccgacagccgacgtttttcagggccggtcccgcacctgcccgccgcttctcccccaagggacatctgcgtcatgcccacgcccgtcttcgccgaaacgacgcccgaccgcagcccgatgcccggccgggtcgcctatgtcaacgcccggctgatcgatccggcgaccggcaccgaccgcatcggcacgctgctgaccgagggtgagaccatcgtcgatatcggcgccggcctcttcgccgatggcgtgcccgagggcgtgcaggtcgtggactgcaccggcctggtgctggcgccgggtctggtcgacatgcatgtccatctgcgcgagccgggccacgagcacaaggaaaccatcgaaaccggcagccgcgcctcggcggcgggcggtgtcaccaccatcgcctgcatggccaataccgcgccggtgatcgacgacatcgcgctggtcgatttcatccgccggcgggcgcgcgagacgggcctcgtcaacgtgctgccggtggccgcgatcaccaaggggctgaaaggcgaacagctggtcgagatgggcctgctggcagaagccggcgccgcctatttcagcgatgacggcctgccggtccgcgacacgctggtgatgcgccgggcgctgtcctatgccggcggcatgggcctgctggtcgcccagcatgccgaggatcacagcctggccggctgcggctgcatgaacgagggcgagaccgccacccggctcggcctgcccggcatcccgtctgcggccgagaccgtgatcgtggagcgcgacatccgcctgctggagctgaccggcggcaaggcccgctatcacgtcgcccatatctccaccgccgaggcggtggaggccgtgcgccaggccaagcgccgcggcctgccggtgacggcagaggtcaccccgcatcacttcacgctcgacgaccgcgcggtcggcgactaccggaccttcgccaagatggcgccgccgctgcgcgccgcccgcgatgtcgacgccatgatcgagggcctggccgacggtacgatcgatgcggtcgcaaccgaccacgccccccacgaccaggacagcaagcgcgtgcccttcgcccatgccgccaatggcgtggtcgggctggaaaccatgctgccgctgaccctggaactggtccgcgacggccatatgtcgctgatcgatgcggtggcggcgatgacgctgaagccggccgatctgctcggcatcgccgccggcaggcttgcgaagggcgcacccgccgatctggtgctgttctccaccgaacatgaatgggtgttgaacgcggccctgctgcattcgaagtccaagaacacccccttcgatggccgcaccctgcgcggtcgggcgctgcggaccgtggtccgcggccgtaccgtcttccagctcgcctgacccgcaaggccctcaccccagcccccctgatccccgcaggagcccccgcccatggctgcagagaccgccccctggctgctcgtcatcgccgccctgggcggctatctgctgggcgccatccccttcggtctggtgctgacccgcatggccgggctcggcgacgtccgcaagatcggctcaggcaatatcggcgccaccaatgtgctgcgcaccggcaataagcccctggcgctggcgacgctgatcctggacagcggcaagggggcggccgccaccctgatcgcgctggccctgctcggccccgatgcggcactggcggccgccgggggctcggttctgggccatctcttcccggtctggctgggcttcaagggcggcaagggcgtcgccaccgggctcggcgtgctgctggccgccgactggcggatcggtcttgccgcctgcgccatctggctggtcacagccttcctcacccgcttctcgtcgctggcggcgctggtcgccttcgccgccgccccggtgctgtcgtggttcctggccacgccggagctggccggcgtcacgctgttcatcgccgtgctggtcttcatccgccacaagaccaacatcgccaggctgctggccggaaccgaaccgaagatcggcaagaagaaggacggagcgggaacagatcaggcggagggctgatccggccaggcgtctccgatcgcggccacgatgcgcgcaagattggcctcgtcggtcgcgagcgctgcatgatcgcctgcaacctccaccagccggacatccgacgacaccctgtcccagcccagaagatggccatgcccggcatatgacgaccgggtatgcgatgtcacgatcagcagcagacggcagtcaagccggcccggctgccatcccacgatcatggcccggcgaatggccgaaatcagcgcccgttctacccggatccggttccggcgtcccggtgccgcccgccgcgcaaaggccgcgaccagcctgagcgcccgatggtcgggcctctgcgccagggtgaagaacagcttggacatcggctggccgatcccacgaaccagccgccgtcggaagcccggcgacggttcggggatcctgcccgcctgcagcagggaggccgcatcgtcatggctggcgacgatgtcgccgaccaccaccattccggccaccagaccgcgatcggccaggatctgcgccgcggcgaccgccagccgcccgccgaaggacagaccgaccagaccgaaatcaggcgtggcgccatcgggtccggccgcgccggtcagatgggcggcgatcctgtcggccacctccgccgccagatcctcgatgccccgccgccgggacagttccgcatccaggtccggcagggccaccagacgcaccgtcgccatcccggcacagcgcgcggccaggacgatcagatgccgggccatgcccatcacccccggcacgaaaaacagcaggcggtccgtcacgcccgccatgccgccactcaacgcccgacgcagatcggccggcgtgatcgcgccgttcagaagagtgaccggcaacggccggccggccagcgtctccacccgtgtggcgaagcgcatcaactccaggctgtcgccgcccagttcggtgaaggtcatgccggccaggggggcggcggcgccgaacatctcggcccaggcacggtcgacggcatcggccagcgccggatcgcccgtctcgccgaccgataccagtgccggcgccggagatgcgagaggtaccgtcggcaggtcagccaggcagtcggcaagagcgcgaccatccagcttgaaattggccagccgcggcagttccgccatcaccagcagacgccgcggcaccagatgcggcggcagctccgcagccaggcggctgcgcagggccgcagggtcgatcagccgccccggcgccggcaccaccacccccgccagggccgtctcgccctgcggtgtccggtccggcagaaccgcggcatcccccacccccggcagggcgcgcagggccgcctccacctcggccggctccacccgatggccgcggatcttgagctgaccatccgcccggcccaggaattcgagctgcccgtcggcgcggatcctgcccagatcgcccggacgcagccgccgtgcccccggcgccacatcgccgccggtcagaaaggtggcggcggtcagctccggatcccgccaatagcctgccgccatataacggctttcgacctcgatctcgccgatatcgccatccgggaccggccggcccccggcatccaccagccgcatgcttcggtctgcaaccggccagccgaccggcaccaccccattggtggggcaggtttcgcgatcgatcagccagtgtcggtagatggtggcattctcggtggagccgatgccgacatagatccgggcatcagccggcgcatcggcaaagacgcgcgccagatcggcggcaaggatccgctcccccgccagataggcgacacgaatgccgcccagcgccgccgggccggccccgccatcggccaggacacgcagcaccgtcggcatggcgtgaaagatggtcgggcgggtggccgcgaagcgccggccggcggcggcgacgccttcggtcctaaggtccaccggaatgacggcggctccggcgaggagcgcgccatacatgtcgcgaatggcaccgttgaccgctggcgaatacagccaggtcaggcgatcggcggcagagatgtccagaacgtcccgatactgaaaaacgtcgtgcagcagccccctctgggtctgccagacccccttggggcggccggtggagccggaggtgtacagaacataggcggcatcatccggcccgccccggggcgaccagccggccggcggcggcgccagatcgtcgatggcgagcaccgtggcccctgcggccatggccgccgccatcagctccggtcgcccggctgcggtcgcccgatcggtcagcaccagccgcaccccggcatggcccaggatcagctcgttgcgggctgccggaaaggaggggtcgatcggcacatagggccgcccggccgcaagcgcccccagcagggccgccaggcaaccggccgaggcggggatcgccaccgccacaggctccggcccctctccgcccgatccctctccgcccaggccctctccgcccaggccctctccgcgcgcccccctccggccgtcgatcgccgcggcgatccgcagcgcctgccccagcaggtcgccataagtcgtcgcagccccgggccccagaaccgcaggggcgcgggggttgcgggccgcgcaatcggcaaaaaccgcgaagaccggccgttccagacggtcgggcgcgatcggcaccagcagcgcctcgggcgtcgcggcaggccgcccgatcatgtcgtcacccggcgcagctgccacatcatccgcgccgcagcccgcagatccaccgacagcggcagcacgcaggcactggccaggatcatgcccccggcccccggcccggcgcgcagccggtccaccaccgcagccagatcgcggccgccccggccaatcagccggtggtcaagccccacggccggcagggcccccgccagcgcctgtgccggcagcgcctccagcacggcctgatccagatgcaccgcccagcgcgccgccccggccggcaggggccaccaggccgtggcatcggcctcgtgaagatgcagcatgttgaaccccagcccgtccgccgcggccatcacgcggcggtcggtgtcgtcgatcgcggccgccagccggtctccggcggcacctgcgggcaggggccagcggccatggccgcgatgcttcgcggcaagatagaccccgtcggcacccgcggccgcaatcgccgccaccagccgcacggcccgcgcggcaaccgcgcccagcgccgcaatcacggcctcgggcgcctcggccagatgccgggccagcacatccgtcgtcgccagctgggccagaaccgtcgccggggcgaacagcgtggtcagcagcggcaccggccgggtgcgggtcgcggccatatcggcggtcgccttcagaaccgcctgctcgcgcggatgccagggggctgccgccgcagcccacccgatccctacccagtccgacacggccgcgaccggccggtgcagaatggtgcgcaggcccaccggatcgggccgccagcaatccgtcaggccgaaggccgccgcctgccaggtgccggccggggtcagcttgatcagatcgccttcgagccgccgatccagagcacgcgtggcggtgaccagggccggggcggtgacgtcacgccgcggatgatgtcgccacagcgcgaccttcgtccggcgcccatccgcccgccatcctgtcccggctctgccagacacggcctcacctctctttatccacagatccgcctggtatgaagaccgccgcaccctaccccgagccgcgccccggcggccagaccggagcaacacattccggcgccgcccggtgatgaatctacaactgaaaagcgacgtacgcgcataattcctggatcattgacgcagaacgggatgcgcatgcattctgtggcccatgtccagaacccgcgtcggcgggctgacgcgggcggagcgcctcgactggttgaggctgatccggaccgagcaggtcggccccatcacctttttcgacctgctcgaccgctatggcaatgccgcggcggcgctggaggccattccggagctggcgaaacgcggcggcaggtcccgtccgctgaccccgccctcgcgcagcgcggcagaggcggaactgcgccggattaccgcggccggcgcccggctggtggcgctgggcgagcccggctatccggcgccgctggcccgcatccccgacccgccacccctgctccagatccgcggccatgatgccgtcgccgccgcaccggcggtggccctggtcggcgcccgatccgccgccctgcccgccatgcgcctcgccggccgcatggccgcagatctggccgcggcgggtgtggtggtggtctcaggccttgcccgcggcatcgatgccgccgcccatgacggcgccctgcgcgccggcccgggcggtgccggcacgatggcggtggtggcgggcgggatcgatgtggtctacccgccggaacacgccgccctccaggcgcgcatcgcggccgaggggctgctggtcgccgaacagccgccgggcaccgaaccccaggcccgccattttccccgccgcaaccggatcgtcgccggcgcgacgctcgccaccgtggtggtggaagcggcgccgcgctcgggctcgctgatcacggccaggcttgcgggcgattatggccgcgaggtgctggcggtgccgggctcccccgccgatccgcgttcggaaggcgccaaccggctgatccgcgacggcgcgaccctggtccgcgatgccgccgacgtgctggaggcgatccgcccgctgatcgaccggccgcttgccgaaccggtcatggagacggccgtcgccccgccgcccatggccccggatccggcggaactcgaccgtgcccgacgcgaaattccccgccggatcggcgcgtctgccgcacgtctcgacgatctcgtccatgagtccggcttgacggcggcgaccattctcacgattttgttggaactggaacttgccgggcggctcgatcgcctgcccggacagaaagtgtcgctgagcatgggctgatccccgcgccccggccgcggcgcgaggaaggcccgacgttcccttcgtgagatgggtaccggcgggtccgttgaagcgcggagaccagcaaggcagctcatgaaggtcgtcgtcgtcgaatcgcctgcgaaagccaagacgatcaacaagtatctcggcgatgacttcaaggtcctcgcgagctacggccatgtcagcgatctgccggcaaaggacggatcggtgcgcccggatgaggacttcgcgatgacctacgaggtcgatccgaagtccgaacagcatctgaaggccatcgccagcgcgctcaagggcgccgatcagctcttcctcgccaccgaccccgatcgcgagggcgaggcgatcagctggcatgtccacaatgccctgacccggcgcggcgcgctcaagggcgtgcccgtcaagcgggtggtgttccacgagatcaccaaaagcgcggtgcagaaggcgatcgccaatccgcgcgacatcgacatgaacctggtcaacgcccagcaggcgcgccgggcgctggactatctggtcggcttcaacctgtcgccggtgctgtggcgcaagctgcccggctcccgctcggccggccgcgtccagtcggtggcgctgcggctgatctgcgagcgcgaggccgagatcgaggccttccgcagccgggaatactggacgatcgatgccgaattcgccgcaggcgagcgccggctgctcgcccggcttcacgcgctcgacggcaagaagctcgacaaattcgcccttggttccgaggacgagaccaaggctgtgctgggccggctggaggcgctctccgactggcgcgtctccgatgtcgagcgcaagcagggccgccgcaacccggcgccccccttcaccacctcgaccctgcagcaggaagccagccgcaagctcggcttctcggccaaaaagaccatgcaggtcgcccaaaagctttacgagggcatctcgctcggccgcgagaccgtcggtctgatcacctatatgcgaaccgacagcgtcaacctgtcgaacgaggcggtggccgcgatccgcgacatggtcgaccaggtcaacggcccccgctacctgcccgaccggccgcgcagcttcgccaacaaggccaagaacgcccaggaagcacatgaagccgtgcgcccgaccgacgtgttccgccggccgaaagaaatccgttcccatctcgacgacgatcagttccggctctacgagctgatctggaagcgcacggtggcgagccagatggcggcggcgatcctggatcaggtcgcgatcgaggtgaccgatggtgcgaaggtcgcaaccttccgcgccaccggcagcgtcatcgccttcgacggcttcctggcgctctaccaggaaggccgcgacgacgaggaagaggacgaggaaaagcgtctgcccaatttcgagcgggccgaaccgctcgatcgcggcccgctgaaatccgaccagcatttcaccgagccgccgccgcgctataccgaggcgacgctggtgaagaagctggaggaactgggcatcggccgcccgtcgacctatgcctcgatcatctcggtgcttcaggaccgcaactatgtggtgctggacaagaagcgcttcgtgccggaagaccgtggctggctggtcaccgccttcctggtcagcttcttcgaccgctatgtcgaatatgatttcaccgcccggctggagaacgaactcgaccaggtggcagagggcgaggtggactggaaggccgtgctgcgcgccttctgggacgccttccacatggcgatcgacggcaccagcgacctcaagatctccgatgtgctgacggcggtcgaggcgcggctcgaatcccatgtcttcccggacaagggcgacggcagcgatccgcgcgcctgcccggcctgcgccaatggccggctgtcgctgcgcctcggcaagttcggctctttcgtcgcctgctccaactatcccgagtgcaagttcacccggccggtcggcggtgccgccggcaccggcgacggggcatcggaagcgggtgccaccgggctggatgtcggccccaagcatctgggcgacgacccggcgacgggcctgcccgtcaccctgcgcaagggcccctatggcgtctatgtccagctgggcgacggcggcaagggggaagaaaaacccaagcgcgcctcgctgcccaaggggctgacgccagaggccgtcaccctcgacatcgccctcggcctgctggccctgccgcgcgagatcggccaacatccggaaaccggcgagatgatcaccgccggcatcggccggttcggtccgtatctgaagcataacggcgccttcaaatcgcttacccccgacgacgatgttctgaccatcggcatcaaccgggcggtcgccctgctcgccgaggcgcctaagggccgcggcggttcggtcgcgccgctgcgcgtgctgggcgaacatccctcgggcggcgagatcgcgctctacaagggccgctacgggccttacgtgaagcatggatcggtgaacgccaccctgccccgcgcggccgatcccgaggcgctgacgctggacgaggccgtggccctggtcgatgcccgcgcggccgcgaccggcaagaaggcaaagccggcgaagaagacgtccgcatcgaaggccaaggccgagaagcccgcggccaaggcgacgaaggcatccaccgccaaggccgcccccaagcgcaaggccgccgcagcggccgagcccgacgaggtgcccttcgacgatgccgtgccggcgaaggcggctgcgaagacggcagctgcgcgcaagccggctgcgagcaaggcggccccgaagaaggcagccacccccaaggcggccgctgcgaagaagcccgcgccgaagaagactgccgcgaagacgagtgccgccggctgaggccggcggcaacctttcgcgcccccggatgttcgcccgaaacagcgggcaccgacctccaaccacttgatcgcacacggcaggtttgcgtgcccacggcttgcggggcggacgcgggcggcgtaccgtgccgcaggatgatgccggccgtgtgtccacgggcggcgcccgcagagaaagccaccagcagccttgacctcctcctcggacgacggcaccgaccgcctgcccacccgcgaacagatcctggccttcatcgccgagagcgaccgaccggtcggcaagcgcgagatcgcgcgcgccttcaacatcaccggcggcgcccgcattgcgctgaaacggatcctgcgcgagctgaaagaggacggctccctgaagcgcgccgggccgcgccgcgtcgccgaacccggcgtcctgccctcggtgctggtggtcgacgtggtctccatcgacgacgagaccggcgaggccgaagcccggccggcggtctgggacgacgacgagcgcgggccccctccgccgatcgtggtgctgcgcgaaggcggtctgcgcccgcgtgacgaggcggcccccggcttcggcgaccggctgctggtccgcctgcatcgcggcgatgccgatgcctatgaagcgcgggtgatccgccggctggaaacccggtcgcgccgggtgaccggggccatccgctcgatcgattacggctggcggctgatcccggccgaccgccgcgcgaagaccgattattcgatcgaagaggccgatctgggcggcgccgaggacggcgaattcgtcgtcgccgaaaccctgcccggccggcggctgggcctgccgcgggcccgggtggtgaagcggctgggccaggagcagacggcgcccgccatcatcgaccttgcgatcgaggcccacggcattcccgatcacttcccggccgccgccgtgcgcgaggccgaggcggcgacggcgccgaaactttccgccggtcgcgaggatctgcgctccatccccttcgtcaccatcgacggcgaggatgcccgcgacttcgacgatgcggtccatgccgagcccgacccggatccgaccaatcccgacggccacatcatccgggtcgcgatcgccgatgtcgcccattacgtcaccgccggcagcgcgctcgaccggtcggccgaagagcgcggcaattcggtctacttccccgaccgggtggtgccgatgctgccggaagcactgtccaacgggctgtgctcgctgcgcccgcacgaggatcgctactgcctggccgcgatgatgcgcatcgacggccagggcaccctgctggaacactgcttcgtccgcgggctgatgcgctcggccgcgcggctgacctataaccgggttcaggccgcgcatgagggccggcccgatgccgagatcgagccgctgatggcgccggtcatccggccgctctacgccgccttccaggtgctggatgccgcccggcgccggcgcggcgcgctcgagatcgacatgcccgaacgccgggtggtcatggacgagaccggccgggtgaccgatatccgcacccgccagcgcttcgacgcccacaagttgatcgaagagttcatgatcctggccaatgtggccgccgccgatacgctgctgcggcgcaaccggccctgcctgttccgcgtccacgaccagccgccggccgacaaggtctcggtgctgcgcgactatgtgaagtcgctgggcctcagcttcaccaactcggtgcatgtcgacccgcgcgacttcaaccgcctgctcaaggcggtggcgaacacgccgctggagcatcaggtgaacaccaccgtactccgcagccagtcgcaggcgacctacagccccgacaatatcggccatttcggcctgtcgctggaacgctacgcccatttcacctcgccgatccggcgctatgccgatctgatcgtgcaccgctcgctgatcaaggcgctgaacctcggctccgacgggctggacggggcggccgccgacggtctgcatgcgctgggcgagcatctgtcgatcaccgagcgccgcgccgacctggccgagcgcgaggtaaccaaccgcctgctggtggtgttcctggccgaccgggtcggcgccaccttcggcggccggatcaccggcatccacggtgtcggcctgttcatcgaactcgacgagaccggggccgacggttttgtcccgatctccaccctcggccgcgaattcttcatcctggatccgtcggaacaggccctgatcggcgaacgctctggcatgcgtttcaccctgggcgaccgggtggaggtgcggctgcgcgaggccgatatcgtggcgggcgggctgctgttcgaactgattgaaggcggccgtgccggcaagccgccgaccccgggccaggtcaagcgcctgaaggccatcgcccgcgaggtggcagccgaacgggcccgcaaccgccgcgatggcggcggcggccggggtccgaaaaccggccgcaaccagaacggccgtcatgggggatcgaggagacgctgatgatcgagaaccggctgcgccgcatcattcaggaagcggacggcttcgccgtcggcaccttcctgatgtccgacagcgccacctcggcggcgctgatggatgccgcgggctacgatttcctggcgatcgaccgccagcacggcgtgatcgacgacgccacctgtctgcgcctgctggccgaatgcggccgtcacggcaccacgccgatcgtgcgcatcccggccaaccggcccgaggatgcgatgcgggcgctggaccatggggcgctgggcgtgatcgcaccgctgatcgacgacgacgtcggcgctgcggcactggccgccgcctgccgtttcccgccccgcggcgggcgcagtttcgggccggtgcgcgcagcccccatccatggccgcagctatctgcaggccatcgacgacagcgtgctcgcgatcgcgatgatcgaaacccgcgccgggctggatgcgctggaccggattctggcggtgcccggcctggatgcgatctttgtcggccccaatgatctggggctggcactcggcctcggcttcaccggcgggcggaccgacacacagccggcgctggccgaagccgtgaccgccatcgtcacccgcgcccgcggtgccggcattccggccggcatccattgtaccgatccggcgatggcccgggcgatgcgcggccttggctaccgcttcgccacggtcggcagtgatcttgggctgatggcccaggcggccgccgccagcgccgaccagtcccgcgcctcctgatccacacgaaggccaatcctttccatgtctgtccgccccgagcatgccgccgccgccggtgccggccagccgccgatgttgaagcttgccctgatcctggggctgctcgcggccttcgggcccctgtcgatcgacatgtacctgccggccttcccggcgatcggcgccgatctgaaggcggatgccgcggccgtgcaagcgacgctggcgctgttctttatgggcatcgccggcggccagctggtctatgggccgctggccgaccgcttcggccgacggcggccgctgctggccggctgtctgctctacgcagccggcagtatcggctgcgcgctggcgaccgatgtcgaccagctgatcgccttccgtctggtgcaggcgctgggcggctgtgcgggcatggtgatgtcgcgggcggtgatccgcgatctgttcgatgaacgccattcggcggtgatgctggcccggctgatgctggtgatgggtgccgcccccatcctggcaccgctgatcggcggccagctgctggagatcgccggctggcgggcgatcttctggctgctgtcgggggtgggcgtgctggcactggtggtggtggcgctgttcctgcccgaaagcctgccggccgaacgccgccggcgccaggggccgggagagatcgccctcacctatctgcgcttcgccatcgaccggcgcttcatcgccccggcgctcgccagtggtgcggcgatgggggcgatgttcgcctatatctcgggctcgcccttcgtcttcatcgagctgcaccaggtgccgccggccgcctatggctggctgttcggcgccaatgccgccggcctgatcctggcctcgcagttcaacgcccggctggtgcggagcacgagcccggccgcgatcatgcgccgggccaatctggtccaggccgtggcggggctggtgctggtggcagtggcgatcagcgccgtttccacccccggcaccacgctggcgctggtggcgatcatgctgccgctgttcctgtgcatcgccatgaacgggctgatcaatcccaatgccaccgcggtcgccatggcccccttcggtgcccgggccggcagtgccgccgccctgctggggctgatccagttcggcaccggcgccatctcggccgccatcgtcggcgcgctcgacgacggcacggcctggccgatggcggcggtcatcgcgggcatggggatcgccggggcgatcgcggcacgtcttgccgcaccggcacccgcggggacgaggcgatgattgccatgcccggacgaaaccactactaatcgaagaagcgcgaccatcttaaaacgcgaaacgaatttgtgtttttctcgtttcgcgatgcggccctctccacgccagaccttggaagcttgagcgatgagcaacatccgtaccgagcgcgtgatcgacgttcaccactggacagaccggctgttcagcttcacgacgacgcgtgatccggcattccgcttcgaaaacggccagttcaccatgatcgggctcgaggtcaacggcaagccgctgcttcgcgcctacagcgtcgccagcccgaactatgaagagacgctggaattcctcagcatcaaggtgcaggacggcccgctgacctccaggcttcagcacatcaagcgcggcgacgcgctgctggtcggtgccaagccggtcggcacgctggtgaaggacaatctgcgcccgggccgcacgctctatatgctgtcgaccggcaccggccttgcccccttcatgagcctgatccgcgatcccgacgtctatgaccgcttcgagaaagtggtgctgacccatacctgccgcgaggtcagcgagctggcctatcacgactacatctcgaaagagatgccggcgcacgagtatttcggcgatgcggtgcgcgagcagctgatctactacccctcggtgacccgagagccgttccgcaaccagggccggatcaccgacctgatcgacagcggcaagctgttcaccgatatcggcctgccggaattcacgcccgagcatgaccggatcatgatctgcggcagcccggaaatgctcgccgacctgcagaaacgggccgaggaccgcggcttcaccgagggcaacagcagccgccccggcgaatacgtgatcgagaaggccttcgtcgaccgctgatcgacgcgccaccttcaggccccggcccggctcagccggccggggacggcacgcacggcctgcagacgacatcccgccgcctggccggcagctcggcactttccagcagttcccagagcggcagggacagcggcggcaccacccgccagtggaaggcgaccagcagccgggtcacaaccggcctggcgccattgccgtcgccctggcccagcggcagcaccatccgggcgtaatgcagccggcgccggctgccgggccggacatagagcgccagcgccagccagcacagcccctcggccgtggacggcccatagctggcggcggcgcggctgcgcagctcttccggcagcgcgtcgggcagctcacgcccggtcagatcccggtcgaacatctcgcgcaggcgctcgcccgccgtgcgcacccgccagcgatcggcggccagcacgtcgagcagcatcagctggggcaggatccggcgcagggcctgcggatcgacggcagacgggggtggcagggccgctgaagccggccgccagtcgcgccagaggtcgaacagggtcgcgaaggcgcccctccgccccagcagccgccggaacccctcttcatcaacctcgtatgccaccgccattccccgatctggtccgggcagccggtctgccgcccgcctccgcacgcggcccgcagcttagccgcaccggggtgaaatgggcagtgcccccttggaaatcatcacaaccggacacggcgcttgacaaggctgcgcccatgaataaggtgcacgtctctacgtccggcgccgacgttacggcgccgtcaacgaacacccgcgcgatcggccgccagccggtcgcccgcccccgggagaccgggggacggcggggcgccggtggcccagatgccgccgccctccggggcaaccggatagcgatacgaggattgagcgatggccaagcccgccaccgtgcagatcaagctggtcagctccgaggggaccggcttcttctacgtgaccaagaagaacccgcgcacccagaccgagaagctccagctgcgcaagtacgacccgaagctgcgcaagcacgtgctgttcaaggaagccaagatcaagtgatcccgccctcccttcggggaggatgcggatcgctcaggcgaccgacgacgcgaaaaaggccgcatgcccgatccgggtacgcggccttttcatttggcagactttttacctgaggcatccgaggcgcgtcttgagcgtccggaggcaggatcaggtgggccggtcgaagatgaagcagtcgcgcccggcggccttggcccgatagagcgcctggtcggcgcggcggagcatgtcgtcggcatcctggtcggccgggatgcgctgggccccgcccaggctggcggtgacggtgaccttggtgccctcgtcgtcgatcacgatcggctggcccgagatcaccgcccggacccgctcggccacttcgtgcgccgagcggtggtcgctgtcgggcagcaccatcacaaattcctcaccgccatagcgggccaccagatcgacgccacggacatggcggctcatccggtcggcgatcgcctgcagcacccggtcgccggcatcgtggccataggtgtcgttcagctgcttgaagcggtcgatgtccagcatcagcaccgccagcgggcggccgtcattgccggcgcgcatgaacatccggtgcagatgcgccgacagatagcggcggttgtacagccccgtcaggccgtcggtggcggccaaggcaatggagcgctgataattctgccgcagccggtcctgatagcgcttgcggcggacctgggtacgcacccgcgcgcccagttcgttcacgtccagcggcatcatcagatagtcgttcacgcccagatccagcgccttggccatgcgctcgacatcgtcatggcccacgatcaccaggatcggggtctggcgggtttcgtcgatcgcccgcagctggctgcacaggcgtagcggatcgaagctttcgatcagcaggttgatcacgatcaggtcgaaaccggcggtgcgcgccagatccagcgcctcggtcgccgtgccgaccgccgagacgctgtgcgtgcgcttcagccggtcggccagaaagtcgcgctcgatctcgctgtcgtccaccaccagcacgcgggcattgtcgccgctttcgtccagcggcagcggcgccgcggcaccgcccccgaaatccgagatggtctgctcgcgcagacgcagctcgtcgagcatcatcttgagccgggtgagagagcgcacgcgcgcgaagagcgccagatcgttgatcggcttggtcaggaaatcatcggcgccggcttccagcgcccgcacccgttccacgctgtcgctgagggccgtgaccatcaccacggggatatgggcggtctcggggtcgctcttcagccggcggcagacctcgtagccgtccatgcccggcatcatgatgtcgagcagaacgatgtcagggggatgggcatgggcacgggcaagcgccatctcgccgttctgcgccagatcgacgtcgtaatactccgccgcaagcttcgcttcgaagagcttgaggttgggcaggagatcgtcgaccaccagaacgcgaccgggcattgcccctcaatccagaaacttgcgcaccgtttcgaggaacggggtcaccgagatcggcttcgagatatagccctcacagccggcatccaggatcttctcctcgtcgcccttcatcgcgaaggccgtgaccgcgatgatcgggatcgtgcggagatcgtcgtcggccttgatccacttggtcacgtccagtcctgacacttcaggcaactgaatgtccatcagaatcagatcgggatgctgatcccgtgcgatcttcagggcctccataccgtcacgggtctgcagagtcacgtagccgttcgcctcaaggaggtcattgaacagcttcatgttcagttcgttgtcttcgacgatcagaaccgtcttcggcatggccaattccgccccgcgccatcaggaggtcccctcggccgccgcggcggcccgacctcacgtcgaacggcccgcgaccggcggttcgcctcgtaccggcgcacgatgcccggttccgatgaccgcagcaatcattttgtggccatccgtcaggcggtgcaacatcatgcgtgtccgatgggccgtttccgatcatgccccggcccggtcaagctggaggagaacggccacacatgttggacccggctgccgcaaacgatggctcccgtatgcagtcccgggtgcttgtcggcatcgatctgggcggcacgaagattgcggcagtcgccatcgaacgggcaacagggcgaacgcttgcacatttacgcatgccgacgccgcgtggcgactatgatgccaccatacggaccatcgacgagattgccgcccgcgcggaacaggcggccggagtgacggagcgcctgccgctgggcatcggcatgcccggcgccatcagccccaaaaccggtctggtgaagaacgccaactccacctggctgaacggccggccgctggaccgcgatttcacggcacgcaccggcagggccgtgcgacttgccaatgatgcgaattgcctggcggtgtcggaagccgtcgacggggcggcggcgggggcccgtctggtctttgccgccatcctgggcacgggcatcggcggcggcatcgccatcgatggccgggtgcatgacggcgccgatgcgatcgccggcgaatggggccacaccccgatgccctgggcccagccctggagccgggcccccggcgaaaccccgccgccgcaggccgccgacctgccggaactgccgggccctgcctgctattgcggccggacgggctgcatcgagacgctgctgtcgggccccgggcttgcccgcgatggcgcccggctgcgcgggctggacgacgacgccgccgccctggaacacagcgccgaggccgtgctggcggcggaacgggccggcgccccctgggcgctggcggccgtggcgcgctggcgccatcgcttcggccgggcgctggccatgatcgtcaacatcctggacccggatgtgatcgtgctgggtggcgggctgtcgcaggtgccggcactggtggcggatcccgggcctctggtcgcgccctggctgttttccgaccggatgcgcacgccggtgcgcattgcgcgccatggcgacgacagcggcgtgcgcggcgccgcccggctgtgggacagcgcctgaccgcaggatcggcgggccgtggctcggcactggacgcgaagcccgccgcgtgggaacatgaccggaacatccggccgttcctggcgagtgccacagcccatgtccgcagcccctgccgccgatgacggcggcacagatcaggcttacccacccgcaggctgcgcccctgcatcggccgcggggtggctgtgccgcgactgcggatccacccgcatggccgaagacggcaaccggcgctgcccggcctgcggttcggcgcggatcgtgatccatcccgaactgcaccggctgaccatcgcccatgtcgattgcgatgccttctacgcctcggtcgaaaagcgcgaccggcccgatctggcgcaacggccggtgatcgtgggcggcggccatcgcggtgtcgtcgccacctgttgctatctggcccggatgaagggcgtgcgctcggccatgccgatgttcaaggcgcgcgaactgtgcccggatgcggtggtgctgccgcccgatatggcgcgctatcgcgaggcggggctgaagatccgccggctgatgcgtgccctcaccccgctggtcgagcccttgtcgatcgacgaggcctatctggatctggggccggaggcgggggcgcccgacagtcgggccagccccgcccagcgcctggccgccctggcccgccgggtggagcgcgaggtgggggtcacggtctcggtcgggctcggccccaacaagtttctggccaagctggcctcggaactggacaagccgcgcggctttgcggtgatcggtacagccgaagccgccgccttcctggccgacaagccggtgcgcatgctgtggggggtgggcccggccttcgaacgccggcttgccacagacggcatcacccggatcggccagctgcaatcactggggccgcaggcgctggcccgccgctatggccggatcggcgcccagatcgcgggctttgccacggggcgcgacccgcggcgggtgacgccctcgcgcccggccaaaagcgtgtcggccgaaaccacgctggcccgcgacgaacgcgccgccgaccgcctggcagagctgttgccgccgctggccgaacgggtggcggcccgtctggccggcagccgtctggtggccgaaggcgtggtgctgaagctgaagaccgccgattttcagaccctgacccgcagccggcggctgaaggcgccgaccgatcgatcggcgcccctgatcgccgcggcacaggacctgctcgccgccgaggcgaccggcgataccgccttccggctgatcgggctgggcgcccagccggtgcgcgaccgggacggcgaccccgccgccccggatctcttcggcaccggctgacggatcagcccggcagcgcgaaggtcagcgtggtgtgggccacgggctcgtcgtcgccgtcggaatagagcgacacctcgccataggccagcctgcggccgcaccggatcagccgtgcttcggaaagcacgtcgaccatggccgggcggcgcaggaaattgatggtcagattgctggtcaccgccatccgcgccgggcccagccggcccatgatcgcggcatagaaggtgacgtcggcaagcgtcgccagggccgggccgctcaacgtgccaccggggcggatcagctgcaccgtggccggaaggcggccccgggcgctaccgtcgtcgatccgctcgatacggatgccgagcagctcggccatgggcaattcatcacgaatgatctgattgaaggcgtcgggacggatccggtcgaggccgggttcgaccattacagtcatgcgtggcgtctctctgttcggaacgcactgagggaacgggttctatcagtcgcactcttccgccgtcggccggttttctaccgagacgagacgagcagatatcgcaaattcaccgtaatctatatcgaatcgccggacgaccccgttcggctggatctggtaaagaagctcatagatcggcgtctcggaccgatcgtcgggcttgaagaaggccagccgcatcggaatgacggtcgccgtgcgcagcgcatccgccgcctcccccgcctggaccggccagtcctggtcggccgcgatctccgtcggccggccgatatgggcgctcacgaaggacaggctgtcctgccccgatccggtcagaacctgggcgcggatgaaggcctccccggcctccgccgcctgaagcagccgctcggtatgggcggtgggcagcagggcaccggccggcacgctctcggttacgcccggcggattggcgaaacgaagtttcgaaggacgatccggtgacgtccgatcgagatgggcgatggccagttcgacgctctcgccgttttctcgctcttcgtaacgaaaccgaaaccgtgtgccgtcgtccgactcctcggaatcgaacaggatgtccgacaccaccggttccgcctcgtcgaaatcgatctccatccggctggcctgcagcaccgaccagccgtcacaggcccggtcgaagatcaccgccatatcacccgcgacgccggcgatcgcggcatcgggctgggctttcagcaggctcatcgcgtaatgcgcgcggtgcggcaccgaatgcggggccgccagggccgcgggcatcagggccaggacggttccggccgccgccacgcatcccaggatcccttgcccgatccggaaccgccctccggttgcgatcaggcgcggcatcacgaccagacgcgacatcacggctcgacgggcggcggcggaacggctgggcagaggcatgggcgaaagctccgggatctgcggtcgggaagacgtctgcggggcgcaggccgccggcgccgcgggcgcaagagtgtgccacgggcggaacctgcccggaaggcccgcccgcgcggccggcttctctcagcggcggatcccgccatccagtgttgcaaccgcgccgtaaagatccggacggcgatcgcggaacagcccccacgaggctctcagccggcgcgccatcgccagatccagctctgcggtcaccaccgcatcgccgctgcgcccggcctcggccaggatcgcgccggtcgggtcggccacgaagctggatccgtagaaggtgagcgtggcatcgcggcccgcctcggtccccacccggttggcggcgatcaccggcaagatattggcgccggcatggccctgcatcacccgccgccaatggtcgcggctgtcccagtccggggcctgaggctcggacccgatcgccgtcggatagagcagcagttcggccccagccagcgccatcgcccgggctgcttcgggaaaccactggtcccagcagatcgcggcgccgatccgccccagcttcgtgtcgaacaccctgaagccggtgtcgccgggcgagaaatagaatttctcctgatagcccggcccgtcggggatatggctcttgcggtagaggcccagcacccggccgtcggcatcgatcatcgccaggctgttgaagaaggcctggccggcgcgttcgaagaagctgaccgggatcaccacccccagttccgccgccagggccgacagccgggcgatcgcgggattgccctcataggggcgtgcggcatcgaaccaggccgggtcctggtccttgcagaaatagggcagctcgaacagttcctgcggcagcaccagccgggcgccggccgcggcggcggtgcggatcatctcctcgacccggtcgaggttccggtcacggtcgtcggccaccgccatctgcagggcggcaaccgtcagcaggccgtcggtcatgtcggaactccgtctgcggcgtctgaaatccgggacatatgatccgctcagcctatccggccccggcctctcgccgcaaccgaagcccttgtgacaaggctgcggcgccgtggcggtttcgcaacaggtggtttccaatcctggacataattcctctcatgatcgacgagcagtgctttctataattgacgttaacgtaaacgttacttaaccatcgagtggttcgagggaattcaatccgggttgtacacccgctttggatacccacgacacatcctgaaagggaatctttccggatcaaaagaatcttaatggggaaacgtccgatgcacgcccgtccgcccagacgtcatccgggccgcgccgccgcggccagcctgccaacccttctcggcctgcccgcgcttgcggcggccctgctcgccgccggccctgccggggctgccggcttcttcatccaggaacagagcgtcaagggcgtcggccgcgcctttgccggcgaagccgccctcggttccgacgcctccaccatcttcaccaacccggcgggcatgacccggctcgacggtcgccaggttcaactgggcggccatgtgctgatcctgaaggcggatctgaccgatgccggctccaccgccaccaccctcggcaccggcggtgccgcggtgcgctatggcggcgccaatggcgaccccttcgacaccacgccggtgccgaatttctacgccgccatgccggtggacgacgaccaccgggtctggctgggtgtgggcatctcggcccccttcggcctggtcgccgactatggcgacggctggttcggccgctacgattcgaccaagaccgaactcaagaccatcgacatcgcccccagcatcgccttcaaggccagcgactggctgtcggtgggcggcggcctcgacatccagtatgccgaggcgacgctcgaaaatgcggtcgccaacggcctcgccccgggcgggcccagccccgcaaccgacggccatgcccgcgtcgagggcgatgactggagcgtgggctacaatctgggtgtgatcttcaccccggtgcctcaggcgcggatcggcctgcattaccgctcggccatttcccacgacctgaagggcacggcctcgctcaccgatctgaccggcccgctggcggcggccaatttccgctccgatggtcaggcggcgctcgacctgccggccgtcgcctcggcagcggtggcggtggatgtcaccgaccggctcaccctgctcggccaggtgaacttctacgaatggagccggttcgacgagatccgggtgcagttctccaacggcctgccggattcggtgaagacccagaattacgaagacagctggggtgtcagcctcggtgccgaataccggctggatccggcctggacgctgcgcggcggcgtgcagtgggaccagacgccgacggtcgatgaataccgcaccacccgcacccccgatgccgaccggctgtggctggcggccggtgccagctgggaagtctcggactggatcggcatcgacatggcctatgcccacattttcgtcgacgacacccggatcgacctgatcgagccgggcatcggcggcaccggtcaggtcaatgtccgcgccgatgtggaaagcagcatcgatatcgtcagccttcaggcgcgcctgaagttctgatcacccggcccctctcgccgccctcccggccgacgacctccgtctagcggaggtcgtcggccggggcggcctcgatcaggccggcgtcatcggcctcgggcatcggggccggttgcggcagggccacggccaggcgggcgaagccgccgaagggagccagcgccgggcagggcacctgctcgatcgccgcggtgggcagggccctggacagggccttcagcgccgctgcatcgttgccgtcttcgaagcccggcaccaccagccggcggccgtcacgcagcaggctcagatagcttgcgggcagcagccgcccggcgtcgtcccgcggccggcgcttcggcaggggcaccggcaccacgctcatcggcatgccgtcggccagggtcaccacctccagccggcgccggatctcggccagggcggcatgatccggatcgccttcgggcgccaccgccacggcgaccacccccggcgccagaaaacggaccacgccatccagattgccgggccgctcgtcgcccgaaaatccacccggcacccagaccacgcgggtcgcgccgaaggttgcggccagatgcacggccatggcctcgcggtcggcctctcgcccgccgaccagcacctcgcttgctaccagcaccccgccgccatcggccgcgaccatgccggcccggccgtcgatgtcgagcaggatgcggcccaccgtctcgtcgccggccagcgccagcaggcggccggccacgtcgcaatcgtcgtgatggtggctgcggtcgaccggccattccaccgcgcagggcgcgccatcggccgtccgccccatcgacgggcggcgatcggcaaagcaggccaggctgccttcccaggacgacacccccaccccggcgccgcagcgcatcgaggcgtcggcaagatcgccggcgcgagccagcatggcgacctgggtgtcgcgggccagaatgcgggcggcctcggcgatggcgaggccggcatcgcggggatcgctgatgccgtcggccgccgacggccagacggcaagccacagccgggccggctggtcgggggccggcaggtggcaggaggggtgcggcggggcacccggatgcatgaacatctcggacatgagggcgtctccgctccggagcgccgggatgctggcagggcgatcatgaccgggggcggcccgctaaacaggcggggccggtcctgcccggcatgtcgggccgcagtctccggcgtgagggggatcgatcgtcgctggtgcggatggcgtgccgccgaggtcgggccttgcctcgtctggtgttcccgtcgttgccgacggcacgtctggtcgtgtcccggatcccatcctagcgcgtgtgggggaagaggtgcaatccgcagcagcaccccgccccctcctccatccgaagcccgcccctatccgaagatcagccgcgccgtttcgcgcgcgatcaccgcctcttcatcggtgtcgagcgccagaaccagcaccgggctcgcagcggccgaaatcaccgggccgtgggcggcattggccgccggatcgagggtcacgcccagaaagcccagatgggcggcaatgcgcgcccgcatgccggctgaataccgcccgatgccggcggtgaacaccagcacgtccagtccgccgatcgccaccgccaccgagcccgcctcgcgaccggcacgataggcgaacagggccatcgcctcttcggccttcggatccgatgaggtctccagcacgcgcatgtcgtcggagacgcccgacacgccgagcagacccgagcgggcattcagcagccggtcgacctcggccgccgtcatgccccggtcgcggatcagatgcagcaccacgccggggtcgatcgcccccgaccgcttgcccatcatcagcccgtcgagtgctgtaaagcccatggtggtcgccaccgaccgccgggcgagcatgccgcaaaggctggcgccgtggcccagatgcgccacgatcacccgcccgtcggcgcgcgggccggcatgatccggcagcacatgggcgatatgggcgtaagacaggccgtggaagccatagcgcagcacgccctcgtcggtcagctcccgcgggatcggcatggtctgggcgatccggggctggctgcggtgaaaggcggtgtcgaaacaggcgacctgcggcagatccggccagagcttccgggtcgcggcaatccccgacagattgtgcggctggtgattgggcgccagggccacgaagccctccagcgccgcgatcaccgcatcatccaccaccaccggcgcatcgaagcgggcaccgccatggaccacgcgatgtcccaccgccgccacctcgcccaggttgtggacgaccgccgcgatccggtccagcgcccaggccgtcagcccggcatgatcggccaggccctccggtggctggccgatctcctccagatgcgcgccgcgccccttggccgacgggcccctcagcgtgccgatggattcgacctcggcccggccgatctcctccatgtccgacaggcggacgacgccgaatttcaggctcgacgagccggcattcacggtgatgatcagctgctcggtcatggccgtgccccacgatggacgaagatctgcgccagtgccgccgaggcgaggcgggcggccgggccgtcggcacggctggtcagcatgatgggcacgcgcgcgcccagcaccaggcctgcggcctcggcgccggccagatggatcagctgcttggcgaccatattgccggcttccagatccggggtgaccaggatgtcggcatcgcccgccacctcggacacgatacccttggccttggccgccgccttcgagaccgcattgtcgaaggcgagcgggccgtcgagcaggccgccggtgatctggccgcgatcggccatcttgcacagcgccgccgcttccagcgtcgaggcgatggccggatagaccgtctctaccgccgacaggatcgcgaccttgggccgatcggtccccagcgcccggaccagatcgatggcgttctggacgatgtcgcgcttggcggcgagatccggatagatgttgatcgccgcatcggtcacgaacagcggcttgggataggccggcacgtccagcgcgaagacatggctcatccgccggccggtgcgcagacccgtcaccttgtcgacggcggcggccatcacctcgtcggtgtgcagcgcgcccttcatgatcgccgcggcctcgccctcgcgcaccagcgccaccgcccgttcggcggcggcatggctgtgtggctggtcgacgatgcggatgcccgacaggctgcgcccggcggcctctgccgccgcccggatcttggcctcggggccgatcaggatcggctggatcagcccggccgccgccgcatccagcgcgccctcgatcgaattggcatcgaccggatggaccacggcggtcgcgatcggcggcagatcggcggtggccgccagcaggcggcgatagaccggccggttctcgggcgccgccgcctcggcggcgacggtcgcctgcggggtcacgacgaagggccggtcgacacgggcctctgcggcacggacctcggccgatccggtcgcgaccagccggccatcggccgcgaccacggtcgcatccagcgtcaggcggcgatcggcgcccagcgtccggaccaccagctttgccgtcagccggtcaccggccgccacctggccggtgcggtccagccgcgagcccaggatttcggcgccggggccgggcagttcggccgcgatcagcaggtcgatcatcagccccggcagagcggtgaaggcggcgacgccgcgaaagccggcatcggccgcgagtgccgggtcgatatgggcggggtcgatctcgcgggcgatctcgcccagccggtcggcaagcggctggcctgcctcgtgaaccaggcaggcgctgtcgccggcacggatatcctcgaacggtcggttggcgatcctgagcatgggaacggtcggtttccgggcctcgtgtggacggacgcttggcttgttgctttgcaccatcctcgccggaatgcgtgacgattgcgacctcgagtttgcccccgcggccgatcgtcccgccgcccatggcgcccggtcaggccgcgtcggccgccttcttcttcgcggcagccgcccggatgcgcgcctcggccatggcatccgccacttcggcggtggtgcggcccgtcctcgccgcttcggcgaagatgcgcgacatggtgtcgccgataccccgaaccagcgccgtcgcccgcgccacgtcatagcccgccggcccgtgctcgaccgcgatgttgatcacgccgccggcattgatcacgtaatcgggggcataaagcacgccccgatcggccagcatccgggcatggcgcggctccgccagctggttgttggcggcaccggcgacgatgccggccttgatctcggggatggtgcggtcgttcagcaccgcgcccagcgcgcagggggcatagacatcgaccggctcggcatggatcaccgccgggtcgacgacgcgggcgccggtcgcggccgccacgcggtcggtggcatcgcggtgaatatcggccaccaccagccgggcaccggactcgtgcagccgccgggccagatcggcccccacatggcccagcccctgaaccgccacggtcacgccggtcagctcgtcgctgccgcgggcatgggccagggccgcgcggatgcccagaaaaacgcccagtgccgtgaagggcgacgggtcgccgctggtctcggccaggcccagaacatggccggtttcgcgccgcacatgggccatatcgtcggtgccgatgccgacatcctcggccgtgatgtagcggccggccaggctttcgacgaagcggccgaaggcgcgcatcatcgccggtgtcttgtcgcggcgggcatcgcccagaatgacggccttggccccgccaaaatccagccccgccatggcgttcttataggtcatgccgcgggccagccgcagcacatcggtcacggcggcggcctcgtcggggtaggcccacatccggcagccgccgacaccggggcccagcacggtggaatggagggccacgatcgccttcagcccggtttcgggatcatggccgaagatcacctgctcgtgaccgtcgaacgcggcacaagaaaatacggacatgttttctccccttcggccatcttcccaagatggccgactgtcttcgccgaagcgaattctgttgctgttgggagtcaatctgtcaccgcgccgcagggctttcaatcgcccaccgcacgcccgtctgaaatagagggaaagttgctggccgccaattcgacgtcattttcccttcgaaagcacccggaagaattggtaataaaattacctgtcgtgacagggggattcggggcgctcagctcccgcgatcggcgatctcgtcctcgaccgcctcggggtcggcgccgcgttcggcgatgtcgcgatccagattggcgatcacccgcaccagcaggtcgcgcagaccgtaaatctcatcgctggcaaggccgtcgatggcggcgatattggtttcggccgcacggggcagcaattcgtgacgcagcgcccggccgcgatcggtcaggtagaccaggctgcggcggcggtcatgcacgtcgcgctcacggcgcaccagaccgcgtcgctccatcagccggagcgccgtcaccgtcgtcggctccatcatccggatgcgccggctgaggtcgcgctgggtgatcccctcttcctgccacaggatgcgcaggaaaaaccacatgcccatggtgacttcggtatccgccacccgcatctgcatggcacgcagataggcccgatgggcatcacgcaccaggtagccgatgctctccagcagggggaaatccgccccggccatggcctgctcgtagacttcggcggccggtcgcgcgccatgaccgggtcttcgaggatccgacgacaccatcagttgcttccgatcgtaaacaatgtcgcattacgattgaagcataccacggctatcgcccccgccaagggcctgggcgcgttcattctgccgccggaaacggctccccgtcagatccggcccagaacagtccaccatacgagatcaagcggccagagcagcagcattgccgccaacccgagcgcgatcatcgcccgcgccgccgcgccctgaccgatgcccgacaggccaagcgccacgatcaccggcggcgactgatagggcagcagggcggtggaaaagcccagcgcctgtgtcatcagcacggtgtcgagcgacagcccggtcgcctccgccagccgggcggccagcggtgtcatgatcgccggtgtgccatgcagagagcccagcagcccgaccacggtcgagatcagccccagcttgtagacgttgagcgcatcggccccgggctcgaagccggcaaggtcgatcatcaccccgcccatggcatcgcccagccccgcggccgagatcacggcccccagcgacagcatggcggcgatgaagatcagcgtgccgaccggcaggccggtgcggatgaaatccgccggcaccaggcgcaggccgggggtcaggatcagggccgcggccgaaagcccgacccaggccggcttcaacccgtgcagccagtcggttgcccaaagcgccaacgtggcccccagaatcaacgccagccggcccagcgcccgcgggtcggccgccacacccggcgccatggccccggcctcacgcgccccggcctcacgcgggggcggggcgggaaacagccgcaccagcagcaccaccagcagcaccgccttcaggatgcccagcaccgggaaatgcagcgccagccagccgccatagctgaaatgatggtcgtagagcgtttccgccgcgccggtcaggatcatgttcggcacattggccggcagaatgccgaagggtggaaagaaggtgcccagcgccgccgccatcaccagcccggtgcggccgggatggccggcgtcatagcccgcgcgctcggccagggccagcgcgatcggcaccagcagcgccacccgccccaccgcggccggcaccagaaaggcgagcagcacgcccgccgccaccatgccggcgatcagcgccgcgtaagaggtgccgaacacgcccgccgcctggcgggccagacggtcggccagccccgcatggcgcgccgccgccccgaagacgaggcccgagagcaccagccagaaggcgccggaatggaagcccgagaacaccgtatcgggtggtgccacccccaggatggcggccccggcgaagaacaggatcgcggcataggcctcgggtgcggcggcagtcgccaccagaaccagcatggcgagggcgagcccgcccgcctgccaggccggggccacatccccgaacatccagggggcgatcacggcaagcagaagccctgccgccgagacgatcggcggcagggcggctgatatcaggcccggcattctgcgtggagcggcggacacggccggtcaggccgcctcgcatttcgcgcgtagggcgcgcgacacccgccctgccggcggccggcccaactgatccgagatgaaccagccggcctgcagcaccgcatcgaaatcgatgccggtacggatgcccatgccgttcagcatatagagcacgtcctcggtcgcgacattgccggtcgcccccttggcataggggcagccgccgagacccgcgaccgaggcatcgaccacggcgatgccttcttccagcgccgccaggatattggccagggcctggccataggtgtcgtggaaatgcaccgccagcttctcgcgcggcaccacggccgcgacggtgtcgatcagcgtcttcaccttgccggcggtgccggtgccgatcgtgtcgcccagcgagacctcgtagcagcccatctcgtagagcgccttcgacacctcggccaccttcgcggggtcgatctcgccctcataggggcagccgagcacgcaggagacatagccgcgcacctgggcgccggcctcgcgcgcccgctccaccaccgggcggaagcgctccaggctttcggcgatggtgcagttgatgttgcgcttgctgaaggcttccgatgcggcgccgaacaccgcaacctcgtcggcccccacttccagcgccaattccagccccttcagattgggggtcagcacggggtagcgggtgcccgggcgccgggtcaggccgcgcatcacctcggcatgatcggccatctgcggcacccatttcgggctgacgaaggcggtcgcctccaccgccggcaggccggcggcggccagacgctcgatcagctcgatcttcacggccgtgggcacgacctccttctcgttctgcaggccgtcgcgcgcgccgacctcgacgatccggacctcggaaggcagggccatgatctcgtcctccgtctggaattgcctcacgccttggcctcggcgggggcgaaggcgatcagctccgccccgtcctcgaccaggtcgcccgcggcataatggaccgcatcgaccgttccgtcgaccggagccgagatggtgtgttccatcttcatcgcctccagcacgatcagcggcgtacccttggtgaccgcggcccccgcctcggtcagcacctgcaccaccttgcccggcatcggcgccaccagccggccgccgcccgccccctcgtcgcccgtgaaggcgaaggggtcgaagcgctcgaccgcggcatgcctcccccgccgcccagacatgcacccgcgccccgacctcggcgacccgggcggtgaagcgatgaccgtccagatcgacgatcatccggccgtcggcctcgatcgtggcgcggaccggctgctccggcccctcgcccaccgacacgccatagccggccgcatggaaatgcacccgcaccgcgatttcgcgctcgccgtcgcggaaatggtcatcgacatggctgaccgcgttcatccgccagccatcggcgatcgcccatgggctgtgcggatcgctggatgccgccgcccgctccgccgtggcgccggccagcaccagcagccggtggagcgccgccgtcgccagcacccggtccgagaccggcaccggcccgggcagcagatcggcgcggtgccgctcgatgaagcgggtgtcgagttccgcggcggcgaaggccggatgggccgccacccggcgcaggaaggcgagattggtcttcaggccggcgacttcgtaatcggccagcgccgcctgcagccgccggatcgcctcggcccggtcggcgccgtggacgatcagcttggcgatcatcgggtcgtaatggatcgacacctcgtcgccggcgcggacaccgctgtcgacccggaccccgggcccgatgggcggcaccaggtgggccagccggccggtcgccggcaggaagtcgccgtcgggatcctcggcatagagccggacctcgatcgcatggccgttgatggtcagctcgtcctgggccagcggcagcggccggccatcggccacctgcagctgccagtcgaccagatcctggccggtgatcgcctcggtcaccggatgctcgacctgcagacgggtgttcatctccatgaagtagaaggcacccttgccctcgggcgaggcatcgacgatgaactcgaccgtaccggcgccgacatagccgatcgcctgggcagccttcaccgccgcctcgcccatcgcacggcgggtcgcctcgtccatgccgggtgccggggcctcttccaccaccttctgatggcggcgctggatcgaacagtcgcgctcgaacagatagaccgcctggccgctctgatcggcgaagacctggatttcgatatggcgcggcgtcaccagatacttctcgatcagcacccggtcgtcgccgaaactcgccgccgcctcgcgcttggcaccggccagggccgcggggaattccgcctcggaatgcaccgcgcgcatacccttgccgccgccgccggcggtcgccttgatcagcaccggccagccgatccggcgggcttccgacagcagcagctccggatcctgatcctcgccgtgatagccgggcaccagcggtacgccggccttttccatgatccgcttggcggcgctcttcgatcccatcgcccggatggcatcggcgggcgggccgatgaacaccaccccggccgcggcgcaggcctcggcgaaggcatcattttcggacaggaagccatagcccgggtggatcgcctgggcgccggtgtcgcgggccgccttcaggatcagatccgccttcaggtagctgtcgcgcgccggcgcgggcccgagcagcaccgcctcgtcggccatttcgacatgggcggcgttgcggtcggcctcggaacagaccgccaccgtggcgatgccgagccggcggcaggtgcggatcacgcggcaggcgatctcaccgcggttggcgatcaggactttgccgaacatgcgtgtcggtccccggttctgaagtcttggcgtgaatgacggaagcggaaggtttttcgggcgtcagccgcgccaggacggcgtgcgcttctcaaggaaggccgtcagcccctcgcgcccctcgtccgaggcacgccggtcggcaatgcgggcggcggtatcggccaccaccgcatcgtcgatcggccggccggccacggcgaaggcgagatccttggcggcggccatggcctcggggccgttggcgagcatcagctgcaccagccgctcgcccgccgcctccagttcctcggcggccaccacctcgtggatcagcccgatctcgcgcgcccggtcggcatcgatcgcctcggcggtcacgaacagccgccgggcccagcgcaggccgatcgcgttgatcacataggggctgatcaccgccgggatgatgccgagcttgacctcggtcagcgcgaatttggcccgcggggtggcgatcgcgatgtcgcaggctgccaccagtccgaccccgccgccataggccgccccctgcaccagggccagggtcggcttcgacagatcgttcagcgcccggaccatggcccccagcgcgcccgcatcggtcaggttctcgtcccggctgtatccggccatgcgccgcatccagttcaggtcggcaccggccgagaagctcttgccttcggcggccagcaccaccacccgcaccgcgggatcgtcgtcgagcgcccggaagatccgggtcagttccgcgatcagcttgtcgtcgaaggcgttgtggatctcgggccgcgccatggtgacgcgtgcgacaccccggtcatcggtcgagacgaccacggcaacgggagaggtatcggtcatcgtccgggcatcctcgattggctgtctggcagggacggaggcaggaagggagggcgtccgtcacatgcggaacacgccgaagcgcgtctgctcgatgggtgcgttgagcgaggcggacagtcccagccccagcacccggcgggtgtcggccgggtcgacgatgccgtcgtcccacagccgcgccgaggaataataggggtggccctgaacctcgtactgctcgcggatcggtgccttgaaggcgtcttcctcggccggatcccaatcctggccgcgcttttccatggcatcgcgcttcacctgggccagcacgctcgccgcctgctcgccgcccatcaccgagatgcgggcattgggccacatccacaggaagcgcgggctgtaggcgcggccgcacatgccgtaattgccggcgccgaagctgccgccgatcagcatggtgaatttcggcacctgggcgcaggccaccgcggtcaccatcttggcgccgtccttggcgatgccgccgctttcgtatttccgcccgaccatgaagccggtgatgttctgcaggaacatcagcggaatgccgcgctgggcgcagagttcgatgaaatgcgcgcccttctgggccgattccgagaacaggatgccgttattggcgacgatgccgaccggatagccgtaaagatgggcgaagccggtgaccagggtcgtgccgtagagcgccttgaactcgtcgaattccgagccgtcgaccacgcgggcgatcacctcgcgcacgtcatagggcttgcgggaatcgcgcgggatgatgccgcccagctccgacgggtcgtaggccggatcgcggggcgtggccagcgccagcgaggcgggcttgcgccagttcagatcggccacgatccgccgggcgatctccagcgcatgggcgtcgttctgggcatagtggtcggtcacgcccgagatgcgggaatgcacgtcggcgccgcccagatcctcggccgtcaccacctcgccggtggcggccttcaccagcggcgggccgcccaggaagatggtgccctggttgcggacgatgatggtctcgtccgacatcgccggcacataggcgccgcctgcggtgcacgagcccatcaccaccgcgatctgcgggatgcccatggccgacatattggcctggttgtagaagatccggccgaaatgttccttgtcggggaagacctcgtcctgctgcggcaggttggcaccgccgctgtcgaccagatagatgcagggcagccggttctgcatcgccacttcctgggcgcgcagatgcttcttcaccgtcatcgggtaataggtgccgcccttgaccgtggcgtcattggcgacgatcacgcattccacgcccgacacccggccgatgccggtgatgatgccggcgcccggaatgttctcgccatacatgccgaaggccgcgaactgcgacagctccagaaagggcgaaccgggatcgagcagcgcccgcacgcggtcgcgcggcagcagcttgccgcgtgagacatggcgctgccgcgccgcctcgccgccgcccgccgcaatcccggcgaccttggccttcaggtcgtcgacctgggcacgcatatgggcggcgttgtcgcggaactcgtcggagcgggtgttcaccgcgcttctgatctgtcgcatggcaggcaggttcccggacgtctaggactgaggacggagacggactgaagacggggtccgactgaagacggagccagactgaagacggaatcaggcagccgtggccggatggcggtggtcgggcatgctcaccagccgccggtttccagccagcgatccacctgcggcagacggtcggccccgaagaagggctcgccatcgaccaggaagaaggggctgccgaaaaccccgcgcgccaccgcggcatcgccggcggcgcggagcttcgccttgatctcgtcggagccgagggctgaaaggcaggcctcgcggtcgaacccggcttcggcggcggtatcggcaacggcttccggcgtcaccgggccggtatcggtcacgaagaccttgtcgtagatcttcagcgccagacgcttcgcgccctcctggtcgatcgcatcggcccaatagaaggcgcgcgaggcggcgaccggattgaaggggaaggtcgacggcatgttgaagggcagaccggcaagcttcgccgagcgcacgaaatcgcgccgggcgtagccgcccttcagcggatcctcgatcgcggcgcgggtgccggtcagcttgaacaccgcgcccaccaggaagggatgccagcgcaccgcccggccgtggcggccggccacgtcctcgatccggtgggcggcgatatagccatagggcgaggtgaagtcgaaatagaagtcgatcggctcggccatggtcggggcgtctcctccgcaccggtggcgccgggtcttctgcggcccggtcgccccctcgtttcgatcagtccggcactcaggcggcgagcgcgcgggcaatcaccagccgctgaatgtcgctggtgccctcgtaaatctggcagacgcggacatcacggtaaatccgctccaccggatactcggccagatagccatagccgcccagcgtctggatcgccgacgagcacacccgttccgccatctcggaggcgaaaagcttggccatcgaggcttccttcaggcagggcaggccggcatcgcgcatctgggccgcgcgcaccaccatcagccgcgccgcttccacctgggtcgccatatcggccaggcggaacgacaccgcctgatgctcgaagatcttcacgccgaagctctcgcgctcctgggcgtactgcaccgcatagtccagcgccgcccgcgccatgccgaccgactgggacgcgatgccgatgcggccgccttccaggttcgacagcgcgattctgtacccctcgcccggcttgccgagcatcagatcgggggtgagcttcagatcctcgaagatgatctggcaggtgtctgaggcgtgctggcccagcttttcctccacccgtccgaccttgtagccgggggtgtcggtcggcacgatgaaggccgagatgcccttcttgcccgccgccggatcggtcaccgcaaacacgatggcgacatcggcattggcgcccgaggtgatgaactgcttggtgccgttcagcgaccagacgccgttctcgaacaccgcccgggtcttgagcgcgctcgcatccgatccggcctggggctcggtcaggcagaaggcgccgatcttgcgccccttggccatgtcgggcaggaagcggcgcttctgatcttcggtgccgaatttcaggatcggcatgcagccgaccgaggtatgcacgctcatgatggtcgaggtggcgccgtcaccggcggcgatctcttcgatcgccagcgcataggacacgttgtcggcgccggccccgccccattcctcgggcacgatcatgccgagcaggccaagttcgcccatcttggccagcgcctcgcgcgggaaggcgtgttcgcggctccactcggcggcatgggggagcagttcgccctgggcgaagtcccgcgccatgtcgcggatcatcttctgctcttcggtgaggatcatcgaaagcgctccggcagatggtctggtcgggcttgaccgccgccaccggccagtggggaccgggggtcgggccgcatcggacggcggcggcggggccggcggcgacaggctggagagggggtggggatgcctgtcgccgcaatcggatccggccggccgcatccctgcggcggccggacatggcgtctggtcagttcatcagctcgacggccatggcggtcgcttcgccgccgccgatgcacaggctggccacgccacgggtcatgccgttgcgcttcaggccgttgagcagggtcaccaggatgcgcgcgcccgaggccccgatcgggtggccgagggcgcaggcgccgccatagatgttcacccgctcgtggtcgagatccagctccttcatcgccgccatggtgacgaccgcgaaggcctcgttgatctcgtagaggtcgacatccttcgccgaccagccggtcctggcgaagagcttgttcatggcgccgatcggcgcggtggtgaaccaggccggctcctgggcatgggtcgcatggccgaggatccgggcgagcggggtcaggccgcgacgctcggcttccgaggcccgcatcagcaccagcgccgcggccccgtcggaaatcgacgacgaattcgcggccgtcaccgtgccgtccttggcgaaggccgggcgcagggtcgggatcttgtcgagattggccttgcgcggctgctcgtcgatgccgatctcggccgtgccgctgcgggtcttgacgctgaccggggtgatctcgacggcggcgctgccgtcctcgccagccttctgggcgcgcttcagcgaggtgatcgcgaagtcgtcctgcgattcgcgggtgaactggtaatggcgagcggtgtcctcggcgaaggtgcccatcaggcggcccttgtcgtaggcatcctccagcccgtccaggaacatgtgatccatcacccggccatggcccatgcgatagccgccgcgggccttgtcgagcagatagggggcgttggtcatgctctccatgccgccggccaccatcacggtgttggacccggccagcagctggtcatgggcgaacatcgcggccttcatgcccgagccgcacatcttgttgatggtggtgcagccggcatccagcggcaggccggcgccgagcgaggcctgacgggcgggcgcctggccctggccggcgggcagcacgcagcccatcaccacttcctcgacatcggcggcatcgacgccggcgcgggtcagggccgcgcggatcgccgaagcgcccagttcggaagcggtcaggtccttaagctcgccctggaagccgcccatgggcgtgcgggcggcgccgacgatgacgatcggatcggtggcggtggtcatgacgtctgctctcctcgatctctcttatcgcgggcccctgcacgggcagcgcgccccgccggccgtcatcggccggcgcgggctgcccccatcggtcacgccgtctcgccgaacagctcgcggccgatcagcatgcggcggatctcggacgtgccggcgccgatctcgtagagcttggcgtcgcgcagcaggcgccccgtgggataatcgttgatatagccgttgccgcccagggcctggatcgcttccagcgccatccaggtcgccttttccgccgcgtagaggatggcgccggcggcatccttgcgcgtggtctcaccccggtcgcaggctttggccacagcgtagacataggcgcgggtggcgctcagcgtcacatacatgtccgcgagcttgccctgcatcagctggaattcgccgatcgggcggccgaactgcttgcgctcgtggacatagggcagcaccacgtccatgcaggactgcatgatgccgagggggcctgcggccagcaccgcgcgctcgtaatcgagcccgctcatcagcacatggacgcccttgttcacgccgcccagcacgttctcttccggcacctcgcaatcctcgaacaccagctcgccggtgttggagccgcgcatgcccagcttgtcgagcttctgggcgaccgagaagcccttgaagcccttctcgatcaggaaggcggtgatgccgcgcgggcccgcttccggatcggtcttggcatagaccaccagcgtgtcggcatcggggccgttggtgatccacatcttggtgccgttcaggatgtagcggtcgcccttcttctcggccttcagccgcatcgagacgacgtcggagccggcgccgggctcgctcatcgccagggcgccgacatgatcgcccgagatcagcttgggcagatagcgccgcttctgttcttcattgccgttgcggctgatctggttgacgcagagattgctgtgcgcaccgtaagacagacccaccgaggccgagccgcggctgatctcttccatcgcgatcacatgttccagatagccgagaccggtgccgccgtattcctcttcggcggtcatgccgagcaggcccagatcgcccatcttcttccacaggtcggccgggaagtcgttggtctggtcgatctccgccgcgcgcggcgcgatctcctgggccgagaagctggtcacggtctgacgcagcatgtcggcggtctcgcccagatcgaagttcagcgtcggatagttcgacagcatctggatcgtctcccttggatcccggtccggcgccgcgggcggcactgccggagcagactcagatttcgctcacctcgatgagggtcgactgcgaggcggcacagaagatcggccggccgtcgcggtcgccgaacacgtcgcattgcgcgaccgacagcgtccgcccggaccggagcacccgggcacgcgcgatcagcttgcggccgaccgccggcgccatcaggttcagcttgtattcgaccgtcagcacgcgggtctggggccgcatcagggtgtggcaggcatagccgcaggcactgtcggcaaccgcgccgacgatgccgccatgatagaaaccgtcctgctgggtcaccatctcggaccagggcagctcgatctcgcagagacccggcgcacagagggtcatgaccgcaccaatggtgcgcatgatcgcctgcgcgtcgaagctcgcccggacgcgcgcctcgaaatcgggatcctggacccggaactccggcagctcatgtgccggcaaaaggcgctcggcctcggccagggtgatggtcatgggcggtcactccctcttccctcgggatcgttccgacatgcccggccggcacccgctggtgcggccgcgtgttcccggcatggaagatcgtgtccatcgaggcttcccgggcctccgtcttaaggtgcggcagctccggttcgggtcgaaccatagcagtggctcggccatagacgaaattgtatcttttcatgcgacgcatcgatagcgtctatgtgtatggccctcgccgggcgggcgctgccgcgcccttggccgccgccgcaatggcggctgggggaggctcgcgcctccccgggctggttagcggggcctgatcatgccatcgcagtggcagcttccatcggacgggtagcgtggacctgtatcagatccggtattttctggcggtggcggagaccggcagctttaccaaggcggcggagcgggtgttcgtgacccagccgaccctgtcggccggcatccgcaagctcgaggacgggctcggcacgccgctcttcatccgccgggcgcggcgggtggagttgaccgaggcggggcagcggtttcagccccatgcgcgggtgatcctgcaggaggccgcgatcgccgagcaggcggcgcggcgcggtgccgatcggcagggtttccggctgggcgtactcaagaccctgccggtggagcggatcgcggccctgctcacccagttcgccgacggccagcgcgatgtcgatgtcgacctgttcgagggcacggtgcccgagatcgacgaggcgctcaccgccggccggatcgatgccgccatcacccgcatcgccgatgatgccgaccgcgcccaggcggcgcccctgttccgcgaccgctatcgcatcgccgtgtcggagcgcaacccgctcgcccggcgcagccagctgcgcattcccgaactcgacggcctgcccttcatcctcaggcggcattgcgagctgatgggcgacatccggcgcaatttcctggccggcggcgcccgtccgcgcatcgtccaccgctccacccaggacgaatggaccgtagccctggtcgccgccgatctggggctcgctttgatgccgcagagcttcgagcggccggggatcgccatgatcccgatcatcgattacgagccgacccggctgatcggcctggcctggcatggcgcgcccgacgaggcgaccaccctgttccgcgccttcgccgcctctcacgactggcatgccggcagttcggcgccggtgccgcaggtggccgccgggtggatgcgctgaagcccccacccggcatgccggtcactcagtgatcgtataggtgccgaggtcgcagagattctgcgtgtcttccagcggttccagatcgccaccgccgaattcgaaccgcatgtcgtatttgcagacattgcggtcgtccttgaagcggatggtcttctgcttgcccggggcgatcacctcgtcgcccagcatgtcttcctcccagtcgtcctcgcccaccggcgaggtgtagaacgcctccaccaccgacctcgtcttgttcacaatcgtcagagagaaggtgttggcggctgccgtcccgctccaggcggtcagggccatcagcgccgcaatgcgcagcacggtcttcatgtcgtcctcgattctgtctcacgaggtttcggaaggcggcgccgatatgcggtgccgcatgccgcacgttacagccttgtcccaccggccgccatcccgcgattttcatggccgtttccgaaacgtgaccggtatgcctcaggcgtcacacccagccgcctgaggaaggcgcggcgcatccgctcgtcatcgccgaaaccgctgcggaccgccacggatttgatcgaggcggcccccgcctccagcgcccggcgggccgcatccagccgcatgccctccacccagcgcgccggcgtctcgcccacttccgcaaggaaggcgcgcgaaaaggccctgaggctcatccccgcccgttcggccagcgccggcaccgtcaggtcggcggccggatcggcggtcgcctggatgcgcagctgcaggaagccgccttcgggcgcggtcaccggttccggcaccagcgggctgaactgcgactggccgcccggcctgcgcaggaacaccaccagctggcgcgccacggcccgggccagggcctggccttcatccgcctccaccagggccagcgccagatcgatgccagcggtgatgccggccgaggtccagaccggcccgtcctgcacccagatctgatcaggctccagccggaccgccgggaagcgccgccggaactccgccgtccggcaccagtgggtggtggcgcgccgcccctccagcaggccggccgccgccagcagcaaggcgcccgaacagaccgaggccacccgctccgcccgtctcgccccggttttcagcaggtcgaggaaatccgcatcccgcccggccgcattcaccccgtcgccgccggcgacgaccagggtatgcggccgggcctctctcagcaccgcggccggctctgccagcagctgcatgcccgatgtggtctcgaccgccccgcccgcccccgccgcatggcgcagccggtagggcgccgcccgcccgcccagccgggccagatcattggcggtcgcaaaaacctggaaggggccggtcacgtccagaagctgggcgccggggaagctcaggaacaggatctcgcgcatcggcgccctccgcgaacaggccgtcgaccgagcttacaccatgcgcctgccgaaaaggaggcgttgatgacctttcggccagggcgtcgccgcggcagcatgacggcacccgtccctgaaggagtgccccatccatgaccgacaccgccatccgccgccgcgccgggctgctgatcttccccggcctcaccgccctcgacatgatcggcccgtgggaggtgtttctgcgcctgcccggctgggcgccggtcgccatcgggctcgacgatcagccgatcgcggccgatggcgggctgatgatcacgccgcaggccaccatcgccgactgcccgccgctcgacctgctgatcgtgcccggcggcggcggcgtcgatgccctgctcgacctcccggaggtgctggattttgtccgcggccgtgccgaagcggcacagtatggcgtggcgtcggtctgcaccggcgcgctggttctgggggcagccgggctgctccgcggcaggcgagccgccacccactgggcctcgcgcccgctactggcggcgctgggagccgaaccctcggccgatcgggtggtgatcgacgggccggtcgccaccggcggcggcgtcaccgccggcatcgacatcgccctcgccctcgccgcccggatcgccggccccgacatcgccgccgccgccgagcttgccatcgaatacgcgccggaaccgccgatgggcgccggccggccggaactggccccgcccgccgtgctggccatggtcgagaccgctttcgccgaccggatcgccgcccggcgccggctggtggaggcggcggccgcccgcctcgcctgaccctgtccgccgcccggcttgtcggccggggaggcctgcggctatcgtcaggggctccggcgggatcgccccgccggacctcatcgccggagccccgatgccgccctcccccgaccgcgccgccagctgggccttctggatcgtgatcggcgccgtgatcgtcggccagggcgccgggacgatccatctgccgtcactggcggcgctggccgccgatctcgacaccgataccgccacggcgcagctcaccctcgccatctgcctgatcggcaatggtgccggccagctgctctacggcccgatcgccgaccgcgccggccggcggccggcgctgctcatcggcctgggcctgctgacgctcggctcggtcggcgccaccttcgccgccgatgccggccagctgctcgtctgccgcttcatccagggcctgggggccgccgccgggccggtggtcgggcgcggcgtgctgcgcgatgccgtgccgcccgaacggctcgtggtggcgatgtcgtcgctgggtctggcgctggcactcgcccccggcagcgcgccggtgatcggcggggtgatcgagcgcctgggcggctggcgctggagcttcggcctgatcgcgcttgccgccgtcgccgcctggattacctgccggctgcatctgccggaaaccctgtcggccgccgaccgcagccgcgcgcgccataccggtgtgatttcgggctatggcgtcttcctgcgtatgccggccttctggggctacgggctgaccttgaccttcactttcggcgggctgttcatcttcgtcggcctcgcccccgtgctgctgatcggcacgctcggcatccgcgccgaccattacggcttctggtcgcttctgccctctctgggcttcctggccggcacccaggtggtgcgccgggcggggctgcgcctcggcggccgccggatgatccggatcggcacgctggtgctggtcgcggccggcatcgccatggccgccgccgccctgctgctaccgctctcggccatcgccctgatggcgcccatggccctgttcggcgccgggctcggcatccaggtgcccaatgtcatgacccgggcggtacagctggaaccgatgctggccggcactgcctcgtctctgctcggcctgtttcaactcggcggatcggcggtgatcgcggccagcgccgccctgctgccccatgacgatgccgccggcctcggcctcgccctcgccgcctgcgcccttgccgccctcgcctgcctgaagctgatcccgcgctgaagcatggcattgagaatcagtcgcaatatggctgcagctcgtgctatggaatgccggtcacccttcctgccacaggctgcggcttggatcagaaccccgaccggctcgacacctttctggcccatcgcggcgcgctggtgagctatgccacgcgtatcgtcggcgaacgcgccgatgccgaggatgtcgtccaggatgcctatctgcgtttcgaggcggccgagcccgaacggcggctcgacgcgccgcgcgcctatctgttccggatcgtccgcaatctggcgctggatctgcgtcgccgcgtcggccgcgatcatctgcgccgggcggccgatcccggcgcggccctggccgggctcgccaccgacgatccgtcgcccgagacggaggccgaggcgcgctcggatctccggcgcctctccgaggcgatggcggaactgccggcacgcacccgccaggcactggagctgcaccgcatgcaggggctgaccatccgcgagatcgcaacccggctcggcatctccaccggcctcgcccatgccctggtcaccgacgggctggaacactgccggcagcggctgcgggggcgggatcaatgacctttcatctgaacagaagccccgtctcgaacgtctctgtctcgaaggtctgttcttccgggagccgcagatgaacgggaaggcgtcgatgcgcggagacgagaaaccggtccgggcctcggactggctggtgcgcctgcacgacgcacccggcgatgccggattgcgggaacgcttcgacgcctggctggccgccaaccccgatcatcagcgcgactgggcagaaatctcccggacctacaggctgatgggccaggtgctgcccgcacctggcgcggcgccagcccgcaaggcggagctgcacagcctccgcccgcgtcggcggatgcggatggcggttgccggccttgccctcgcagccggcatcgccgccatcgccgtcctgccgggccagctgcgaagcggccttgccgaccagtcgaccggcagcgccgaaacccggcaggtcgcgctggctgatggcagccgcatggatctggcgccacgaagtgccgccgatgtcgagatcgacgccatcggccgccggatccgcctgatccagggccgggcctatttcgaggtcgcaaccgatcccacacgccccttcgtggtctcggccggcccggcgacggtcaccgtccgcggcaccggtttcgaggtcgcggagaccgataccggtctggaagtggcggtacgccatggccgggtggaggtggcggccggcggcgcatcccgcctgctggaagccggtgaccggctgaccatccgcaccaatggcgacatcatggaggatcggtcgcgcgccgacgaggtcgcagcctggacctctggccagctgatcgcgcgcgatcgcccggttgccgaggtggtggcggcccttcgtccctatgccgcgcaggtgatcgtcctctccgatgacgaccttgcccgtcagccgctgaccggcatctacgacctgcgccgcccccgcgccgcgctcgacgccatcgccgccgcccagggcgcccgcgtcgtcgagatcacgccctggatcctgctgctctcgaaaaaaatctgaacacccggcccggccccgtcgtcaaggcttcgacatctgcaattgcgtcgcacgcgcaagaagccatggcgcacatggcgggcgacgcctgagatcgcatccgaagggtcggggcttatggacaaggcgacgaacaggacggccggacgggccgtcgcggcggcactgatgctgggcacggccctggcgaccggcggtatcctctggccggcaggggcacaggcccagacggcggcacaggacgccctgcacgatttcgacattccggcccagaggctgggcgacgccctgcccgccttcggtcgccaggccggcatccaggtctcggcccatggcgatgtcgtgcgcgaggccatgaccgctggcgtctcggggcggctgagtgtcccggcggcgctcgaccgtctgctcgccggcacggggctcgcccaccgacaggacgccggcggtgtggtgatctttgagacgggcgatacggcggccggcactaccaccctcgatccgctgatggtccagggtgcccgcagcgccgatgctttcgccggcgccgccgaccgcgccggatcgctgaccgtcacccgcgaggatctggaacggcgcaacccggccaccctcaaggacgtcttcgcgggcgaggccacggtctcggtcggcggcggccagccggtcgcacagaagatctatgtccagggcatcgaagagaccaatctggcggtcaccatcgacggcgcccgccagaacaacaaggtcttccaccacaacgccaccacgctgatcgacccggccctgctcaaggccgtgcgggtggatccgggcgtcgcccccgccgatgccgggccgggtgcgctggggggtgccatcgtctatgaaaccgccgatgccgccgacctgctcgacccgggcgagatggccggcggctatgtctcgaccagctgggacagcaacggcaacaccttcaccaagggcggctcggtctatggccgcaccaccgacggattcgaagggctcgccttcttcaaacaggccgatggcgacgactacgaagccggcaatggccgcgaggtttcgggcaccggcgccgggctgcagagcatcctgctgaagggcgcctgggaaagcaccgacggccaccgcctggagctgtcgggcgagcaggtgcaggatgattcggttcgccccttccgcgccaatatcggccgtctgaccaaccgccccgccgacaaccggctctacgatctccgccgccgcaatctggtcgcgacctacgaagacacaacccgcgaggggatgtggaacccgcgcttggtgctgggctggaacgaaaccgatctgggcgtccccagcccggacgacacggtcgtctacagccatggcgagaccaccagcctgtcgggccggatcgaaaaccggatgttcttcacccccgatgacagcgtcaccgccggtgtcgatttctacgacgacgaggccgcctacaaagaccgcagcagcgacatgtccgagacggcgaccaatgtcggcgtctatgcccaggctcgcctgcagccgatcgacccgctgcgtctctccttcggcctgcgcggcgaccagcagtggttcgagggtgtgaacggcaccgaaatcgaccatgccggcctcagcggcaatgcctcggtggcctgggacctgcgcgacgatctgacgctgaaagcgggctattccaacgtcttcggcggcgtcgctctggccgagaatttcgtcatgaattcggggtgggactatttcggcggcatcaagccggtccgatcgaacaatgtgaccctcggcgccgagtaccggctcgacggcttcactttcggtgccggcatgttccgcagccggttcgaagatgcccgcaacgaaagctggcgtgacggcccggccggcaatctcgacttcgagaccgagggctacgtcctgtcggccgcctataactgggggcccggtttcgcacgcatctcttacaccgacacccggttgaccatcgaaggcaagccgggcgattcggacatcggcctctatctgggcagcccggtcggacagttgatcgcagccgaaatcgcccatcgcttcgagaccaccggcctcctggtcggcgccaccgtcgaagccggcttcgaaaacgacgacctggtttcagaaggttatgaaacgctcgaagcctatcagtcgctgaacctttatgcggaatacaccccggatatcgtgcgcgggctgacgctccggggcgaggtcaacaacgtcttcgaccaggcctatgccgaccgtacgacctatggccaggaattctcgaacgtcgacccgatctacgagccgggccggtccttcctgatcaaggcgaccatggccttctgaacgatcgcgctaccggacatgcaaaacgccggccccacgaggccggcgttttcatttgctcagttggcgtcgatcacctggtcgcggaaatcgagcatgacggtcttccaccagtccagcgtgtcgtcgaaattgcgccggctcacgccgcttttcaggttcacgtcgaactcgatcaccgggtcgccctcgtcgtcgatataggcgcggctgaagcgcttggtccggttccactccgcgacatgggcctcggtcacgttggtgtccgtccagccggcatagaagcccagcgtgtcgcaattgcggttgttcgtgcagtcgttgaagaagatcgcatagccgacaccgtcgatgcggccgcggatcagcggatcgccgttgtccgatttttcaagattggcagagccgtagccgcgggccagattcaggatctggtcggggtcggaaccgtcgatcatctgttgcgcggccaccgcctgcggcgccagcattatcatgcccagtgcggcggcgaccaccaccccgcggatcgacgtcatgccagtcatgcctgaacctgccttccggttttgatgtcacgaaaccggagcctacgggatggcgccggcagcggcaagctggcacaagatcagagccgcccctcgacacctgccgatgaaaagccccgcatgccgaccgcacctcttcggatcgacgctctccagatcctccgcttcatcgctgcggggctgatcgttctgcaccacacgatcagcatccttcacagccggaacatcgacggcatcccacggatccccggactgatcgcgggcgtcgacatattctttgtgctgtcgggcttcatcatggtgcatgccttcagcccgaatggccgtcgatccgccttcatgctgaaacgcatcttccgcatcgtaccgctctactggctgctcaccactctcctctgggggatggccgtcgcggcgccgcagcgcttcaataccgttgatgccgatccctcagcctggctgatggcactctcattcctgccacagacgctgtcagggaggatcgtggagcccgtgcttcatgtcggctggaccctcaattacgaaatggccttctacaccctcttcgccgcctgcttcgcggggacggccagccgcacagccggtcgctgtgccggcgttctcgtcgggctggtcattgccgggcagatcttcgatccggccgatccggtcatcgccttctataccagccccctgctgctcgaattcgctgccggcatgggggcggcccttctctgtcggcacagggcggagcatctgcgcccaggcgggccctggctgctggcggcaggtatcctgttgctggttttgcaggggatctggccggtgggcggccatcgggccctgatctacggcgtgcccggcctcggcatagtcctcggcaccgcgctgctccacgttccccacgggtggtgctcccgcgcggccatccgtctgggcgacgcctcttatgccctctatctcgttcacccactggtgctggcaacggtcgcgaagctgcttatcgataccggccatctccgccaggccctgccgctcgccctgatcatgatgacgctctcggtcctggcggctttcccctgccgccatctcgtcgagcgtcccgcgcaggcctggttgcaacgtcgcctgaaccacagagacagggttcagagcagaaccagctgagccagccccagaaaggcgaagaagccgaccacatcggtgaccgcggtcaggaacacgccggccgagaccgccgggtcgaccttcagccggtcgagggcgagcgggatcagcatccccgccaggcccgccgtcaccagattggcgagcagggcgcagaacagcacgccgccgatgaaggggtcgaagatcaccgccgccacggcgccgaccgcgatgccgaagaccaggccgttgatcgtgcccacccccacctcgcgggtcaggatgcgcatggcgttggacggcgtcagttccttcagcgccagcgccctgaccgccacggtcagggtctgggtgccggcattaccgcccatcgaggccacgatcggcatcagcaccgccagggcgacgatctgttcgatcgtcgcctcgaacagcgagatcaccgagctgaccatcagcgccgtgccgagattgaccccgagccaggcgatgcgctggcgcaccaccgaaaccaggccggcattcacgtcgacctcggatccgacaccggccatcagggccatgtcctcttcggcctcttcctgaatgacgtcgaccacgtcgtcgaaggtgatcacgccgatcagccggccctgatcgtccacgaccggggcggaggccagcgaatagtgccggaacagccgggccacctcttcctgatcggtggcggcggcgatggcatcgacgtcgcggtccatgatgtcgcgcagcagcaccttgcgcggatggcgcagcatgcgggccagcggcaccgatccgatcggcttgtgccgcgggtcgaccacgaagatttcgtagaattcctcgggcaggtccggggtttcgcgcaggaagtcgatggcgcgccccaccgtccagaaggccggcatcgcgatcagatcgcgctgcatcaggcggccggcggaatattccggataggcgaggctttcctccagcgcccgccgggtggcggggggcaccgccgccagcaatgccgcctggatgtcgtcgtccagatcctcgatcagatagatcgcatcgtcgctgtccagttccgacagcgcttcggccagcgcccgggggcccagctgggcgatgacctgatcgcggacattgccgcccagatgcggcaggatttcagggtcgaagccgtcgcgctgcagctccaccagcgcgcggcgttcctctcccgacagccgttccagcagatcggcgatgtcggcggcatgcagttcggcgaccagcatgcgcgccgtgggcgcgtccccctcgtccagggcatcggccacccgccggaccagttcgtccgagacgccgtaaagcgcctcggcctcgcccgccgcggtggccgtctcaccgtcgcgtccctggatgtcgtcgtcgtcgcgcaagctgtcggatctccggggatcgggaaggggggtcggggaatgccggccggcatcccgtccccggaaagccggccgctcagatcatgtcaggcaggttccgccgggatcgggcaccagggcgtgtcgcgcgacttttcgatcgcgtccacgaccaccagggccgacaggttgacgataccgcgcaccgacaccgcgggggtcagaatatgggccggatggttgagcccgatcagcaccggcccgaccgaggtgccgctggtcagcgccttggcgagattaaaggcgatgttgccggaatcaaggtccggcgtgatcagcagattggccgagccctgaagcagcgagcccgggaagacccgatggcgcacctcttccgagatggcggcatcggcctgcatctcaccctcgacctccagctccggcgcctgctcgcggaccagtgcgaaggcatcgcgcatcatctgcgccgacggcgtctcgccggttccgtagctcgacgacgacagcaacgcgatcttgggcgtgatgccgaagcggcggacctcctcggcgcacatgatcgtcatctcggcgatctgctcggggctgcgcttgtgctccacctgggtgtcggccacgaagatggtcttggtgggcaggatcagcgcctgcatggcgcagggctcactcaccccccggcgcaccccgaagatctccttcaggtggcgcaggttcttcacgaaccggctgaccgggccgcagatcagggcgtcggcctcgccgatatggaccatcagcgcgccgatcaccgtcgcccgggtgcgcaccacggtgcgggcgctttcgggcgtgacgccgcggcggcacatcagccggtggtattccgaccaataggtgttgtagcgcggatcatcctcggggtcgcacagctcgatatccttgtcgagcttgagccgcagacccagccgctcgatgcgccgctgcaccaccgcgcggcggccgatcaggatcggctgggcgaagccttcgtcgaccacgatctgggcggcacgcagcacgcgctcatcctcgccatcggcatagaccacgcgtttgggctgcgccttcgcgcgctcgaacacggtccgcatgaccaggcccgagcggaagaaataggacgacagtacctggcgataggcgtcgaaatcctcgatcggccgggtggcgacgccgctttccatcgcggcccgggccaccgccgacgacacctcgaccaccagccggggatcgaacggcttggggatcaggtagtccgggccgaagcgcagttcctggccgccataggcctgcgccacttccgacgagggctcggccatggccagatcggcgatcgcctgggcggccgccttcttcatctcgatgttgatcgtggtcgcgcccacatccagcgcgccgcggaacacgaaggggaagcagaggacgttgttgacctggttggggaagtccgaccggccggtggcgatgatcgcatcggggcgcacccggcgcgcctcgtcgggcaggatctcgggcgtcgggttggccagcgccatgatgatcggctgcggcgccatggtcttgaccatctcggccgtcagcacccgcggggccgacaggcccaggaagatgtcggcgcccgaaatcacctcggccagcgtccgcgcgtcggtctcgaccgcataggtctccttgcgcggatccatctgctcgttgcggcccttccagaccacgccgacgatgtcggtgacggtgatgttggcgcgcggcagacccagctcgaccagcaggtccaggcaggccagcgccgcggcaccggcgcccgaggccaccagcttcacctgatccagcggcttgcccaccacgcgcagcgcgttcagcatcgcggccgaaaccacgatcgcggtgccgtgctggtcgtcgtggaagaccgggatcttcatccggtccttcagccgttcctcgatctcgaagcattccggcgccttgatgtcctcaaggttgatcgcgccgaaagacggctcaaggctggcgatgatctcgaccagcttgtcggggtcgcgttcgtcgatctcgatgtccaccgcgtcgatgccggcgaacttcttgaacaggaccgccttgccttccatcaccggcttggccgccagcgggccgatcgcgcccaggcccagaacggcggtgccgttggtcaccaccgcgaccatgttgccgcgggtggtatagagcgaggcgttgagcgggtcctcgacgatcgcctcgcaggcataggccacgcccggagaataggcgagcgcgaggtcgcgctggttggcgagcggcttggtcggctcgatgctgaacttgcccggtttcggcaggcggtgatattcgagcgcgccgtcgcgcagttccttcgacattcgcggtcgtctcccccggtatcttacgccgcgggcccgggctgcggcctcttcatccgcgcccttttcccgcgtgcgggcacagtatagccgccacgccccgaaaggccaccggcacccggccgcagccgccggaggtccggtttgcaaccatcgcatgggcggggcctcgccgcaccatcgtgcgggatgtcgcccgatatggcgcaaccggccccggcgcactagattggggccagctgtcgctgacgaagatgaagacgaggacgagacggatggcgggaacgctgcagggtgacgggatcagaccggtcgaatgggtcatcgcccccggcctgaccgactacgaggccgccgtcgccgagatggaggcgcgcgccgcccggatccgcgagggcacggcggcagagcgggtgtggctggtcgagcatccgccgatcctgaccgccggcaccagtgcgcagcaggatcgcgacctgctggtgccgccgcgtttcccggtctaccggaccggccgcggcggccagatcacctatcacggccccggccagcgcgtggcctatgtcatgctcgacctcaaggcccgcggcgccgatatccgggcctatgtgcacgggctggaaaactgggtgatccgggcgctcgaccgcttcaacgtcaagggcctcacccgcgacgaccgggtgggggtctgggtggaacgcggcgacgggttcgacgacaagatcgccgccatcggcgtgcgcgtgcgccgctgggtcagcttccacggcatttcgctgaatgtggagccggatctcggccactatgccggcatcgtgccctgcggcgtgcagggccacggcatcacctcgctggtggcgctgggccggccggtgggcatggtcgaggccgacatggcgctgcgcgaagccttcgaggaggttttcggccccaccaccgacgcgggcgacgacggtcgcggcagctgatcaccgtcgaaggccgatcaccatcgaagaggcatcgcggtcgaccggccgcggtcgcggagggtgacggcgatcgcggccgccgtgaccgccttgatcaggtcgccgggcaggaaggccatgctgccggtcagcacctgccagggcgacagcgtggtcaccatcgcagcccagggtacgccgatcagatagaccacgccgatgccgccggtgatcgtcgccaggatgaagcgcagccagccggcgcgccccgcctctgccagcagcccgatgacgaaggccgccgggatccagccgatcagaaaaccgccggtcggcccggtcagaatgcccatgccgccgcggccgccggcgagcaacggtgcgccggccatcaccagcgccacgaataccatctgggccagcgccgcccgccacgagcccagcaccaggcccgagagcatcacgcccaatgtctgggccgtgatcggcacgcccatcagcggcacatccagcggtgggaacaggcccagcacggccgtcagcgccgtaaaaaacagaatgtggaagacatcgcgggcgcgcatcgggtcgatcctcctgccgccggtctcctctcttcaggacgggagagccgaaggcgctgactcccttatcggttatgtttgtaccttcgtcaatcgcccatggcgcgggcatgacggcatcacccggcgcggcgccgaaagggccaggcgatcagcccggtaatcgcgtcatagaccagccacgccaccaccatgcccagcaggccataggtcaggctggccggctccaccggcagggtcggcacgtaatcggcccaggtcgcccgggcgatctcgggatcgacccgccgcagcagctccagcggcctgaggaaggggtcggccgcggccacggcatcgcgcgcgacggcaagctcgtccacccgcgccgcggcggccgcctccagcgccgcccgggccggctgtgccacctggtcatagggggccacgccgatgcggatctgatccagcaaccggcgcgcctcgtccagatggccgcccaggcgctgcagataggccagcgcgaagccctgcgcctgtgccgcgccaagccccagaaccagggcgcagatgctgccggccaggcggtctatgcggcccagaagccagcgtcccatgaatggcagtgtcccatttttcagacggtcggcccggttcaaacggttggcttacggcgaaagccgggcccatcgggtgcctcggccgggctgctccgcacggcttcgacccgtgccgcgggcggcccgtcctgggcgcggcggatcacggtctgcaccgcggcgcgcggcccggaaatcagcgcctccaccgatccgtcccggcggttgcgcacccagccgtccagcccgtagcggcgggcctggccctcgaaccaccagcgatagcccaccccctgcacccggccggtgatggcgagcgccatggtcacccggtcgcccggcgccgtgccggcgacaggtgccggcgcatcccgggccgcgggggcggacatgtcctcgtcaggggatcgatcgtcggtcatggcgcgtccgtatgtgccgtgggcctgccttaagcctagcccagccaccggctgcacggaagcggttcagggcagcagccggcccggattcaggatgccgtgcgggtccagcaccgccttcagcatctgcatggtccggatctcggcggcagagcggttgcggtccagataggcccgcttcacctggccgatgccgtgttcggcggaaatcgagccgcgatactggccgaccaggtcgaacaccgcctcgtcgattggcgcctgcagggcgcggtagccctcggccgacatgccctgcggcgccatcacgttgacatggacattgccgtcggcgacatggccgaaatagatcggccgcagcccgcgggcgacccgggccagcgccagatcgcaatcggcgatgaaatggccgatatcgcccaccgcaaaggtcaggtcgtatttgtgcaccggcgcggtgcggcccaccgcctcgggcacgccttcgcgcagcagccagagcgcttcggcctgggcctcgctctgggcgatgatcgcatcggccacatgctcgtcttcgatcagccggccgatcaccgtctccagccgctcgcgctcggcggcggcggcggcatcgtcgctgcccacctcgatcagcaccgcataggtgtgggtgtcggcaaaggggctgcgggccccgtcgagcgccgtggcgaccagcgtcaccgcatcggcgccgatcagctccacggaattcagccggcccgggaaggtgctgcgcaccgcccccagcacccgggtcacgtcctcgaaacggtcgaccgcgaccatggcgacggcgcgcccggcttcggccgggtgcagcttcaggctggcggcggtcaccacgcccagcgtgccttcggcgccgatgaaaacctgcttcaggtcgtagccggtattgttcttgcgcagcgtcgtcagcccgtcgagcaccgtgccgtcggccaacaccacttccagccccagcacctggtcgcggatatggccgtagcgcagcaccttcagcccgccggcattggtcgagatgttgccgccgatccggcaggatcccttggatcccagatccagcgccagcatcagccccgcctcgcgcgccgccgcctgggcggtctccagcaccacacctgcatccatggtgatgctggcgcccacggtgtcgacctcgcggatgcgggtcatccgctcgacgctcagcacgaaagcgccggcggcatcgggcaccgagccgccgaccaggccggtattgcccgcctggggcaccacggccaggcgatgggtgttcagataggacagcagccgcgagacggcggcggtgtcgcgcgggcgcagcaccgcgaaggcccgcccctggaacttgcccatccagtcgcgctcataggccgccatctgcgccgggtccgtgatcagaccggccgtatcgaccaggctgccgagctgttcgacatggcgttccagatcggcgacggacggcggacgacgggtcatgcggcactccggtcggacgggatgggatctgtcggggatctctcagggcgagagtggggatgattctgtcgccggtttgcgatcacgacaacggccatgggcggcggggcagccatgcacgggctgcggtccggccccctctcagacaggaaaaaccccgccggacacgcggcccggcggggtttcgaagagacggcggagatgtcggcgatcactcgaattcgatgatcacctgatcggcggcgacgctggaaccggcgccggccttgatctccttcaccgtgcaattgcgctcggcgcgcagcacgttttccatcttcatggcctcgatcaccgccagctcctcgccggcctggacctcctggcccacctcgaccgcaaccgacagcaccaggcccggcatcggcgagagcaggaaccggctcatgtccggggcctgcttgaccggcatcatcgcagcataggcggcacccttgcgggtgtagacccgcgccaccagcaccgatccgccatgggtcagcttccagcccgccgacacgcgctcgatctgcaccacccgggtccgatcgtcgacggtcgccgacagcagccggtcgcccagcttccagctgcagtccagcgtcaccggcttgccgcccatgtcgagcaccagcgccggcgcgtgctgcaccaccttcacctcgacctgctcgtcgtccagcatgaccaccaactcgtcggggacatggtgaacatagccgcgcatctggccggtgatgcggccctggcgggcacggtcggccagatcggccatcacggcgatcgccgccagcgcccggcgggcctcggcgtccagcggcgcaccgtggaagccgtcggggtattcctcggcgatgaagccggtcgacagccggccttccaggaagcgcggatgcttcatcagcgcggtcaggaaggggatgttgtgggtgatgccgcggatgtaataggcgtcgagcgcatcgctcatgcgctcggccgcctgggcgcgggtctcgccgtaggtgaccagcttggcgaccatcgggtcgtagaacatgctgatctcggcgccttcatagacgccgctgtccacgcgcacgcccgggcccttgggctcgacatagcgcgccagacggccgatcgacggcaggaagccgcgatacgggtcctcggcatagacgcgggcttccatcgcccagccggtcagggtcacatccgcctgcgagaacggcagatgctcacccgccgccacccggatcatcagctcgaccaggtcgtagccggtgatcagctcggtcaccggatgctcgacctgcaggcgggtgttcatctcaaggaagtagaagctgcgatcggggccgacgatgaactcgaccgtgccggccgaacgatagttcaccgcgcgcgccagcgcgaccgcctgctcgcccatcgccttgcgggtcgcctcgtccaggaaggggctcggggcctcttcgatcaccttctggtgacggcgctggatggagcattcgcgctcgcccagatagcagatgttgccatgggcgtcggcgatgatctggatctcgatatggcgcggctgctcgatgaacttctcgatgaagacgcggtcgtcgccgaagctcgacttcgcttccgaggtcgccgagcggaagccttcgcgggcctccttcgcgtcatgggccaggcgcatgcccttgccgccgccgccggccgaggccttgatcatgaccggatagccgatctcgtcggcgatcttcaccgcctcgtcggcgtccttgatctcgcccacatagccggggacggtcgagacaccggccttcttggccagcttcttcgactcgatcttgtcgcccatcgcatagatggcctcgacattcgggccgatgaaggcgatgccggcggcatccagcgccttggcgaagctctggttctcggacaggaagccatagcccgggtgcaccgcctgggcgccggtggccttacaggcctcgacgatgcggtcggcgatcagatagctctgattgctggggctcgggccgatatgcacggcctcgtcggccatgcggacatgcagcgcgtcggcatcggcatccgaatacaccgccaccgtcttgatgcccatacggcgggcagtccggatcacccggcaggcgatctcgccgcgattggcgatgaggatcttctcgaacatgggagcgcgtctcgactggaaatcaggaagaggatgacggcggttgcggcggttcggccccgcctcccgtccgcccccggccccacgacagcacgccgtaggcccagagaccgtggaggaccaccgcacctgcccagatcgcgagcgcgaagccgatccgaccttcggggtcgtcgatcttcagcagctgcgtcagcagggcgatcaggccgttcgccgccgcgaagccgaagccgtggagatagaagccggtcaggcgccgcgcgcgtcgtgcatgcgccgccttcaccagatccgtctcctgctccggcccgctcacggctgcccggtcacagcggaatgttgccgtgcttcttccacggcttctcgcgacgcttgttccgcagcatgtccagcgcgccgcagatgcgggcgcgggtgttgtgcggacggatcacgtcgtcgatgaacccgcgggaggccgcgacgaagggattggcgaagcggccgcgatattcctcggtccgcgccgcgatcttctccgcgtcgccgatatcctggcggaagatgatctccaccgcgcccttggggcccatgaccgcgatctcggccgagggccaggcatagttcacgtcgccgcgcagatgcttggagctcatcacgtcataggcgccgccataggccttgcgcgtgatgacggtgactttcggcaccgtcgcctcggcataggcataaagcagcttggcgccgtgcttgatgatgccgccgaattcctggctggtgcccggcaggaagcccggcacgtccacgaaggtgacgatcgggatgttgaagcagtcgcagaaccgcacgaagcgggcggccttgcgcgagctgtcgatgtccaggcagccggccaggaccatcggctggttggcgacgatgccgacggtctggccgtccatgcgcgcgaagccgaccaggatgttcttggcgaactcgggctggatctcgaagaagtcgccctcgtcgaccaccttctcgatcagctccttcatgtcgtagggcttgttcgggttcggcggaaccagggtgtcgagcgacggctcctgacgcgcgaccgggtcctgcgtctcgcgcagcggcgccggctcgcggttcgacagcggcaggaagtcgaagaagcggcgcagctgcagcagcgcgtcgacatcgttctcgaaggcgacgtccgcaaccgaagacttcgtggtatgcgtgaccgcaccacccagttcctcggccgtcaccacctcgtgggtcacggtcttcacgacgtccggacccgtcacgaacatgtaggacgtgtccttcaccatgaagatgaagtcggtcatggcgggtgagtacaccgcaccaccggcgcagggacccatgatcatcgagatctgcggcaccacgcccgaggcttcgacattgcgcaggaacacgtcggcatagcctgcgagcgaggccacgccttcctggatgcgggcgccgcccgaatcgttgagcccgatgaccggggcgccgacctgaaccgcctggtccatgatcttgcagatcttctctgcatgcgcttccgacagcgcgccgccgaacacggtgaagtcctggctgaacacgaagaccaggcggccgttgatcgtgccgcggccggtgacgacgccgtcgcccgggatcttggtgttttccatcccgaattcggtgcagcggtgttcgacgaacatgtcgtattcttcgaacgacccggcatcgagcagcagttcgatgcgctcgcgggcagtcagcttgcccttggcatgctgggcgtcgatacggcgctcgccgccgcccatccgggcagcctgacgacgcttctcaagctcttcgagtatcgcctgcatctccggtcttcttcatcctcgaatggtagggcgccgtccgcggacggcccccccggaccggatgcggcacgcaaagcgccttacacggcgtttccttgttcgcctgtgctgatagcatgacgaacccggctgcgccacatcctttgccgtgaacagggcttttgcggcaaggctttggcaaattcttgccgcatatgcgaaaggtgtgcgacatcgcacgcccggttgcgcaactttgcgcaacggccatctgcagctgcggaattagaccgaccctaccctgcgttgagcgcgtcgcggatccgtgccagatcatccaggtcgcggcggagcagcgcgaggcgctcggcctgctcggcatcctcgccccagcgggcgatctggaaatgttcgtcggcgaaggcggcatcatatgccgtcgcgggatcgattcccgcctcggccagcgccaggccgatcaccaccgatccggcggtggtcaccgcgccatgcagcaccgccagtcgccaggggtcggcggcctcgatcgcgcgcgtcagcctttccaccgtcgcgggtggctggtccacggccagaaggccggtggtggtcaccagatggatatcgtagcgggtgcgggcccagtccaccaggggatcccagtgccgggcctgaagggccgccagttccttcggattgtcggcgcgatagcacaccagatccgtaccgatatagccggcaagctcggccgcgatctgcgcccggtgcggcaccacccggtcgatcaccacattggcgagcttcgtcgccggcatggtctcgggcgcgatatgggtctcctgcgccgcccattcatcggcaatcagctgggccagcgcccggccgggcaccaccagcggtgccttggccggggtgcgcaggccgcggccgtcgagcagaacggcccagccgccgcccgcggccccctcccctgccgatggtgcggcctcggccgccttgtagaaacgcttgcggcgcgtgacggcgtcgctcatgccccgatcctccgttccggcgcaagcggcgccccgatcagggtcgcgatcgcggcatccagctcggccgccgccgtcaccaccagatcggcccccgcatccagcaggtcctgatgggcatggcagccccaggccaccccgattgccctggcacccgccgcccgcgccatttccatgtcgtagctggtatcgccgatcagcacgctgcgcgccggatcggccccggtttcgtccatcgcagccagcatcatcgccggatgcggcttgctcggatgggtgtcggcggtctgtatggtcacgaacagccgctcgaagccgaagcgggccaccgtgcgctccacgccgcggatcgatttgccggtcgccatgcccagcacatagcccgccccgtcgagccgcttcagcgccgcctccacgccatcgaacagccgctcgtcgcccatcagcccggccgccagccggcggcgataggcatcgcgatagccccgggccagatcatggcaggcaagatcgtccagatgcggcagcagccggccgatcgcgatcggcagcgacaggccgatgatctgcgccacctcggccggtgtcggggctgcaatgccggcggcgaggaagcaatccgccatggtgtcggcgatatgcccggcgctgtcgaccagcgtgccgtcgcagtcgaacaccaccagcccgatcccgtccgccgtcatcgtcatccatccatctccggatcaaagcccagccggtcgaaactctgtgccatatggggcggaatggcggcgcgcaccgaaatccgccgcccgtccggcccgtccagggtcaggcgccgtgcatgcagatgcagccgccgcggcaacccctgcccccgcagatccaccgcctgtccgccatatttcaggtcgcccacgatcggcgtgccgatcgccgccagatgggcgcggatctgatgggtgcggccggtcagcggcttcagcgccaccagggcgcagggtccgcccgccgccagcacctcgtattcggtgaccgccgtctggccgtcgccctcgtccaccgccaccatgcgttcgccgccgcgttccacctggcgcttggccagcggcaggtcgatcacgccccgcgccggccgcggcacgcccagcgtcaccgcccagtagatcttggtggtggtgcgctcgcggaaggcccgggtcgcccaggcggcggcgcgggcattgcgcgccagtgccagcacgcccgaggtgtcgcgatccagccggtgcaccagccgcggccgctcgtcgtccgggtggcgcttcagcgcatccagcataccgtccagatgccggtcggtgccgctgccgccctgcaccgccagccccgagggcttgtcgatcaggatcaggtcggcggtttccagcagcacccgcccgcgcaggaaatccgcctcctcggccgtggtctggcgggccccgacccggccctcggcctttgcctccagcatcggcagggccggcggcggcaggcggaccacggcaccggccgtcagccgctgatcggccttggcgcgtttgccgtccacccgcacctggccggtgcgggcccagcgctgggcctcgccgaaactcagcgccggcaggtgtttgcgcagccagcggtccagccgctggccgtcctcgtcgggcccgacttccctatgcagcggatcgacgctcatccggcgatcatcctgacggtcgcaagcccggccagcagggcaagcgcgcccgccaccaccgatcccagcacgtaaagcgccgcggccatggtttcgccgcgctgccagagcgagaccgcatccagcgagaaggtcgaaaaggtcgtgaacgcccccagaaatccggtcgcgatcagggtgcgggcatgggggaacatcggcaggccatgggcggcggcgccggcgatcgcgcccatcaggaacgagcccaggatgttcacgatcaccgtgccccaggggaagcccaggccgaaggccgccgcactccaggtgttgacgccgtgacgggccagcgcgcccgcggccccgccgatggcgatcaccgccagcgtcgccggtgcgaatgcggtcatgcctctccctcttcgtccctggatctgcgggcggcggcccgcatctccgcctggcgctcggctctcagcttcgaccaatattccagccgcttggcgatgtcacgctcgaacccccgcggccggggctcatagatcacccgcgcgcccatgccctcgggccagtagtcgcggcctgaaaacgcgtccggcgcgtcatggtcgtagtcatagccatggccatagcccagctgcttcatcagtttggtcggcgcgttcaggatgtgcatcggcggcatcagcgaaccggtttccttggccagccggcgcgcggtcttgtaggccatatagaccccgttcgacttgggcgcggtcgcaagatagacgaccgcctgggcaatggcgagttcgccctcggggctgcccagggtctcgtaggcgcgctgggccgccagcgcctgttccaccgcgcgcggatcggccatgccgatatcctcgaccgcgaagcggatcagccggcggacgacatagagcggatcctcgccgccatccagcatgcgcgcgaaccagtagagcgccgcatcgacatccgatccgcgcagcgatttgtgcagcgcgctgatcaggttgtaatggccttcctgcgccttgtcgtagagcggcagccggcgctgcagcagctggcccagccgcaccgtatccagccgctcgccctcgggcagggcatagagcgtgtcggccaggttcagcagaaagcggccgtcgccgtcggccatgccgaccagcacggcccgggcctcgtcgtccaccggcagcggccggccttccgccgcctcggcgcggatcagaagctcgcccagcgccgcctcgtccagccgccgcagcaccagaacctgggtgcgcgacaacagcgcgccgttcagttcgaaagacgggttctcggtcgtagcaccgatcagcgtgaccgtcccatcctccacatagggcaggaaactgtcctgctgggcgcggttgaagcggtggatctcgtcgacgaacagcagggtctggcggccggtatcgcgcagcgccgccgcctcggcaaaggccttgcgcagatcggcgacggtcgagaacacggccgaaagtgccgcgaagcgcatgccggtcgcctcggccagcagccgcgccagcgtggtcttgccggtgcccggcggcccccacaggatcagcgaggccagccgcttcgcctggaccatccgggtcaccggcccgtcggggccgaacagatggtcctggccaacgatctcgccgatccggcccggacggagccggtcggcaagcggacgtggggcggcggcatcgaacagcgtggccatgggggtcgggcgggctccggggggctgacgtaagggcagagagcgcgggagggcccgcgatcagcccatcagatccaaggtgagttcgcggccctcgcggcgcaaggtcagctgccagcggcgctggccctgcatctgcttcagggtcgtctcgacatcggcggtacgcgacaggcgcttgccgttcaccgccagcaccatgtcgccgggcttgaggccgatcgaggccgcggcggaattgcgggtgatgtcgaccacgatcaccccttcctcgaagccgtcgatccccagctcctcggccagggcgggcgagagattggcgatccgcgcgccggcaagcgggttgctgccggtgatctcgcgctcgtcgcgggccaccgtctcgggtgcggcgaccagcggcagcgacacggtctgccggcggccctcgcgccagatggtgaccgcggtctcgccgccgatcccggcggccgccagacggaagcgcagtgcccgcgggtcgtcgaccggcttgccgccgatctccaggatcacgtcaccccgcttcagcacacccttggcgggaccttcgggatgtacgtcgctcaccagcacgccggtgggccgcggcatgcccaggctttcggcgatctcctgcgtcaccggctggccgcgggcgccgagccaggcgcgcgccaccggccggccctcgatcgccgcctgcaccaccgttttcaccagggtggcggggatcgcaaagccgatgccgttggagccgccggagcggctgaagatcgcggtgttcacgccgatcagctcgccgttcaccgtcaccagtgcgccgcccgaattgccggggttgatcgccgcatcggtctggatgaaggactggaagtccgagaccccgaccatggtgcgggcaagcgccgagacgatgccgctggtcaccgtctgccccaccccgaagggatttccgatcgccagcaccagatcgccgacctcgatcgagtcgctgtcgccgaagctcagcgccggcagggtctggccctcggtgtcgatcttcagcaccgccagatcggtctgcgggtccagccgcaccacctcggccgcgaattcgcggcggtcgttcagcaccacggtgatctggtcggcgccgtcgatcacatggttgttggtgacgatatagccgcggccgtcgacgatgacgcccgatccgagcgcgttctgcacccgctccgacggcttgccgatgcccatccggtcgccgaagaagcggcggaagaacgggtcgtcgaagaacggagagcgctgctgcaccaccaccgtgcggcgggtgtagatgttcaccaccgccggcgccgcctgacgcaccacgggcgcgaaggacagctgcatttcgctccggctttccggcacccgccgttcggcatcggccgccaccgccggcggcacctgcaatgccgccagggccagcaccagcgccagcatcctcgaccgcaggccgccgcggatcgccgcggccaggtctgcatcccgttcaggcagtcggttcatcactctcattcccgcccggttgtctcgtccaggtccgacagcatagtccccgccgcccggaccacaagtgaccagagccacgcacgcgccccgaacgcagaacgggcggtgcgccttgcggcacaccgcccgttcccaagggtcccgtcgcgatgccgataccggcaccgccgcccggatcaatcctcggcgccgtcctcggcaacctgcttcgggcccgaatcctggcccttggcggcaaggttgcggtcgaccagctcgatgatcgccatcggggccgcatcgccatagcggaagccggccttcagcacgcgggtataaccgccagcgcgggcctggtagcgctcggccagctcgccgaacagcttctgcacgatcacgccgtcgggcaggcgcgaggcggcctgacggcgggcgtggaggtcgccgcgcttgccgagggtgatcaggcgctccaccaccgggcgcagttccttcgccttcggcagcgtggtcttgatctgctcgtgcttcagcagcgcgaccgccatgttggcgagcatcgccttgcggtgggcggtggtgcggttcagcttgcgctggttcatgccatgacgcatgaggggaactcctgccttggcatcatccgcatgcgggggccatccgcggtgcggggcccggtctccgggccttgatgctgttctgacggggcggacgtgcgcaggcactacccgccccctgggatgtcgtccggtgccgcgaggcgcccgaagaggctcagtacggctcttcgagcttcttcgccagctcttcgatgttctccggtggccagttgctgatctgcatgccgagcttcagacccatggaggacagaacctccttgatctcgttcagcgacttgcgaccaaaattcggcgtccggagcatctcggcctcggtcttctggaccaggtcgccgatgtagacgatgttgtcgttcttcaggcaattcgccgaacgcaccgacagctccagttcctcgaccttgcggaggaggttggggttgaacggcagctcgtcctgctcctcgcgctccgtcggcatttccggctcttcgaagttgatgaagagctggaactggtcctgcaggatgcgcgcggccagcgcgatcgagtcttccggcgtgatggcgccgttggtctcgacatagagcgagagacggtcatagtcggtgtacgaaccgacgcggctgttctcgaccttgtacgagaccttcttgatcgggctgaacagggcatcgaccgggatcaggccgatcggcgcgtcctcgggccggttggccgaggccgggacatagcccttacccgtgttgacgacgaattccatgttcagcaccgcgccctcgtcgagggtgcagagcaccagatccggatccaggatcccgatatcgggcccggtctggatcatcgacgccttcacctcgcaggggccggtcgccttcagcgtcatccgcttcgggccgtcggcatgcatggtcagcgacatggtcttcacgttcagcacgatgtcggtcacgtcctcgcgcacgccggggacggacgagaactcgtgcagaacgccgtcgatcttgatggcggtcacagcggcgccctggagcgacgacagcagcacccggcggagggcattgccgagcgtcatgccgaagccgcgctcaagcggctcggcaaccacggtcgcctgacgggccggattggcgccgggctcgatttcgagcttgttcggcttaatcaggtcctgccaattcttatggatcacgtgaacgacctctcgttgctcgcgccgcaagtggtggatgccggtcgttgcggggatccggcgttgcggtgatacggcgggcatatggcacccgccgtgccggtgacgcggaaccagacaggcttacgccggccggtgcgcgccccgctcatcggggctggcgcgtccgaccggcgggggcgcgtgcggtcctggacgtcagacgcggcgccgcttgggcgggcggcagccgttgtgcgggatgggggtcacgtcgcggatcgacgtgatcgcgaagccggccgcctgaagggcgcgcagagccgactcgcggcccgaacccgggcccttcacctcgacgtcgagggtgcgcatgccgtgctcggcggccttgcggccggcgtcttcggcagcgacctgcgccgcatagggggtcgacttgcgcgagcccttaaagcccatggtccccgacgacgaccaggagatggtgttcccctgaacgtcggtgatggtgatcatggtgttgttgaagctcgcgttcacgtgcgcgacgccggaggtgatgttcttccggtcgcggcggcgcagacgcgcacccgtatccttagccatggtgcgtccttacttcttcttgcccgcaatcggcttcgccgggcccttgcgggtccgcgcgttggtgtgggtgcgctggccgcgcaccggcaggccgcgacgatggcgcaggccgcgatagcagccgaggtccatcaggcgcttgatgttcatcgcgacttcgcggcggaggtcaccctcgaccgtatagtcgctgtcgatcacttcacggatgcggataacatcggcatccgacagctcgttcacacgccgctcggcggggataccgaccttgccgcagatctcctgcgacttcgcccggccgatgccgtgaatgtaggtcagcgcgatctcgactcgcttcgcggtcgggatattcacacctgcaatacgcgccacgcttgattctccttcgtcgaccgacggtctgcgcccgcacgcgcccactcggcgcggaggggcgcgattataggatgaccgtcgctcaagtcaacactcagatgtcaggatccggcgtccaaaatggccttcagcgcccgggtcacatcatcgatgtctgccatgccgtccaccgtccgcagcagccccttcgcttcgtaatagggcagcagcggtgcggtctgggcgtgatacgcctcgagccggctcttcaccgtctcggcattgtcgtccttacggcgggtgaactcggtcgacccgcacacgtcgcagacgccctcgatcttgggcttctggaaggtgtcgtgatagccggcaccgcatttggcgcaggcgaaacggccggtgatgcgctcgaccagcgcaccgtcgtcgaccttcatctcgatcacgtgatcgagcttcaggccctgagaggcgagcatcccgtccagcgcctcggcctgggccacggtgcgcgggaaaccgtcgaggatgaagccgttgctgcaatcgtcctggccgatgcggccggcgatcatgtcgatgatcgcctggtccggcaccagttggccggcatccatgatcgccttcacgcggttgccgagcgcgctgcccgacttcacttcggcgcggagcatgtcgccggtggacagctgcacgatgccgtaggcgtcgaccagacgctgcgactgggtgcccttgccggcaccgggaggtccgaggaggatcaggatcacgaccgccgtcctttgagtcgggccttcttgatcagcccttcatactggtgtgccagcaggtgggactggatctgggccacggtgtcgatggtgacgttgaccacgatcagcaggctggtgccgccgaaatagaacggaaccgagtactcgctgatcagaatttcggggagcgcgcagaccgctgcgatataggccgcgccgatcacggtcagacgggtgaggacgtgatcgaggtaatctgccgtgttcttgcccggccggatgcccggaatgaagccgccatgcttgcgcaggttgtcggccgtctcttccgggttgaagacgatggcggtgtagaagaagcagaagaacaggatcgcgccgacatagagcgccaggtagagcggctggccatgggccaggttcgccgtcagccaggtcagccatgcgggaccgccggtggcgttgaagctcgcgatggtggtcggcagcaacaggatcgagctggcgaagatcggcgggatcacgccggcggtgttgagcttcagcggcagatgcgagctctcgccaccatagatccggttgccgacctggcgcttgggatactgcaccacgatccggcgctgggcccgctccatgaacacgatgaaggtgatcacggcgaccgacatgatcagcagcgccaggatgaagccggtcgacagcgcgccggtgcggcccagttccagcatgcgggccagcgcgccgggcagctcggccacaatgccggtgaagatgatcagagagatgccgttgccgacgccacgggcggtgatctgctcgcccagccacatcaggaacatcgtgccgccgaccagcgtgatcacggtcgcggcgcggaaataggcgccggggtcggccacggcggacatgccgccggcctgcagcccttcaaggcccaccgagatgccgtaggcctgcacgatcgccagcgccaccgtgccgtagcgggtgtactggttcagcagcttgcgcccgctctcgccctccttcttcaaggccgcgaaactcggcagaaccgcggtcagcagctgcacgatgatcgaggccgagatgtagggcatcacggtgagcgcgaagatggtcatgcgaccgagcgcgccgccggcgaagacgttgaacatgccgagaatgccgccggcgttctgattgaacacgtcggcgagcacggcgggattgatccccggcaccgggatataggtgcccaggcgatagaccagcagcgcgcccagggtgaaccagagccgcttcttcagttccgtggccttgccgaaggccgcgaaattcaggctgcccgcaagttggtcggcggaggacgccatcgcggatgcgctcccggcttgaagatggggatcaggaatgtcgcggccggggtcgtcccccgtccgcggacacacaggtcgtcgagtggtccatggcgtcgcccgggccactcacattccagggccgcggctaccgcggtccgggaatgcgagcgcgggcaaccatcccccggtcaggaccggcggacggtcacccgtcaagcctgctcgacgcaagccccggcctggatcaggcctgggcctcgtcggccaccggcgccgccggcagctcgaccttgccgccggccttctccaccgcttccacggccgccgcagaggcgccgctgacgcggatggtgacggctgcggtgatctcgcccttggcgaggaggcgcacgccgtcgcggatgcgacgcacgaggcccgcctcgatcagggccgcttcggtgatctcggtgccgagcttgccggcatcgatcgccttctggatgcgacccagattgacatggacgaaatcgttacggaagggcgcattggtgaaaccacggcgcggaaggcgacgatgcagcggcatctgaccgccctcgaagcccttgatcgccacgccgctgcgcgccttcgcacccttgtggcccttgccggcagtcttgccggtgccggagccggggccgcgaccgatgcgcttgcggtccttggtcgcgccgggattgtccctgagctcgttgagcttcatgacacggctgttccttgcgttcgtgtgtctggggaaggaagcccggggtcaccccctcaggccacctcctccaccaccacgagatgggccaccttggcgatcatgccgcgcaccgagggggtatcctcgagcacccggctgcgatgccgcttgttgaggcccagaccgatcagcgtctggcgctggtagtcgggacggccgatcgggctgccgatctgggtcaccttcacctgcttcttcgcctcggacatggatctcactccttgcccgcggcagcagcggcggcctggccgtcgcggcgcccgatgatgtcgctgaccttgcggccgcggcggcgggcaacctcacgcggcgactgcacggccttgaggccgtcgaaggtcgccttgatgagattgtaggggttcgaggtgccgtggctcttcgccacgacgtccgcgacacccagactctccagcaccgcgcgcatcgggccgccggcgatgatgccggtgcccggaggggccgcgcgcatcaggatccggccggcaccgaaatgcccgtcgatgtcgtggtggagcgtgcggccctcgcgaagcggaacgcggatcatgccgcgcttcgccttctcggtggccttgcggattgcctcggggacctcgcgggccttgccctggccgaaaccgacccggccacgaccgtcaccgacaaccaccagcgcggcaaagccgaaccggcgaccgcccttcaccaccttcgcgacgcgattgatggtgacgagcttgtcgatgaactcgccatcttcctcgcgaggcttgcgctcgttttccgtgcgtgccatgcgttcggccccctcagaacgacagcccgccctcgcgggcggcgtcggccagcgccttcacgcggccatgatagatgtagccaccgcggtcgaagaccacctcggtcacgccgcttgccgcggcgcgcgaggcgatcagcttgccgaccgccttggcggcttcgatgcccgcaccgttcttcagctcgcccttgagctcgctgtcgagggtggaggccgaagccagggtcacgccctgcacatcgtcgatgatctgggcgtagatattcagattggagcggtagacgctcagccgcggacggccgtgcgacttcttgcgcagctgcgtacgcacacgccgcttgcgccgctcgaagagcgaattcgcgttcatgcccctgcggctccttacttcttcttgccttccttgcggacgatgatctcgtcctcgtacttgacgcccttgcccttatagggctcgggcgaccggaaggaccggatctcggcggcaatctgaccgacgcgctgcttgtcgatgccagagatggcgagcgcggtcggcttttcagccttgatctcgatgtccgccggaacggcgtacttgatgtcgtggctgtagccgagctgcagggtcagcagcttgccgtcaacagcggcgcggtaaccgacgccgttgatgtcgagcttcacggtgaagccttccgacacacccttcaccatattggcgacgagggtgcgcgagaggccccacatggcgcggccgcggcgttcgtcgttggccggcgcgacgacgaccttgccgtcctcgagcgcgacgttcacgtccgacggcagggtccgctcgagcgcgccgagcttgcccttcacgcggacggtgttgccgtcgacggccacttcgacgccctggggcaccgcaaccggattcttaccgatacgcgacatgggacgtctcctcagaacaccttgcagagaacctcaccgccaacattggcggtgcgggcctccgcgtcggacatgacgccacggggggtcgagaggatctggatgccgaggccgttatagtgcttcggcagggccttgatcgacgaatagacgcggcgaccggggcgggaaacgcggccgatttcgcggatggcgggctcgccgtccacatacttcagcgcgatctcgaacaccggcttgccttcagacgactcgctgcgctcgtagccacggatgtagccctcgcgggtcagcacgtcgagcacccaaccgcgcagcttcgaggccgggcacagagtcgtcgacttgcgcgccagctgagcgttgcggatacgggtgatcatatcgccgaggggatcggtcatggacatatccggtcctcctctcttaccagctcgacttcgtcatgccggggatctgcccctgcgacgccaggtcgcggagcgccacgcggcacagctgcagcttgcggtacaccgcacgggggcggccggtcagcgcgcaccggttccggatgcgggtcttcgagccgttgcgcgggagggcggcgagcttcagggtcgccgcgaaacgctcctcgggcgacagctcacgatcgtcaaccaccgccttcagggcagcgcgcttgttcgcaaaacgcgcaaccagctgctcgcggtgcttgttcttctggacggcactggtcttggccataatcgcctcgcttgccgttgctcagttcacgaagggcatcttgaaggcggcaagaagcgccttcgcctcggcatccgtcttggccgtcgtcgcgaagacgatgtccatgccccggacggtatcgaccttgtcgtactcgatctcggggaagacgatctgctctttgaggcccatggcataattgccacgcccgtcgaacgacttgccgttcagcccgcggaagtcgcggacgcgcggcagagcgatggtgacgagacgatccaggaactcgtacatccgatcgcggcgcagcgtcaccttgacgccgatcgccatgccctcgcgcagcttgaagccggcgatcgacttcgaggcgcgggtcacgacgggcttctggccggtgatcttggccagatcggtcacgacgccgttgatcttcttctgatcgccaaccgcctcgccgacgcccacattcaggacgatcttatcgagacgggggatctccatgacgttcgcgtagctgaactgctcgcgcagctgcgggcgaacctcgttaacgtagtactcgtacaagcgtgccattttgggctgctccgccgtcaacgatcgatctgctcgccggaccgcttggcgacgcgcaccttacggccatcttcgagcgtggtaaaaccgacgcgggtcggcttgccgtccttggggtcggcgatcgcgacgttcgacaggtgcagcgacgcttccttctccacgataccgccgggattgcccggcttgggagcggtgtgccgcttgacgaggttaacgccctgaacgacgacgcggttctccttggggagaacctgcgcaaccgtcccggccttgcccttgtcacgcccggtcaaaacgacgacgttgtcgcctttcttgatcttggctgccatcagaggacctcgggggccagagagatgatcttcatgaacttcttgccgcggagctcgcgggtgaccggcccgaagatacgggtaccgatcggctcgccatgcttgttgatgagcacggcggcattgcggtcgaagcggatggcggtgccgtccggacgacgcagctccttggcggtacgaacgaccaccgcacggtggacgtcgcccttcttcaccttaccacgcggaatcgcctccttcacggagacgacgatcacgtcgccgacacgcgcgacgcggcgacgcgaaccgccgagaacgcggatgcacatcacacgccgggcgccgctgttgtccgccacttccagattggtttcggtctggatcacgggaccgttccttaatcagcaggggccgggcttcattcgccgtcagcgacgaccgtccagcgcttgcgcttggagatcggagccgattcaatgatgcggacgatgtcgccggccttgaaccggttgtcctcatcatgcgcggcatacttcttgctgcggcgaatgaacttcttgtagatcgggtgctggaagcgacgttcgaccttgacgatgatcgtcttgtcgcccttgtcgctcaccacgacgccctgaaggatacgcttgggcatctgatcactccttcgccgcggcgccggccgactggccgatcacggtcttgatccgggcgatgtcgcgccgcacctcgcgcacgcgcgcggtgttttcgagctggccgccagcctgctgaaagcgcaggttaaactgctctttcttcagctggagcagcatggtgttcagctcggtcgccgacttcgcgcgcagttcttcagccttcatggcctcagccctccacaccgatgcgctggatcacgcgggtgcggatcggcagcttggcggcgccacgctcgaaggcctcgcgggccaggtcggcggggacaccatccagttcgaacatcacgcgaccgggcttcacgcgggccatccagaattccggagagcccttgcccttacccatgcgcacctcggccggcttcttcgaaaccggcacgtcggggaagatacgcacccacacgcggccgacgcggcggatgtggcgggtgatcgcgcgacgggtcgcctcgatctgccgcgccgtcaaccggccgggttccatcgccttcaggccgtaggcgccgaaattcagcgccgtaccacccttggcatcaccgtggatgcggcccttatgcgccttgcgatatttcgtccgcttcggactcagcataagttccagcctttctcactaagctgatcgccgccggatcagcgcgaagcccgcgtctcacgacgctcggcttccgctgccagcggatcgcggctcagcacttcgcccttgaacacccagaccttgacaccgcaggtgccataggtggtgaaggcggtcgcctggccatagtcgatgtcggcgcgcagcgtatgcagcggcacgcgaccttcacggtaccattccgtacgggcgatttcggcgccgcccagacggccgctgcaggtgatgcggatgccttcggcacccagacgcatcgccgactgcacggcacgcttcatcgcccgacggaacgccacgcggcgctccagctgctgggcgatgttctcggccaccagggtggcgtcgagttcgggcttgcggacctcggcgatgttcagatgaacctcgcccttgaccagcttgccgacatcggccttcagcttgtcgatgtcggcgcccttcttgccgatgatcacgccgggacgcgcgctgttgagcgtgatgcgcaccttctgcgcagcccgctcgatcacgatgcccgacacgccggcgttcttcaggcggcccttcaggtacttgcgcaggcgcaggtcttcctgaagcaggtcgccataattgtcatccgcgtaccagcggctgtcccaggtacggatgatcccgagccggagcccgatgggattgaccttatgacccattagtcctgctcctcacgctcgcggaccaccacggtcagctggctgaaaggcttctccacgcgaccaacacggccacgggcgcgggcgctgaaccgcttcatgaccagcgccttgccgacaaaggcctcggccacgaacagacgatccacgtccagctcgtggttgttttccgcattggcgatcgccgactgcagggtcttcttcacgtcgttcgagatccggcggcgcgagaaggtcagcgcagccagcgccgactcgacgctccgaccacggatcagctcggcgacggtgttgagcttgcgcgggctcacgcgcagcatcgtcgaaaccgcgcgcgcctcgttttcggcaacccgccgctcggcactaggcttgcccatggttatttcctcttggccttcttgtccgcggcgtggccgtagaacgtgcgggtgggcgcgaactcgccgaacttatgcccgaccatgtcctcggagacaagcacgggcaggaacttgtgcccgttatagaccccaaaggtcaagcccacaaactggggcaggatggtcgaacgacgcgaccaggtgcgaatcacctccttgcggccggaggtgtgcagcgcgtcggccttcttcagcaggtacccgtcgacaaacgggcctttccaaaccgaacggggcacggtgtcctccttcagaccttagggcttgcggcgacggacgataaacttgtccgtagccttgttattgcgggtgcgcttgcccttggtcggcttgccccacggagtaaccggatgacgaccgcccgaggtgcggccttcaccgccgccatgcgggtgatcgaccgggttcatcgcaacgccacggacaaccgggcggcgacccatccaccgggaacggccggccttgcccaggctgacgttctggtggtcggggttcgacaccgcaccgatggtggccatgcattcggcgcgcaccatacgctgctcgccggacgccatgcgcagcatgacgtagttgccgtccttgccgaccacctgaacataggtgccggccgaccgcgcgatctgaccacccttgccgggcttcagctcgacattgtggacgatcgtgccgaccggaatcgacgacagcggcatggcattgccgggccgcacgtcgaccttggcaccggcgacgaccttgtcgccggccttcaggcgctgcggggccaggatataggcctgctcgccgtcggtgtactcgatcagcgcgatgaacgcggtgcggttcggatcgtactcgaggcgcacgaccgaggcttccacgtcccacttgcggcgcttgaagtcgaccagacggtagcgacgcttgtgaccgccgccaacctggaacgccgtgatgcggcccatgttgttgcggccacccgacttggtcaggccttcggtcagggacttgaccggcttgcccttccaaagctccgagcgatcgaccagaaccagctgacgccggccgggcgaagtcggcttgtatgccttcaaagccatcggatcagatccccgccgtcagatcgatctgctggccttcggccagagtcacgatcgccttcttgaagtccgagcgacgcccggggcggccacggaagcgcttggtcttgccggcctgcaccaaggtgttcaccgccttgaccttcacgccgaagagcttctcgacggcctgcttgatctcgggcttggtcgcatccagggtcaccttgaaggtgacctggtcattctccgaacccatcgtcgacttttcggtgacgaccgggctcaggatgatgtcgtacatccgctccgggttcatttcagccgcgcctccaggctctcgaccgcggcgcgcgacagcaccagggtgtcgcggcgcaggatgtcgtaaacattggcgccctggctcggcagaacgtcgatgccgatcaggttgcgggcggcgaggcggaagccctggtcgacctcggtgccgccgatgaacagcgtcgagctgcccagaccggccttctcgagacgggccaccagcgccttggtcttggcgtcgtcggccttcagctcgtcgaccaccaccagcttgccaccctgggccttgaccgacagcgcggtcttcagggccagacgacgcaccttcttcggcaggtcgtgggcatggctgcggaccacgggaccgtggaccgtggcaccgccgcggaagatgttcgcccgcttggcgccgtgccgcgcgcggcccgtgcccttctggcggtagatcttcgcggtcgagccggcgatctcggagatcgtcttcaccttgtgcgtcccggcgcgccgcttggcgagctggtagcgcaccatccggtgcaggatgtcgacgcgggccgggagaccgaacacctcgtcagccagcgcgatcgtgccggcatcctcgttatcgagggtaatgaccttcacatccatcgctcggccctcagccttccgtggtctcggcggccgccccggcggcctgcgccttgaggccggccgggaacggcacgctctcgggcagcgccttcttgacggcgtcacgcacgagaacgtacgaaccggcggcacccgggatggcgccctcgacgagcagcaggccacggtcggcgtcgaccacggtcacgcgcaggttctgcacggtcacgcggcgggcacccatgtggccggccatcttcttgcccttgaaggtacggcccggatcctgacggttaccggtcgaaccgtgcgagcggtgcgagaccgacacgccgtgggtggcacgaagaccgccgaagttgtggcgcttcatggcgccggcgaagcccttaccgatcgaggtgccgacgacgtcgacgaactggccgacgacgaagtggttggcaccgatctcggccccgatctccggcagcgcatcggcggtcacgcggaattccgcgagcttcgccttcggctccaccttcgccttcgcgaagtggccacgctgggccttcgagacgttcttaaccttggccgcgccgtagccgacctgaaccgcggtgtaaccgtcggtctcgtcggtgcggtgggcgacgacctgcagattgtcgaccttcagcacggtcacaggaatgtgaatgccggccgagtcgaaaacgcgggtcatcccgagcttgcgggtgatgactccagtacgcatctggcgttaccccctcagagcttgatctcgacgtcgacgccggccgcgaggtcgagcttcatcagcgcgtcgacggtctgcggggtgggctcgacgatgtcgagaaggcgcttgtgcgtccggatctcgaactgttcgcgcgacttcttgtcgatgtgcggcgaacggagcaccgtgaagcgctcgatctcggtcggcagcgggatcgggccccgcacgctggcgccggtccgcttggcggtgttcacgatctcgcgcgtcgactgatcgagcacgcgatgatcgaacgccttcaggcggatgcgaatgttctggccttccatcatgggcttctaccttggcctcggcggtgcgacctgccggatgaatccggggtgccgcagcgccgcgcgtccttgcatgagaccggcccgccgggcggaccggccgggcgctcgtggcgtcaggatatcaggcggcgaatgcgccaagcgggatcaacccgcccggcgcacccgctgccgtcgtccgtcgatcaacccatcaccttggcgacgacgccggcgccgacggtacggccgccttcgcggatcgcgaagcgcaggccttcgtccatggcgatcggcgagatcagctcgacggtgaccgacacgttgtcacccggcatgaccatctccgtgccttccggcagggtgatgacaccggtcacgtccgtggtccggaagtagaactgcggacgatagttggtgaagaagggggtgtgacggccgccctcttccttggtcaggatatacgcctcggcggcgaacttcgtgtgcggggtgatcgtgttcggcttcgccagaacctgaccgcgctccacgtcctcgcgcttcgtgccgcgcagcagcacgccgacattgtcgcccgcctcgccctgatcgagcagcttgcggaacatctcgacgccggtcaccgtggtcttcgtggtgtcgcgcagacccacgatcgccacttcctcgccgaccttgatcacgccgcgctcgatacggccggtcacaaccgtgccgcggcccgagatcgagaacacgtcttcgatcggcatcaggaacggctggtccttcggacgatccggggtcgggatgtactcgtcgaccgaccgcatcagctcaaggatccgctcggcgccgatctcggggttcttgccctcgatcgcagccagggccgagcccttgatcaccgggatgtcgtcgcccgggaagtcgtagctcgacagaagctcgcgcacttccatctcgacgagctccagaagctcctcgtcgtcgaccatgtcgaccttgttcatgaacaccaccagcgccggaacgccaacctggcgcgccagcaggatgtgctcgcgggtctgcggcatcgggccgtccgccgccgacaccaccaggatcgcgccgtccatctgcgcagcacccgtgatcatgttcttcacgtagtcggcatggccggggcaatcaacatgcgcatagtgacgggcttccgtctggtactcgacatgcgccgtgttgatggtgatgccgcgctccttctcttcaggagccttgtcgatcgagtcgtacgacgtataggtcgcaccgcccgtctcggccagaaccttcgtgatcgcagccgtcagcgtcgtcttgccatggtccacgtgaccgatcgtgccgatgttcacgtgcggcttgctgcgctcgaacttttccttacccatggctctcgcctccgtctttccaaacgtttttcaaaccggtcgtcgatccgcggatcagcccgcgtacttcgccttgacctcgtccgccagatgctgcggaaccggctcgtaatggtcgaactgcatcgtgtactgggcgcggccctgggacatcgagcgcagctggttgacgtagccgaacatgctggccagcggcaccatggcgttcacgacgcgggcattgccgcggctgtccatgctgctcacctgaccacggcggctgttcaggtcgccgatgatgtcgcccatgtactcgtccggagtgacgacctcgaccttcatgatcggctcgaggaggaccggacggctcttgcccatggcctcgcggaacgcggcacgcgacgcgatttcgaaggcgagcaccgagctgtcgacgtcgtgataggcgccgtcgatcagttcggccttgaggttcaccaccgggaagcccgcgatcacgccgttgcccaggcaggactcgatgcccttctgaacgccggggacgtattcgcgcggaaccgagccgccgacgaccttgttctcgaacgcgaagccttcctcgccctcgacgggctcgaacttcagcttcacccgcgcgaactggcccgaaccgccggtctgcttcttgtgggtgtagtcgacctcgaccggctggccgaagcgctcgcgataggccacctgcggctgaccgacattcgcctcgaccttgaactcgcggcgcatgcgatcgacgatgatctcgagatggagctcgcccatgcccttgatcacggtctggccgctttcctcgtcggtcgacacgcggaaggacggatcctcctgcgccagacgcgacagggcgaggcccatcttctcctggtcgctcttggtcttcggctcgaccgcgacctcgatcaccggatccgggaactccatgcgctccaggatgatcttggcatccgaggcgcagagggtgtcaccggtggtggtgcccttcatgccgcagagcgccacgatatcgccggcgcgggcttccttgacgtcttcgcggctgttcgcatgcatcagcagcatgcggccgacgcgctcgcgatcacccttcacggtgttcagcacgtaggagccgctctcgaccacacccgaatagacgcggatataggtcagcgagccgacgaaggggtccgacatgatcttgaaggccagcgccgagaagggcgcctcgtccttgctctcgcggaccagcgtggtctccggatcgtcgacggcggtgccgcggacggaggggacgtcgaccggcgagggcaggaagtcgatcacggcgtcgagcaggggctgcacgcccttgttcttgaacgccgaaccgttgatcacggggacgaactgacgcgccagcgtgcccttgcggatgcagcgcttcagggtggcgacgtccggctcgttgccctcgagataggcctccatcacctcgtcgtcggcctcgacggccgtctcgaccagcttctggcggtactcttcggcgcggtcggcgagatcggccgggatgtcacgctcttcgaactcggcgccgaggctctcgtccttccagacgaccgccttcatcttcaccaggtcgacgatgccgacatattccgactcggagccgatcggcaggctcagaaccagcgggttggcgcccagccggtcgaccatcatgtcgacgcagcggtagaagttggcgcccatgcggtccatcttgttgacgaagcagatgcgcggcacgcggtacttgtccgcctgacgccacaccgtctccgactggggctcgacgcccgcgacactgtcgaacaccgcgaccgcgccgtcgagaacgcggagcgaacgctccacctcgatggtgaagtcgacgtggcccggggtgtcgatgatgttgatgcggtggttgttccagaagcaggtcgtcgcggccgacgtgatggtgatgccgcgctcctgctcctgctccatccagtccatcgtggccgcaccctcgtgcacctcaccgatcttatgggaccggccggtgtaatagaggatgcgctcggtcgtcgtcgtcttaccggcatcgatgtgcgccatgatgccgatgttgcggtaggcctcgatgggcgtcgtgcgtgccatgttcgcgtccaggaagctggggtttctaagagacggccgacccgttaccagcgatagtgcgagaacgccttgttggcgtccgccatgcggtgggtgtcttcacgcttcttgattgcggtgccacggctctgcgcggcatcgagcagttcgccggccagacgctccaccgccgtgttctcggaacggttccgggcggcggtgatcagccagcggatggccagggcctgggcgcgatcggggcggacctcgaccgggacctgataggtggcgccaccgacgcggcggctcttcacctcgaccgccgggcgcacgttctcgagcgcctcgtggaagacgcggaggccttcctgacgggtcttctgctcgatcagatcgaaggcgccgtagacgatcgcttccgcgaccgacttcttgccatcatacatcagcacgttcatgaacttgctgacgacggcatcgccgaacttcggatccgggagaacctggcgcttttcagcggcatgacgacgggacatggatcaacctctccttgacggccggatcacttcggccgcttggcgccgtacttcgaacgacgctgacgacggttcttgacgccctgggtgtccagcgtgccgcggaggatgtggtagcgcacgcccggaaggtccttcacgcggccgccacggatcagcaccaccgagtgctcctgaaggttatgaccttcgcccggaatgtagctggtgacttcgaagctgttggtcagacgcacgcgggcgaccttacgaagcgccgagttcggcttcttcggggtggtcgtgtacacgcgggtgcagacaccacgcttctgggggcacgcctcgagggccggcaccttgttgcgatccaccggcgcgaggcgcggcttgcggatcagctgattgatcgtgggcatccaatcgatcccgtcaaacttgggctgcagggtttgcgaccctgcgtccacacaaaaaccgtcggagggcaaagcccctttcccgccaacggcacaaatgccggctcgggaaaggctttaccttccgggggctgttttcgccggcccctacggcatggaggggaccggatgtccgtgcggcatggacgcgcccgcccatgggggtccgcacaccagcccccgaagtgagcgcgcatactagttgtggcccctccccccgtcaaccccaaaaggcttgacacgcaagggtttccggcccgtcggggaatcccgcgggactctgcggaatcctgcaggattcccgcgaaaagcgaggggccggccctccggggcgggtagcggacctgcatcatctgcatgccccgacctcatcccctccccgcctcccctcaaacgccgacggccctgttgccgccccttgaagggcagcaacagggccgcggatgtcgtccagggcgtcctggcctggagagttactccgcagcgcccggcacgtcggcggagctttccagcgccgtctcgtcgccgtcctcgttgccgagcagggccttatcgcggttggccgcgatcgacttcagccggttcacggcggcgccggtgccggccgggatcagccggccgacgatgacgttctccttcaggccgtccagcgtgtccatcttgccggcggtcgccgcctcggtgagcacgcgggtggtctcctggaacgacgccgccgagatgaacgaccgggtcagcagcgaggccttggtgatgccctggagcaccggctcggccttcgcctcgcgcatgtcgggctgacgctcgccgccttccgacgccagacgctcggcattgcgctgccggaccttggcgttgatctggtcgaactcgaaccggtcgacctgctcgccgagcaggaaggtggtgtcgcccggatccaggatctcgaccttctgcagcatctggcgaacgatcacctcgatgtgcttgtcgttgatcttcacgccctgcagccggtagacctcctggatctcgttgatcagataggaggccagctcctcgacacccagcacgcgcaggatgtcgtggggcaccgggttgccgtccatcagcaggtcgccgcggcggacatagtcgccctcctggaccgtcaggtgcttgcccttcgggaccaggtactcgcgcggctcctgatccgcctcgtccggcacgatcaggatgcggcgcttgctcttgtagtcgcggccgaactcgaccttgccctggatctcggcgatgaccgcatgatccttgggcttgcgggcctcaaacagttccgcgacgcgcggcagaccaccggtgatgtcgcgggtcttgctgctctcgcgcgggatacgcgccagaacgtcacctgcgttcacctgctgtccgttctccaccgacagcacggcatccacgctcatgaaatagcgggcttccatgccgttcggcagggtcaggacctcgccctggctgtcgcgcagcgtgatccgcgggcgcagatccgcgccacggggctgctggcgccagtcgatgacgaccttgttggcgatgccggtggcctcgtccatccgttccagcagcgagatgccgtcgaccaggtcgacgtaatgcgccacaccgctggtttcggtgatgatcggcaccgtatacgggtcccagtccgccagacgctggccggcggtgaccatctggccctcgtccacgaacagacgaccaccatagggcaccttgtgccgcgccttctcgcggccgtcctcggcaaggaggacgacttcgagattgcgggacatgacgaccagggcaccctggctgtcgcgcaccacattgcggttcaccagctgcacgcggccttcgtaattggcctcgatgctggagacgaccgcgccgcgctgcgccgcaccgccgatatggaaggtccgcatggtcagctgcgtgcccggctcaccgatcgactgcgccgcgatgacgccgaccgcctcgccgatattcacccgcgtgccgcgtgccagatcgcgaccatagcaggctgcgcagacgccgtggccgctctcgcaggtcagcaccgagcggatgcggatggcctcgacaccggcctcgtcgacccgctcgaccaccgcctcgtcgatcagctcgccggcagccaccacgacctcgccggtcgtgggatgggtcaccgcctcagcggcggtccggcccaggatgcgatcggccagggtctcgatcaccacgccgccgtcgatgacggcacgggtcatcaggccctgctcggtcccgcaatcttcctcggtgatgacgcagtcctgcgccacatcgacgagacggcgggtgaggtaacccgagttcgcggtcttcagcgccgtgtcggccaggcccttacgggcaccgtgcgtcgagttgaagtactcgagcaccgacaggccttccttgaagttcgagatgatcggcgtctcgatgatctcgcccgagggcttggccatcaggccgcgcatgcccgcgagctgcttcatctgggccgccgaaccacgggcgccggaatgggccatcatgtagatcgagttcatgtggcgggggctcttggccatgcccgcctgcccctgacccgagatgacgcgcatcatggcgtccgcgacctggtcggtgcacttcgcccaggcgtcgacgaccttgttgtacttttcacccttggtgatgagaccctcctggtactgggtctcgtactgcttcacctcttcggtggtgacggccaccagctccgccttctcgtcggggacgatcatgtcgtccttgccgaacgagatgccggcgcgcgccgcacggcggaagccgagcgccatcagccggtcgcagaagatcaccgtttccttctgaccgcagtggcggtagacggcgtcgatgacgttggtgatctctttcttggtcagaacccggttgatcaggtcgaacttgatcttggggttccgcggcaggatctcggacagcagcatgcggcccggggtcgcatccaccatcaccgtgatcgggttgttgtcgtcgtccaccgtgcggtagcggcagcggatcttggcatgcaggctgacgacgccggcgtcgagcgcctggtcgatctcgcccacatcggcgaacaccatgccctcgcccagctcgttctcgccgatctgggtctggtagtagaggccgaggacgatgtcctgcgacggcacgatgatcggcttgccgttcgcggggctcaggatgttgttggtcgacatcatgagcacgcgggcttcgagctgcgcctcgatcgacagcggcacatgcaccgccatctggtcgccgtcgaagtcggcgttgaaggccgcgcagaccagcgggtgcagctggatcgccttgccctcgatcagcaccggctcgaaagcctggatgccgaggcggtgcagggtcggcgcgcggttcaggaacaccggatgctcgcggatgacctcgtcgagcacgtcccagacctcggggcgctctttctccaccatgcgcttcgccgccttgatggtggtggcgaggccatagagttcgagcttcgagtagatgaacggcttgaagagttcgagcgccatcttcttgggcaggccgcactggtggagcttcagctccgggcccaccacgatgaccgaacgacccgaatagtcgacgcgcttgccgagcaggttctgacggaaccggccctgcttgcccttcagcatgtcggacagcgacttcagcggacgcttgttggcgccggtgatgacgcggccgcgacggccgttgtcgaacagcgcgtccaccgcttcctgcagcatgcgcttctcgttgcgcacgatgatgtcgggcgcgcgcagttcgagcagacgcttcaggcggttgttgcggttgatgacgcggcgatagaggtcgttcaggtccgaggtcgcgaagcggccaccgtccagcggcaccagcgggcgcagatccggcgggatgacgggcacgacttccaggatcatccactcgggacgattctcggactcgatgaaggattcgagcagcttcagccgcttgaccagcttcttgcgcttggcttcagacgaggtctcgaccagctcggtgcgcatctcctcgctctcgcgatcgagatcgagctgcttcagcatgtcgcggatggcttcggcaccgatacccgcctggaaggcgtccgggccgtattcctcctgcgcacgcatgaactgctcttccgtcagcagctgatgctgcttgagcggggtcaggcccggctccatcaccacgtagttctcgaaatagagaacccgctcgatgtccttcagcgtcatgtcgagcagaaggccgatgcgcgagggcagcgacttcaggaaccagatatgcgcgaccggcgaggccagttcgatatggcccatgcgttcacgacgcaccttggcctgaatgacctcgacgccgcacttctcgcagacgatgccgcgatgcttcatgcgcttgtacttgccgcacaggcattcgtagtccttgatcggaccgaaaatgcgtgcgcagaacaggccgtcgcgctccggcttgaacgtgcggtagttgatcgtctcgggcttcttgacctcgccatacgaccacgaccggatcttctccgggctggcgatggagatgcggatcgcatcgaaggactgcgcccccgaaccgaagccgaacagattgagcacgtcgttgttcatgggaaagtcgctctcccttagcgcgtcttccgcaaggtctgcggagtgcggacggcgcggcggacggatatggcagccatatccatccgccgcgccggagatcggccgggccgatggcgtcagtcgttacggaccagttcgacgtcgaggccgagtgcctggatttccttcacgagaacgttgaagctctcggggatgccggcctcgaaggtatcgtcgcccttgacgatcgcctcgtagatcttggtccggcccgacacgtcgtcggacttcaccgtcagcatttcctgcagcgtgtaggcggcaccataggcctggagcgcccacacctccatttcaccgaaacgctgaccgccgaaatgcgccttaccgcccagcggctgctgggtgaccaggctgtaggggccgatggaccgggcgtggatcttgtcgtcgaccaggtggtggagcttcagcatgtagatgtagcccacggtcaccttgcggtcgaagggctcacccgtgcggccgtcgatcagctggacctgaccggaatggtcgagaccggcttcttcgagcatgcgcacgacgtcgccttcgttggcaccgtcgaagaccggggtcgccatcggcacgccgcgcttcagattgcgcgccagctccagcacctcggcgtccgacatcgcgtcgatctcgcggcagtcgtcttcccgttcatagacctgacgcagataggcacgcaggtcgtccatggtcttgccgcgatccatctcctcgacgatcttgccgatcttgcggccgagcccggccgaagcccagcccagatgcgtctcgaggatctgcccgacattcatgcggctcggcacgcccagcgggttcagcacgatgtcgacattgccgccgtcttccagatacggcatgtcctcgatcggcatgatgcgcgagatgacgcccttgttgccgtgacggccggccatcttgtcgcccggctgaagcttgcgcttcacggcgatgaagaccttgaccatcttgagcacgccgggcggcagctcgtcgccgcgctgcagcttctcgaccttgttctcgaagcgcttctgaagctgatcgacccgctggtcgagctgcttcttcaccgcctcgatatcggccatgcgcgcctcgtcggcgatggcgatctgccaccactgaccgcgggtgaaggacgagagcacctcgtcggtcaccacctcgcccgccttgatgccacgcgggccgccgacgatcttctgaccgtcgagcaggtcgcggagctggcgataggcgttgcgctccagaatcgcgcgctcgtcgtcgcggtccttggccagacggtcgatctcttcccgctcgatcgccagggcgcgctggtccttgtcgacgccgcggcgcgagaacacccgcacctcgacgacggtgccggtcacacccggcggcacgcgcagcgaggtatcgcgaacattcgcggccttctcgccgaagatggcgcggagcagcttctcttccggcgtcatcgggctttcgcccttcggcgtgaccttgccgaccagaatgtcgcccgccttcacctcggcaccgatataggtgatgccggcctcgtcgagattgcggaggccttcctcaccgacattcgggatgtcgcgggtgatttcctcaggccccagcttcgtgtcgcgggccatcacctcgaattcctcgatatggatcgaggtgaacacgtcgtccgagacgatgcgttccgagatgaggatcgagtcctcgaagttgtagcccatccacggcatgaacgcgacgagcacgttccggccgagggcgaggtcgccaagttcggtcgacgggccgtcggcgatgatgtcgccggcctggatccggtcacccaccttcaccagcggacgctggttgatgcaggtgttctggttcgaccgctggaacttcgacagcttgtagatgtcgacgccgttggtcgcgccgtcgccgtcggtcacgcggatcacgatgcgggtggcgtcgacctggtcgaccacgccgccgcgctttgcagccagcgccacgcccgagtcgcgtgccaccaccggctcgatgccggtgccgaccagcggcgcctcggcacggaccagcggcaccgcctgacgctgcatgttcgagcccatcagcgcgcggttcgcgtcgtcgttctcaaggaacgggatcagcgaagccgcaaccgaaaccagctgcttcggcgacacgtcgatatgggtgatctgctcgcgcggcgacatcacgaactcgcccatctcgcggcaggtcaccagctcgttgacgaagcggccttcggcatcgagatcggcattggcctgcgcgatggtgtagcggccctcttccatcgccgagaggtacacgacctcgtcggtgacgcggccgtcgaccaccttgcgataggggctttcgatgaagccgtatttgttcacccgtgcataggtggccaggctgttgatcagaccgatattcgggccttccggcgtctcgatcgggcagatgcggccataatgcgtgggatggatgtcgcggacctcgaagcccgcgcgctcgcgggtcagaccgcccgggccaagcgccgacaggcgacgcttgtgggtgatctcggacaacgggttggtctggtccatgaactgcgacaactgcgaagagccgaagaattcacgcaccgccgccgccgccggcttcgcattgatcaggtcgtggggcatgaccgactcgatgtcgaccgagcccatacgctccttgatcgcgcgctccatgcgcagcagaccgatgcggtactggttctccatcagctcgccgaccgaccggacgcggcgattgccgagatggtcgatgtcgtcgatctcgcccttgccgtccttcaggtcgaccagggtcttgatgaccgagaggatgtcctcgcggcgcagcacccgcacgctgtcgtcggtgtcgaggccgaggcgcatgttcatcttcacgcgaccgacggccgagagatcataacgctcgctgtcgaagaacaggctctcgaacagggcctcggcggtctcgggggtcggcggctcacccgggcgcatcacccggtagatgttcatgagcgcttcgtcgcgggtgtcggtgcggtccagcatcagcgtgttgcgcatataggcgcccacattgatgtggtcgatcgccagcgtcggcagccgggtgatgcccagctcctccagcttcaccagatgctcggcggtgatctcgtcaccggcctcgatcaggacctcgccggtggtctcgtcgatcacgtcctcgccggcataggcgccgatcaggtcttccggcgccaccacgaaggcgcgcaggccgctttcgaccagcttgcggatcacccgcggcgccagcttcttgccggcctcggcgacgacctcgccggtatcggcgtcgatcaggtcgcgggcgagcttgatgccgcgcaggcggtcttcgacgaagggcgtctgccagcccttgtcgttctgctcgtaggtgatcgtggcgtagaaggtcgagaggatctgctcgttgtcatagccgagcgcgcgcagcagcgtggtcgccggcagcttgcggcgacggtcgatgcgcacatagaccagatccttggcgtcgaactcgaaatcgagccacgagccgcgataggggatgatccgggcggcgtagagcagcttgcccgaggcatgggtcttgccgcggtcatggtcgaagaagacgcccggcgagcggtgcatctggctgacgatgacgcgctcggtgccgttgacgatgaaggtgcccttgtccgtcatgagcggcatgtcgcccatgtagacgtcctgctccttgatgtcgcggatcgaccgggcgccggtgtcttcgtcgatgtcccacacgaccagacgcagcgtaaccttcagcggcgcggcgaaggtcatgccgcgctgctggcattcctcgacgtcgaacttcggggtctcgagttcatagcgcacgaactcgagagtcgcgcggtcggaaaagtccttgatcggaaaaaccgacttgaacacgccctgcagaccgctatccgggcgctgggccggatcggcgtcgagctgaaggaactggtcgtacgacttcttctggacctcgatcaggttcggcagcgtcgtgacttcggggatgcgaccgaagctcttccgaacgcgcttgcgacccgtaaacgagtatgccatcgtcgttcctctcgaaccgtttttctaacggcgtcggcgccgtcaattcatgcgcccgccccgcctgcaggacccccggcattcaccggagccggtcctcagacagtcgatcccgcactcaccgccccaggccaccggctgccgacgcgccggtgaagtcggacgtttcgacgaaaacggccggcactccgcccgcgcgcgtcgcgcgctgcgatgagccgaccagccatccgtcgttcacgtcctgctgcgtgcccgtccatgacgggatcgcatccttccgccgagggacgatcgcctgcatatccgtctgaaatccacacacccgaagacgcgtccgatccagccacatacacatgcggttgcggcgccatgccggatcctgcatgacgcccgatgaaacccgtaagtagttgcgtgtgtccagcctgtcgcggagccaaagctgcccgtcaccacttgcgagcctgtgaccatatccgaaagcgaggcggatgggaagatttttgttgcagcatgcggctgcgcccatcacggcggcgatcgatcgatggtccggtccgccggccacacggccctgcccgtcccgcccccggtggcgagccaccgaaggatcctcccggcaaggcaacgccgcccgcccccgggcgaaccggggtcgggcggcgcagctgccgcgacacccttgggcgtcgcggcggatcgctcggtcgagcgatgcgtcgggtcgggtgaattacttcacttcgaccttcgcaccggcctcttccagcttcttcttcatcgcctcggcttcgtccttggtcacgccttccttcaccggcttcggcgcgccctcgaccaggtccttggcttccttcaggccaaggcccgtgatcgcacggacttccttaatgacgttgatcttcttgtcaccggcatcggcgaggatcacgtcgaactcggtcttctcctcgaccggggcggcagcctcggcggcgccaccggcggcagccacggcgaccggagcggcggcggagacgccccacttctcttcgagcatcttcgagagctcggcggcctcgataacggtgagggcggacagctcgtcaaccaggcgggcgagatcggccattgtagtagctcctgaacttcgatccgggtcggcccgcgcggggtccggtcacgggccggcatctgccgtgccaccaaccggtgccctgggtcgggcgggccttcgatgatgggtttggtccgaggggtgggcagcctggggtcaggcggcctggtccttctcggcataggccttgaggacacgggccagctggccgccgggggcctgcagcacgccgacgatgcggctcgcgggcgcctgaaggacgccgatgagcttgccgcgcagttcgtcgagcgacggcaggtccgcaagggccttgatgccgttggcgtcgagggtctgaccgatgatgccgccgcccagaacaacgagcttctcgttggtcttggcgaacttcatcgtggccttggccgccgccaccggatccgacgacaccgcaatggcggtcgggccgttgaacagcgggatgatcccctcgaaagccgtcccctggagtgccagacgggcgagcgtgttcttggtgaccttgaaggacgcgccaacctcgcgcatcccgatccggagctgggtggactcggccaccgtcagaccccggtaatgggtcaccaccacgacgcccgcggacgtgaaggactggcgcagttctgcgaccagctcttccttgcttgcacgatccacggttcgtctccgcgtgtgggttaccatgcgacgcgccggctcccccggataaggggggacgccgcatcgcggctcggtggcaccgtctccggtctccggccgggccgggaaccgtcggggtgccgtccgcacctgccgcgagtctgcgaaccgtccggaccggcaagacgccgtaccggatcgattgctcgccgtctggacaggcggatcccggaggatccattaaatgccgggcgctccggtcggaaccgggggtccggcacacctgccgtctcggacaggacggtcttcagtcatccggcccgcggaaacccgccggccggatgaaggtcttgaagtcaggccgcgttgccctggccacccggctgggtgatctcggcaacgtcgacgcgcacgcccggacccatggtcgagctgagcgccagcttcttcaggtaggtgcccttggcacccgacggcttcgccttgatcagcgcatccacgaaggcgcggatgttctcgaccagggcggtctccgagaagctcgccttgccgacgccaccatggatgataccggccttttcgacgcggaattcaacctggccggccttggcggccttgaccgcatcggcgacgttcggggtgacggtgccgagcttcgggttcggcatcaggccgcgggggccgagcacgcggcccagacgacccaccaccggcatgaggtccggggtcgcgatggcgcgctcgaaatcgatcttgccgccgaggatctcttcggccagatcttccgcacccaccacttcggcgccggccgcgcgggcctcttcggccttgtcgccgcgggcgaaaaccgccacgcgcacgctcttgccggtgccgttgggcagctgcaccacgccacggaccatctggtcggcgtgacgcggatcgacgcccaggccgaccgagatttcgacggtctcgtcgaacttcgcgccggcattggccttcaccagagccaccgcctcgtcaaggccgtagagcttctcgcgatcgacggtcgcgcgggcctgcttcagtcgcttgccgtggaacgccatccgattactccaccaccacgaggcccatggaccgggccgagcccttcaccatctgaatcgcgccgtccaggtcgttcgcgttcagatcgaccatcttgtcctcggcgatcttggcgatctgctcgagggtgatggaaccggactgggccttgccgggggtggcgccgcccttggagatgcccgcggccttcttgatgtagtacgaaaccggcggcttcttcatgatgaaggtgaagctgcggtcctggtaggccgtgatgaccaccgggatcggcatgccgacttccataccctgggtctgcgcgttgaacgccttgcagaactccatgatgttcaggccgcgctgaccgagcgcgggaccgatcggcggcgacgggttcgccttaccggccggcacctgaagccggatatagccggtaatcttctttgccatgttcagacccttccattcagacggggcggcggtggcggccctggcaaggcctcccgccggcaccacccgcgatcacccgtgccgtcaccggctccggagctgcgggctgcatccgcccggcggatgccggaacggatgcgggcgaagccggccctgaagaggccggcttcgcccgaagccttgatgtctcagaccttttcgacctgagagaattccagttcgaccggggtcgagcggccgaagatcgaaacggccaccttcaggcgggcccgctcgtcgtcgacatcctcgaccacaccgttgaacgaggtgaacggaccgtcggccacccgcacctgctcgccgatctcgaagctgatcgacggcttggggcgctcgacgccttccttcacctgattgatgatccggtcggcttccgcctgggtgatcggcacggggcgcgagccgccgccgcccaggaacccggtgaccttcggcgtgtccttgaccagatgccaggtgtcgtcggtcagctgcatcttcaccagcacatagccggggaagaacttgcgctcggtgttgaccttcacgccgcggcggacctcgaccacgtcttccgacggcaccaggacctcttcgatcaggccttccatgcccttgcgggcggcctgttcgcggatcgactgcgccaccttcttctcgaagcccgagtagacgtggatgatgtaccagttgctgatcatggtgccggctcctcgttcaggtcaggcgccgaggccgaggatcagccgaacgccccaggcgatcacctggtcggcgacgaagaaaaagatcgccgcgacgaacgccatcacgaacacggtggcggtggtgatcagcgtttccttgcgggtcggccaggtgacgcggcgcgcctcctgacgaacctgccgcacgaactcgccgggggaagtcttggccatggctactctgttccggatctgccgccggtcagcccgggcggctctgggtcggggtcacgaacgcgcggcggagaggttggcaggagtggagggactcgaacccccagcccccggttttggagaccggtgctctaccattgagctacactcctccaccgccgcacgacacaccggactggccgatgcgacgtgcccttcaaagatcacggcccgccttcctgaaggcctgccctacgatcgacgccgtaaggtgcccggttcggcagacaaggcccggttcggcagacaaggatcgccgtcgcccgcaggtgcggacgggccatccttctagcgcgtcatgtccgacttgtcgagacactttcgacgccctgcgcgcagttcttcacgtcacccctgaagcaccgtccggcgccgtcgggaaaacgccgcggcccctgccggaacactgtccggcaggggccgcaaagcgggtccggaggccgctggaaccggggttccgggcctccggggtctcgtcagccttctagcgcgtcatgtccgacttgtcgagacactttcgacgccctgcgcgcagttcttcacgtcacccctgaagcaccgtccggcgccgtcgggaaaacgccgcggcccctgccggaacactgtccggcaggggccgcaaagcgggtccggaggccgctggaaccggggttccgggcctccggggtctcgtcagcccatcaccttggcgacgacgccggcgccgacggtacggccgccttcgcggatcgcgaagcgcaggccttcgtccatggcgatcggcgagatcagctcgacggtgaccgacacgttgtcacccggcatgaccatctccgtgccttccggcagggtgatgacaccggtcacgtccgtggtccggaagtagaactgcggacgatagttggtgaagaagggggtgtgacggccgccctcttccttggtcaggatatacgcctcggcggcgaacttcgtgtgcggggtgatcgtgttcggcttcgccagaacctgaccgcgctccacgtcctcgcgcttcgtgccgcgcagcagcacgccgacattgtcgcccgcctcgccctgatcgagcagcttgcggaacatctcgacgccggtcaccgtggtcttcgtggtgtcgcgcagacccacgatcgccacttcctcgccgaccttgatcacgccgcgctcgatacggccggtcacaaccgtgccgcggcccgagatcgagaacacgtcttcgatcggcatcaggaacggctggtccttcggacgatccggggtcgggatgtactcgtcgaccgaccgcatcagctcaaggatccgctcggcgccgatctcggggttcttgccctcgatcgcagccagggccgagcccttgatcaccgggatgtcgtcgcccgggaagtcgtagctcgacagaagctcgcgcacttccatctcgacgagctccagaagctcctcgtcgtcgaccatgtcgaccttgttcatgaacaccaccagcgccggaacgccaacctggcgcgccagcaggatgtgctcgcgggtctgcggcatcgggccgtccgccgccgacaccaccaggatcgcgccgtccatctgcgcagcacccgtgatcatgttcttcacgtagtcggcatggccggggcaatcaacatgcgcatagtgacgggcttccgtctggtactcgacatgcgccgtgttgatggtgatgccgcgctccttctcttcaggagccttgtcgatcgagtcgtacgacgtataggtcgcaccgcccgtctcggccagaaccttcgtgatcgcagccgtcagcgtcgtcttgccatggtccacgtgaccgatcgtgccgatgttcacgtgcggcttgctgcgctcgaacttttccttacccatcctgctcaaacccgactagagagctgtaccgacggagaaaacgcggctgcccaaagatttcgggcccgcgagggtagcatttccgggatctggagcgggtgacgggaatcgaacccgcatagccagcttggaaggctggagctctaccattgagctacacccgcgcccgcgcgaccataagggccgccccgcttggggcggaggccggtcacgcctgcatccgcgaccaggctgcgctgcagggaaagtggtggagggggttggatttgaaccaacgtagggaaaacccggcagatttacagtctgctgccattgaccgctcggccacccctccatgggtgcttcctgcaccgcgccttggcgacggcactatggaaattcgcgggaagaagtcaacgagaatgttgcagagcacgcattcgaagaccttgtcccacgatcgcgaaccggtaccggagtacgggtccgcttgacgaagccttgttccctgccccatgaagaggccggaaccggccgcgtcgaacgcggtgtagcgcgttcgtaacgaaaccgaggaccgatgtcaaaccaagatcgccgccgaccgtcaaatcgtgattcaacacatcgtgatcaggcacgggccggccgcagccgcggacggggcgaccagggcggccgcgagaccggcggcgggctgtggttctacggccgccacccggtcgaggcggcgctggccaatccggcgcgcagcctgcaccggctgctggtcgcggaacggtccgaggccgcaagcgacccgaaactctcaagccttgcccgccggcgcaacctgcagatcgaaaccgtgccccgcgccgagatcgaccggcgcttcggcgaggatgccgtccatcaggggctggctttgcagctcgcccccctgcccgagcgcgatcttgaggcgacgctcgccgccgtgcccgaggggccggcgctgatcgtggtgctggaccaggtgaccgacccgcataatgtgggcgcgatcctgcgggccgccgccgccttcggcgcggccgcagtgatcaccaccgaacggcgggcggcgcccgaaagcgccgtgctcgccaaggccgcttcgggcacgctcgaactcgtgccgctggtccagatcggcaacctcgcccgcgcgctcgacgagctgaagcggctgggctggtggtgcgtgggcctcgacggccatgcgacacaggatgtccgcgccgccggcctgcccgagcgcctggccctggtgatgggcgccgaaggcccggggctgcgccggctgacccgcgagacctgcgacctgctgctgcgcctgccgatttcggaccaggtggagagcctgaacgtcgccaccgcgaccgccgtcgccctttatgcgctgggccccagccggggcgcttcgggcgcctgatccagcggccggggggcggccccctcgcgcggcagcctcaactctacggcgagcccgggcatgggctcgccgggtgccgtgtcggacagcaccagccgcccgccatgcagccgggccacggcatcggcaagcgcaagccccaggccgcttccggggcggctgcgcgccggatccagccgggcatagcgctccaccacccgcgcgcgttccgccgccggaacgccggctccgcgatcctccaccctgatcacgatccagtccccgttcgcctcgacggcgaggcggatcaccaccggcccggcgccgtgtttcaggctgttctccagcagattggccaccgcccgctgcagcagcgcccggtcacccggccgggtgatgtcgggcgtgagaacgctggtgaccggccggccctcgtcctcgaagggcaattcgtagatctcggccagttccgcgaccagcgccgagatgtccaccggcgcccaggcggtgcggccggcgccgctttcggcgcgggcgatggtggtcagcgcctcgaaggtctggatcacccggtcgatttccgccaccgcctcgtcgagcccggcgcgggccgcggcaccatcgccgcgcccgaccgccgccgccgcgtcttcggccgacacgcgggcccgggccagcggcccgcgcagatcatgggccatagcgtccgaggcgagccggcttgcggtcatcagccgggcgatctcgtcgagcatcgcattcaccgcatccgccagacggtcgtattcatcgccgctgccggctaccggaagccgcttctccatgtcgccggccatgatccggcgcgcggcctgggccatggcatccacccgggcgagcgatcgccgggccaggatccagccgccatagagcccgagcagcagcaccagccccatcgaccaggcagaggcctcggtcaccagctcgcggaaccgggcgcgctcggccagatcccgaccgaccagcaggcggaagccgcccgccagctgatagacccggacccgggcggtgcggccgtcggccagttcggcatcgatggcgccgtcggcggtcacctcggcggcccgcggccaggcatcaagcgtgccctcgatcggtacgccgtcgggggccgccagcaggtagatgccgcccagccccatgccgggcgtggcgcccggattgggcccgggccggccgcgcggcgcaccggatcgtgcccgcaccacctcgatcagccggcccagcccctcgatccggtactgttcggccaggccccgcacctcggcatccagggtctggtcgatctgctggtcgatgagcgtcagcgccgcccaggtcaccgcccccagcacgatgccggtcgaggccacgaaaaccgccagatacatcgcaacgatgcgcgcggccgatgtccggcgcagatgccggaacagaccggccgcatcagcggtcatcatgctctccgtctcctccggccggcaccggatcctccatgcccagcgaatagccgccgccgcgatgggtgcggatcagcggtcgaccgaaacccttgtcgatcttctggcgcagccggctgacatggacctcgaccacattggtctggggttcgaaatggaagtcccagaccccttcatagagcatggcccgggtcaccacctggccttcgtggcgcatcaggaattcgagcagccggtattcctgcggccggaggtcgatggcgcggccggcgcgggtcacccgcctggtgcgcaggtcgacctccagatccgccaccacaagccggtcggtggcggtggcctgcaccggtcggcggcccagcgcttcgacccgcgccaccagttccacggcggcgaagggtttggagagatagtcgtcgccgccggccttcaggccacgcacgcgttcatccacatgggccagcgccgagaggatcagcaccggcaccccctgaccggccccccgcagcgcgcccagcaccgccagcccgtccagccccggcagcatgcggtcgagcacgatcacgtcatagccgccgccggtggcgagaaacagcccctcgcgcccatcgggtgcccggtcgacgacgtggccggcctcggtcagcgcgcgcgtcgcctgctgggcggtgcggtcgtcatcctcgatgatcaggatcttcatgggccggcatgtcccgaagcattgggcagaagagttcagggaagggtatcgcaagccccggtcagaagacggagcgggcgggcacccccggaatggtggcacccgcccgcatccccccgcaagcatcgcatctgccctgcgctgcccgcgggtcttggatccggagcgaccaggagggagggtcagccgctccggaaggcgtcatccgggccggtgcgcggcccgggtgacgtcaaccatgaaccggtccggcggtcacttgatctcgaccgcgacgaagcggctttcattgccgcgggcgaccagcagcaggacatgatcgcgcttgcgggcgcgggcctcgtcgatcagcgccgtcacctgcgacgggcggtcgaccgcggtgccggccacctgctcgatcacgtcgccggggcgcagctccgggccggggccggcatggggccgcttgtcgtcgcctttgggcggcaggatgtcgaccacggccacgcccttgacgctgtcgtcgatgcccagccgctggcgcagcccgtcatcgatcggggccaggcgcacgcccagcgcatccaccgccacaccggcgcccggatctgcatgatcgccctgctggttggccgccagatcctgcggacgctcgcccaggcggatgcggatctccttctcatcgccctggcgcttcaccgccagcccgacccggtcgcccggctgcagatcgcccaccttgcgggtcagatcgcgggcatccttcaccggctggccgtcgatctgcaccaccacatcgccgcgttccagcccggcatcacccgccgggctgcccggcagcacccgggcgaccagcgcgccttcgggcttgtccatgcccagcgcctcggcgatttcaggcgtcagcggctggatttcaacacccagccaaccgcgggagatgctgccgctttccttcagctgcgccaccaccttggtcgcgatattggccgggatcgaaaagccgatgccgaccgacccgccattggggctgtagatggcggtgttgatgccgatcaccttgccgctttcgtcgaagaccgggccgccgctgttgccgcggttgatcgcggcatcgatctgcaggaaatcgtcgtaggggccggcattgatgtcgcggttgcgggccgagacgatgccggcggtcaccgtgccgcccaggccgaacgggttgccgaccgccagcacccagtcgcccacccgggcggcgtcgctgtcgccgaactgaaccgccggcaggtcgtggccggcctcgatcttcagcagcgcaaggtctgtcagcgggtcgcggcccaccagcttggcggtgtactggctcttgtcttccagcgtgaccttgatttccgtcgcgccgtcgatgacgtggttgttggtcacgacatagcccgagggatcgatgatgaagcccgatcccagcgcattcaccacctggggatgggtcggctgctggccctgcatgaagggttcgaagaagcggcggaagggggagttctcgggcaggtcgaagggcagcatctgctcgggcccgctcggctgctgcacttcctgggtggtggagatgttgaccaccgccggcatcaccttctcggccagcggtgcgaagctttcgggcagcgatgcggcattggcgggcaccggcgcgatcaccgtgccgccgacggcggccagcggcagggcaagcgctacgccggccatcagcccggcgccatagcggcgcaggcggttggcgtggcggcgggcggcgaagtcgcgggtgcggatcgcggccggctggggaagctgttcggtcatggcgtcagatcctcggtcagtgcagcctgcccccggcggggaggagcgttgggggaagcagagagggggaagacctctccccggctgcgtcgtcgaggatcattcaagcagccgggccctcaccgccggatgtcaggaacatgaacgcccgttcatctttccgaccttcgtagccttgtcccgatcaccgtcacgcggtatgtagtgcgggtgccgtcgcgcacaggctgtacccggccccggccgggacgcgtcccgggcccgatgcggcgccggctgccggattagctcaattggtagagcacccgccttgtaagcggaaggttgtgggttcaagtcccccatccggcaccagcgcggcccccgctcagatgtcccgcccgctgcacgccacgaccatccccagcacgacccgccacggctccggttaccggcttcacacagccttttcgggaacgtcacttcacctgtgaccgccgtcacttcacgtgcgtccgccgtttcctatagtgacttgcgtagccgtgatgccggcggcagctcccactccccggcatcccgtccattctggcgcccgtgcccggatggaccctacccgattggtgctgatgcttgacttgagccccgcccggcgcgtccgcgtgccttgcggggctttctttttgtcctgacgccgcccgcgcttcaccgcaacgcaacaatgtgttgtgcactgcgggcgggcggcctgatccacagtcggcacaacctgcccgattcttaggcagcccctgaacgactcggatggagtcagggggttggactcgttgtccacagacttctccaccagaacgggggaaaagctggaggcttccagcggaccgcaggcgcagctagtctgaggggatgagtgatcgttccatcgaaccgggcgccaccggtacccatccgacccgctggctgatgacccattacgggccctatcaggccggcctggacgcggccggccggccgcagcttgcgcccgatcccgcggatccggcgccgacgccgcttggcctggcgctggcggaggtggatcaccggctgcgcatccgccgccccgccgcccgcagcacctggcttgcggcggtggaagcgggccgcgatccggaagggaccgggcgcggcgaggcccccttcgtggaactgccctgggacgaggcgctggatctggcggccgccgaactggcccgcatccatcgcgaccacggccccaccgccatctatggcggcagctatggctggggctccgccggctggttccaccgtgcccgcgcccagctgcaccggctgctggccgccgccggcggcttcaccatgggggtcggcacctattcccacggcgcggccgagcggatgatcccgcatgttctggggctggatttcgccgccgccggcgccgccgcccccgattgggacgagatcgcggccacgaccgacatcctgttgagcttcggcggcatcccgctgcgcaacacccagctcgactggggcggcatccccggccaccgggtgggtgccgcgctggaacgcgcgctcgatcgcggcctcgacatggtcaccgtggcgccgatggccgatgatgcggccgcggccggccgggcccgatggctccgcatccgccccggcaccgatgtcgcgctgatcctggctctgctgcatgtgctggtcagcgaagggctgatcgaccggccggcgctggaccggctcacccatggctggccggtgctggaagcccatatcctgggccgcgacggcacgccgcccaaaaccccggcctgggcggccggcatcaccggcatcgcggatgccgccatcaccgccctcgcccgaaggctcgccggccgccgggcggtgatcgccatggcctggggcgtgcagcgccaccagaatggcgagatggcggtttgggccgcccatgccctggcggcggcgctgggccagatcggcctgcccggcggcggggtcggcatcggctatggcgccggcggcggcttcggcctgccccagaccgggcgccgcccggggctgatcggggccttgcccaaccccaacggcatggaggtgccggtctcgcgcttcgccgacatcctgctcgcccccggcgccaccatcgatcacgacggccgccggatcaccgcccccgatatccggctggtctggtgggcgggcggcaaccccttccaccatcatcaggatctgaaccggctgatccgcgcctgggcggtgccgcgcacgatcatcgtgcaggatatggtctggacccaggccgcccgccgcgccgatctggtcctgcccgccaccgggccgctggaacgcgccgatatcgcgggcggtctgcagggccccacgatcatcgccgccgatgcgctggtgccgccggtggcggaggcccgcgacgatcacgccatcctggcggccatcgccgaccggctgggctgccgctcagccttcgatgacgggctcgacgccgaagcctggctcgcccggctctgggaccgcgcccgcagcggcaccgacgatcttcccgatctggccgggctgcgcgccgcaggccgcatcgacccgccccccctgcccgatgccgtccgcacccgcgccgggaggcttgcccgcttccgcgccgatcccgcggccgacccgctgccgacgccttcggggcgcatcgaactggcatcggacaggatcgcggcgatggggcttccgggccatccctgctggcagccgccggcggaatgggcgggcagcgacctcaccgcccgtttccccctgcatctgctatcgccccagccggcgacgcggctgcacggccagctggaccatgccgccccctcgcttgcggccaagcatgacgggcgcgagcgggtgatgctgcatccggaagatgccgccgcccgcggtattgccgacggcgactgcgtgatgatctggaatgatcgcggtgcctgccttgccgcggcccgcctctccaccgacatcatgcccggcgtggcggccctgccgaccggcgcctggtatgatccctctcccaccctgaaggatgccgccggccggccggtctgccgccacggcaatcccaacctgctcacccgcgatgccggctcttcgccgatcgcccaggcgccggccgcccagacctgtctggtcgacatccggcgcgtcgatccggccaccgccgccgcggaacgccccagcccctatgaaggcccgatgttcgcagatcgagacaccgtaaccaccgccagccccgacaccggacccgccgcatgagccgtggcatgcgccgcggcgggggcctgcccgccgatctgccgccggcaccggtggaacgcccgcaattcgccgccgcccgcgatcttctgccctatctctggccccgcggccgccgggacatgaagatgcgggtggtgttcgccctgctggcgctggtcggcgccaaggcggcgatgctgaccgtgccgctgttctacaaacaggcggtggatgcgctgggcacgggggccggcacggccgcgaccgcggtcaccgtaccggtgatgctgatcctggcctatggcgtggcgcgtctggccggccaggcgctgggcgacgtccgcgacgcggtcttcgcccgcgtcgcccagaacgccacccgcgccgccggtctcgacgtcttccgccacctgcatcggctgagcctgcgcttccatctggagcggcgcaccggggcgctggcgcgcgccatcgagcgcggcgtccagggcatccagttcctgctgtcgacggtgctgttcagcatcgtgccgacgctgatcgaactctgcctggtcgcggtggtgctctggcggctctatgactggcgcttcgcggcggtgacgctcgccaccgtcggcatctatgtcgccttcaccatccgggtctcggagctgcgcgtcgttcatcgccgggtgatgaacgaacgcgaccaggaagccggcggccgggcgatggacagcctgctcaactacgagacggtgaagtatttcggcgccgaaacccgcgaggcagagcgctatgaccgtgcgctcgccgcctatgaaaccgccgccgtccgcgcccagctctcactctcgggtctcaatgtcggccaggggctgatcatcgcctcggggctggtcgcaatcatgctgctggcggccagcggcatcgccgacggcagcatgaccatcggcgatttcgtcgcggtcaacgcctatctgatccagctttatgtgccgctcaacgtgctgggcttcgtctaccggcagctgcgccagtcgctgaccgatatggagaccatgttctcgctggcggcggtcgcgccagaggtcgccgatcgcccggacgccccaccgcttcgggtcaccggcggcgagatccggttcgaagacgtcgtcttcggctacgatccgcgccggccgatcctgaaggggttgagcttcaccgcccgcgccggcagcacggtcgccatcgtcggcccctcgggcgccggcaaatccacggtctcgcggctgatgttccgtttcttcgaccccggctccggcaggatcctgatcgacggccaggagatcggggccgtcgcccaggaaagcctgcgggccgcgatcggcatggttccgcaggatcccgtgctgttcaacgacacgctcggctacaacgtcgcctatggccgccccgatgcgacgcccgacgagatccgcgccgtgctcgaccgcgcggcgctggggcccctgctcgccagcctgcccgacgggctggaaacccgggtgggcgaacgcgggctgaagctttcaggcggagagaagcagcgggtggcgatcgcccgcgctttgctcaaggatccgccgatcctgatcttcgacgaggcgacatcggccctcgacacccgcaccgaggccgcgatccgcgacgggctggcgctggccgggcgcggccgcaccatgctggtcatcgcccaccgcctgtcgaccatcgtcgatgccgatctgatcgtggtgatggaagacggacgggcggtcgaacagggccgccatgacgagctggtcgccgcgggcgggctctatgcccggctctgggcgcagcagagtgccgagcccgaggcagcgccggcgggcacgtccgaagaggcggcatcatgacccgacgcgccaggaccacgtcgttccccgaaatcgccgtggccaaaagcccgatgcgcatcgccaccctgctggtggtcgggctggtctggatcgccgcctgtgcctggttcgcggtccaggggctcagcggcgcgatcgaggatccggcggcgctgctggtgttctcggccctgctcgccggcatcgccgggatgctggtctggacggtgatcgatctcgtccgccgcccggggccggtgatggtgctggcggcagacgggctgatcgcgcccttcctcggcagcgaccggccgatcccctgggcggatgtccagatgcgccgctccgcgctcggcgcctggttcatgggcatcgtgctcgcggtcaggatcgaccccgccgtccataccggccgccccggccccgcccggctgttcggcccggggggccggcggctcgacgacggcagggtcgaggtcgacatcgccctgcccaacatctttgccggcggccgcgagaaggtcatcgcgatgatcatgcagcgccatgtgccggcggcgctggctgcggcgggcatcccgcccggcggcaggaagcgctgagacgtccggaagccgggatacgtccggaagccgggatacgtccggaagtatgtgctgcattgcaaaaggcgcattgggcaaacgccgcctgcaggcctacctttcagtcatcgaacacgaccgctccggcgcggcgcccgacagtcacggacgccccggagccgactgaaaccggagccttaccccatggccgccaccaagatcgcccaggtcccctctcaggacgaaatcgacgcgctgatccgcgaagcccgccagatgcgcgcccgcgccttcgcccagtcgatcgaaaacctcttcgcccgtatcggccgcctgttcggcggtcaccagggcaccaatggcggcctcgccgcccgctgaccggacatctcttccggcagttcccacgcccccgcatatccgtgctgcagcgcagcatatcccggacgtcgtgccgtcggttcggggacttgccacagcccggtctcgaccatgaggcgccgacccgttaaggtcggcgcctcatgtcgttcgggccccggatatcgggtgccgcagtgtttcgggaaggtcagacagtggcatcggataccccccgcgccgcaaccgacgccacgatagataccgcgacccgccgccgcgccatggcggcactggtgctgaccgtcaccttctggtcgttcaacttcgtggtcggccgggcggtggccgggcagatcccgccgctgacgctgtctttcctgcgctggttcttcgccttcctgctgttcagcctgatcgcctggccgcatgtcctgcgcgaccggtcggggctgatccgggcctggcccaagctgctgctgatggggctgacctcggtcgccggctacaacaccttcgtctatctggcgctggagcggaccaccgcgatcaacgccgtcatcctgaacgccaccatgccgatcgcgatcgcggtgatggcggcgctggccggcgtcgaccggctgggccgcaaccagctggccgggatcatcgtctccttctgcggcgtcgcctatatcgtcgccggcggcgaccccatggcgctgctgcatctgaagatcggcgcgggcgatctgtggattctgggcgccacgctgtcctggggcgtctattcggtggcgctgcgcttcaagccggcctggctgcaccccttttcgctgctctgggccaatatgctgatcggcatgctggcgctcagcccgctggcgctgaccgaagtgctcgacggccgcctgccggtggtctcggcgaccacggtggcggcggtcgcctatgtcgcgatcttcccctcgatcatcgcctatatcctgtggaacggggcggtggcgaagatcggccccaatcgcgccgggctgttcatgcatctgatgccgatcctgacaccggtctggagcatgctgtttctgggcgaaaggctggggccccatcatctggtcggtggtatcgccatcctggccgggctggtgctcaccaccaggacatcccgggccgcccgcggctgaaccgggcctgccgcggaactgggtgatccgccaccggagcgggtccgtatagtgacgtgaaccctgccggagatgccggcatgccagtcacgtccctgcccgccgaggcccgatgaccgaccgtcccctgatcgtctggttccgccaggatctgcgcatcgccgacaacccggcgcttcaccgcgcatcccggagcggcagccggctggtctgcgtctatgtccatgaagacgacgatcccgcccatgacgacgtgccggcgccgcggccgctcggcggtgcggcgcgctggtggctgcatcggtcgctcctggcgctcgatgccgatctgcgcgcgatcggcggccggctgctgctgctgaaggggccggccgcgcgcgagatcccggcgctcgcccgccggatcggggccggggccgtgctgatcaaccgggtctatgatcccgaaggcgccgctcgcgaccgggcgatcggagagcggctgaaggccgatggcatccacatggccggccacaacgccctgctgctccacgagccctggacgatcgagacgaagaccggcggcccctatcaggtcttcacccccttctggcgcgccgcccgcgacaagggtgagatcccgccgccgctcgcggcacccgaccggctggacctggtcgaagacgcgcccgaaggcgtgccgctcgcagctctcgacctgctgccgcggatcgactgggcgggcggcatcgccgccagctggacgcccggatccgccggcgcccgcgaccgtctggccggcttcctgaaccgcgccctcaccggctacaagcccgatcgcgaccggccggcgggggagaccacctcgcggctgtcgccgcatctgcgcttcggcgagatcggcccgcgcacggtctggcatgccgtccaccatgcgatcgaggcccagggtcttacggggccggcacgggcctcggccgacaccttcctcaccgagctgggctggcgcgaattcagctatcacctgctgcatcatttcccgcatctgccggcacgcgaccttaaagagacgctgaccggctttccctggcgagaagatgccgcggcactcgatgcctggcagcgcggccggaccggttatccgatcgtcgatgccggcatgcgccagctctggcacaccggctggatgcacaaccgggtgcggatggtggtcgcgtccttcctggtcaagcatctgatgatctggtggaagccgggcgaggcctggttctgggacacgctggtcgatgccgatccggccagcaacaccgccagctggcaatggtcggccggcaccggtgccgatgccgccccctatttccggatcttcaacccggtgctgcagggcgagcggttcgacggcgacggcgcctatgtccgccgctgggtgcccgagcttgcaaaactccccgaccgctatctgcacaaaccctggacggcccccgcctccgtcctcgccaccgccggcatcaggcccggccagacctatcccgccccgatcgtcgatcacgatcaggcccgcgagcgtgcgcttgcggggtatgcgcagacccgcaaggagtgagccggatgtacggtctgaacgagatcgagcaggcgggcgggaccgccgaacgcctgcggccggtggcggtgatcggcgccggcggggccgggctcgccgccgcctgggcgctggcccgttccggccggccggtgacgctgatggagcgcgcgccccgtgctggcggccacatcaacaccatcgatgccggccccgcgctgggcagcccgcatccggtgccggtcgataccggcttcatcgtctataacgagcgcaactaccccaacctggtccggctgttcggggcgctcgacaccgaaaccgccgccagcgacatgtcgttttcggtcagcctggcggggggcgcctatgaatatcgcggcagtgccggcgggctgttcgccgcccgccgcaacctgatcgacatgagccattggcggatgctgcgcgacatgcaccgcttcaaccgccaggccccggcgctcgccgtcgacggcaccgaaagcctggggcggttcctcggccgcaacggcttctcgaccgatttcgcccgccgctatctgctgccgatgggggcggcgatctggtcggcgccgatcgcgaccctgctggagttccccgcggaaagcttcgtgcgcttcttccgcaaccatgccctgctcgactatcgcggccggccggtctggcgcacggtggccggcggcacgcgcagctatgccgatcgggtcctggcccatccgctgatcacgctcgaaacctcggcgggggtggaggcggtgatccgcagcccggccgggccgatggtgaaatgccgcggccgcatggccgagacctattcggccgtcatcctcgccacccacgccgacgaggcactggccctgatcgaccgtccggatgccgcagaacgccgggttctgatggccttcggctatcagcccaaccgggcggtgctgcatcgcgacgcgcggctgatgccgcgccgccgccgggcctgggcctcctggaactatctgggccataccgatggcagcggtactgagcagctggcggtcagctactggatgaaccgcctgcagccgctcgcgaccgaaaccgacctcttcgtcaccctgaacccgccggtggagccgcgggacgtcatcgccgacatcacctatgcccatccggtcttcgatggccccgccatcgcggcccagccggccctggccgacatccagggcaccggcggtgtctggttcgccggggcacatttcggcttcggcttccacgaggatgcctgtgcgagcggccttgccgcggcggtcatggccggcgccgacctgccctggccggagctgctgggcgaggcgaccctgcgtcgcctgccggccctgaccgccctgcccgcgcggatcgaggcccgcagccgcagctgggccctggctgcggaataggcggcactcccggcgacgccacgtctggaattgtccgcgcattgcccccatcctgaacccgtgacggttcattcgctgcagccaccggaggccgcatgaggatcgaaggcgggctcggatctgcgaaggtgatgcaccggcggctgcggccgcgggagaatgccttcgtctatccggccttttacgtcgccctgcccctggaccggatcgaccgggccggcaacgccctgttcggggtggaccgtctgcgcccgctcgccttgctcacccgcgatcacggcccccgcgacggcagcccctggcggccctggcttcaggacattctggaccgtttcggccttggcgatctgggcaccggcaacgtgctgctgatgacccatccccgggtcttcgggcatgtgttcaacccggtcagcttctggttcgtgcgcgatgacgacggccgtttacgggcggtgctggcagaggtgaacaacaccttcggcgaccggcacaattatctcgtggcccatgacgacggccggccgatcctgccggaagaccggatcacggcccgcaaggtgttccacgtctcgcctttctgtgccgtcgacggtcactacctcttccgcttccgggtggaagacgggatgatcgcggcagcgatcgattatcacgatgcggccggtccgctgctgctgaccgccgtcaccctgaagcgccgcccgctcgactttgccaatgccgcccggctgctggcgtccatgccggtgatgacgctccaggtggtggcgcggatccactggcaggcgctcaggctctggctgcgcggcaccaggtttcaccgccgcccggccccaccgatggaggagacgacccgatgagcacggacagtctgtccccgggaagcggtttcgcaggcccggccggccttgccggtctggatctgccgggcttcttcagcggcatcctggggcgctgggccgtgggcgagctgacggtcattctgcccgacgggcacaaggtcacagcgcggggcgccacgccgggcgaacatgcggtgctgcgcctgaccgactggtcggtggtccgccgctgcctgaagcgcggcgcggtcggctttgccgaggcctatatggacggcgcggtcgataccgacgatctggtcgccctgctcaccctgctcgcccgcaatgaagacgtgatcgcccgcggcttttcgggcgggcgcaccgcgcgtctgctgggctggatggcccatgccctgttccgccgcaacagccggcgcggttcgaagcgcaacatccacgcccattacgatctgggcaacagcttctacgccctctggctcgacgacagcatgacctattcctcgggcatctacgggccggacggaaccggcgatctggcggcggcccaggccgccaaatacgaccgcctgctcgaccggatcgccctggcggaagcagggctcgacagccccggccgggtgctggagatcggctgcggctggggcggctttgccgaacgcgccgccgcccgcggccatcacgtccacggcatcaccatcagccgcgcccagctggaccatgcctgcgcccgtgcccgcgacggcggctgggccgatcgggcgcatctggaattccgcgactatcgcgaccttcagggccgctacgaccacatcgtctcgatcgagatgatcgaggcggtgggcgagcgctggtggccgacctatttccgcaccctcgccgaccgcctggcgccgggcggccgggccctggtccaggcgatcaccatcgacgagcggcactaccagcgctaccggcgcggggcggatttcatccagcgctatgtcttccccggcggcatgctgccgacccgcacggtcatccgcgcccaggccgccgcggtcgggctgaccgtcaccgatgaattcgccttcggtcgcgactatgcgcgcacgctggtcgcctggctcgcccgcttcgatgccgcccgcgcccgcgtgctggcggccggcttcgacacccggttcatccggctctggcggtactacctcgcctattgcgccgccgggttcgagaccggccgcatcgacgtggttcaggtggagatggcccatggccgatgaccgacgacgcaccgcccccctgctccgccggctggaaagctggcagggccggcgggtctggctgatcggcgccagcgacggcatcggccgcgaactggcccgcctgctcgccgccgacggcgcaaggctcgcggtcagcgcccggcgcgtggacgagctggaggcactggcccgcgatctcggccccgaggccctggcgcttcccgtcgatgccaccgatcaggccgccctcaccaccgccgccgcccgtctggaggccgcctggggcgccgtcgaccatgtgatctataccgccggcgtctactggccgatgggcatcgacacattcgatgtcgaaaaggccgcgaagatgatcgaggtcaacctgaccggcggtctcagggtcaccgctgccgccctgcccctgctcgaacgcggccacgcgccccagctggccctcaccgccagcgcttcggcctatcgcggtctgccgcgggcgatcggctatggcgcctccaaggccgggctctacaatctggccgaaaccctggcggtggagctggcgccgcgcggcatcgacgtgcgcgttatcaaccccggtttcgtgcgcacccggctgaccgacatgaacgatttccgcatgccggcgatgatcgagcccgaggccgccgcccgggcgatgcgcgacggcctggcctcacgccatttccacatccatttcccgaagcgcttcaccggtctgctggtcgccgcccgcctcctgcccagccgctggtggctggcgctctccgcccgcatggtcaaggggtgatcggccagcgcgacgccgctcagaccggcgccgccagccggcgccggatcatccgcagcaccgcccccagcaccggcacccgctcgtaaagctgtgccgccgggtcccaatggtcgatatgggccagcacccggccgtcttccgccagcgtcacctcgctcatgccctccagcgtgaagggttgcgttcggcccttgcgccgggcggtgaaccgccagcggatgaggcccgtggcgccgtctgaggcgcgggccgttacccggaagcgcggcacctccagcgtctcgaacatatgggccagcagcgccttcacccgatcgcgcccggtcacgtcgttgaacgggtcggcaaagcgcagctccgccaccgccagatcgccgatccggtccaggctttccggcgacaggctctcgaaaaagctgcaccaggcgtccagcccggcattcatccggtcggtcatgcgaaaagatcccctgtggcatccgtcggggcgtccgtcggtcggccgaagccccggtcgctgccgtgccggtccagatgggccaggaaatccgcagcctggcgttccagcgccgccacccgcgccggggccatccggtccagcgagcgataggccagcgccagccgcggattgccgtccagccgccggcggttgcggatcaggaaatcccagtagagcgcattgaacgggcaggcgccatcgccggtcggccgcttggggtcatagcggcagccgcggcaatgatccgacatgcgcgagatatagccggcccccgccgcatagggcttgctcgccatccgcccgccatcggcatgcagcgccatgccctggacattgggcagctccacccactccaccgcatcggcatagaccgccaggtaccaggcggcgacctcctccggccgggtgccggtcagcagcgcgaaattgcccgtcaccatcagccgctggatgtgatgggcatagccggtgcggagcgtctggcccagggccgccgccatgcaggccatgtcggtctcgcccgaccagtacatccagggcagcggccgggttgcgtcgagcgcattggtcgcggcatagcccggcatctccagccagtagatcccgcggacatattcccgccagcccaggatctggcggatgaagccctcgaccgcggcgagcggcgcacgcccctccgcccatgccgcctcggcccgccggcagacctccagcggttccagcaggcccagattgagcgcgggcgagatccgggcatggaacagcacctcctcacccgcggccatcgcatcctgatagtcgccgaaccgctccagccgccgggtgatgaaatcctccagcgccgccagcgcctgggccctggtcaccggccagtcgaaaccggcggtgtcgccgacatgggccccgaaccgcgcatcgaccagccggatcaccgcacgggtgacctcatcgggcggaaagcccgccggtacgggcggacgcccgcccgccgccttcgcatcgaagggcttgcggttctcggcatcgaaattccatcgcgctcccgccgggctgtcgccgtcatcggccatcagcagcccggtccggcggcgcatcatccggtagaaatgctccatccgctgctggcggcgcccgcgcgcccagtcgcggaaatcattccggctgcacaggaaacgggtgtcggggcggatgtccagatccacgcccgcggctgcggccgcccggatcagcgcctgttccacccgccagtcgccggcttcggtcatcaccacccgccgggtgccgtgccgggcgatggcgcgggtcagctcccccgccaggctgccggtattgccggcatcatccagcgccacatagtcgaccgtcagccccccggccacgagatcatcggcgaaatggcgcatcgccgacaggaagagcgcgatccgcacccggctggacggcacatgggtcgcctcttcggcgacctcggccatcagaatcacatccgcctcgccgggctgcgcgccgtcgagcgcagtcagcccccggctcagctggtcgcccagcaccaggcgcagcgtccgggccatgcgcggtcagcttttcacatgcagggcgccgcgcccgccatccaccgcgatcacctggccggtgatccacccggcgcgggccgacagcagcagggccatcatcaccgccacatcttcgggctcacccagccggcgcatggggtgcaggcgggccagagccgatcccacaccgccggtggcgccatagatcagcaccggggcctcatccccttccaggatatccgtcatcgaaccgctccagcagacctcgtcttccggacaggcaagctagatctggcggcgcatccggaaagggtcgacgcatccggaaagggtcgctgcgtccggaaacggccgacggcccgcagcttgcactgcgggccgtcggggatacgtctgcatagggcgggtccgtcggatcagtctttcagcccgccataggggtcggccagcaccgggccggggtcttccgccccctggggcaggccttcccagccgccgcccagcgccttgtacaggttcaccgaggcgacatagaggttctggcgggtggtcacccgcgacagctcgacgtcgagcagggtgcgctcggcatccagcacgtccagataggcggcatagccggcgtcatagcgcagccgcgccagttccaccgtcctctgcagctcggccacctgggcgtcctgcgcctccagctggcccatggccgccgtgcgcgatgccagcgcatccagaacgtcctggaaggcggtgcgcaccgtctggcgatagctgatcgcggtctgctcatagcgcgacttcgccgcctcgacctgggcatcggtgcgcccgaaatcgaagatcggcccggtcagcgccagggccaggccccagatgccggcgccgttcgacaggaagtcagacagctgcgtgctctgtcgtccggccgaagcggtcaggctgatctgcgggaaatagcccgcccgcgcgacgccgacattggcggccgcggccgcgatctgctgttcggccaccgccacgtcggggcggcgcagcagcagttccgacggcaggcccagcggcggcaccggtgcatccggcagaacgtccagcgccacgccgcgctcgacatccttgccgatcagctcggccggggtgcgccccagcagcacgcccagcgcattggcggcctgatcgcgcgagccttccagctccgggatccgggcgcgggtcgattcccgctccgaccgcgcctgggccaggtcgagcgcgtcgatcgtgccggcctcgtactgggcctgctgcagctccagggtctgttcgcgcgccgacagcgtgcggcgggcgatctccagctgcaggtccagcgcccgaagctgcagataggcgttggcggtgtcggccgcgacggtcaggcgcaccgcatcgcgattggccaccgtctgcagcagctgggcacgctgggcccggtcggcattgctgagccggccccagaggtccagctcataagacagcgccgccgaggccgagaaggtattggccagctggccacccgacgagccgaagctcgatgtctggttgcgctgggcactgccactgccatccagcgacggcagccggtcggccgaggtgccccgggccagggcccgggcctcgttcacccgctccaccgccagcagcaggtcgtcattggcgaccagcgcctcttcgaccagacgggtcagggcgggatcgccgaaattgcgccaccaggtgccgtcgacacgggcggcgggcagttccgcggcgcgcgcctcggcagcggcctggccgcgctcgccccagctggcgccggtctggatggccgggggatccccggccggggccagtgcacaggcggacatcagggctgcggccagtaccgcgacaaggggccgggccgcgacaaggggccgggccgcgcggcggggcagatcgccccggatcacgggtgccgcgaggctcgggtcagctacggacatgggcgctctccggagtttcggtcggggctgctgccttgtggcggtctttccgcgacagcttcgccgccagtgtatagaaggccggcacgaagaacatcgcgatgaaggtggccgccagcatgccgccgatgacgccggtgccgatcgagtgacggctggcagagccggcaccggtgctgatcgccagcggcacgacgcccaggatgaaggcgagagaggtcatcacgatcggccggaagcgcaggcgcgccgcctcgtccgccgcatcgatgatgctccgccccgcccggcgctgctgcatggcgaactccacgatcagaatggcgttcttcgccgacaggccgatcagggtaaccagaccgatctggaaatacacgtcgttctcgatgccgcgcagccagattgcgagcagcgcgcccagaaccgcgaagggcacggcggccaccaccgccagcggcatcgtccagcgttcatactgggcggccaggatcagcaccaccatcacgatgccgaagccgaaggcgagcatgctcgacccggcggccgccttttcctgataggccgagccggtccagctcagcgtatagccctcgggcaggctttccgccgccacctgctccatgatcgagagcgcctggcccgagctgaagcccggggcgggctggcccatgatcttggcgccggtgaacaggttgaagcgttccagcatgtcgggaccgacgatgcgcttcgccgtcaccagcacgtcgagcgggatcatttcgcccgaattggagcgcacgaagacatagcgcatatcgtccggcgtgcggcggaaatcgccttccgactgcaggttcacctggaaggtgcggccgaacagggtgaagtcgttgacatagaccgacccgaaggtcgcctgcatggtggtgtagacatcggcgatgggcacgcccagcgccttggccttctcgcggtcgacggccacgtcgtactgcggcaccgaggccgagaaggtggtcgacaggccggtcagttccggccgctgcgacgccgcctggatcaggccctgcacggcggcctgaaggtcggcgacggtgccaccggtgcggtcctggacataggcctcgaaaccgccggtcatgctgatgccctgaatgggcggcgggttgaaggccagcgtgaacgagttggggtcgctcatgccgatgcccatcatcgggccgggcaggttgcgggcatccagcgacggatcgttacgctggctccagtccttcagcggcaggaaataggcggcggcattggtcttctgggccgaggacagcaggtcgaagcccgacagcgtcaccacctcgttcaccgccggatgctgcatgaacttctcggtcaggcccagcgcactgtcctcggtccgcgacagcgacgccgccggcggcagataggtctgggcgatgatatagccctggtcctcgttcggcagcagagagcccgggatccgctggaacagcgtccaggacgcgaagcccaccgccgccagcaccagaatggccaggaaggcgcgcttcacgatcaccgacacgccatagacatagccgcgggtcaggcgatcgaaattgcggttgaaccagcggaagaaggcccagggcttgtgctcgccctctttcagcagcagggcgcagagcgccggcgacagggtcagcgccacgatgcccgagatgaacaccgacatcgcgatggtgatggcgaactgcttgtacatctggccggtcaggccgcccaggaagcccacgggcacgaacaccgcgcacagcaccagcacgatcgcgatgaccgcgcccgacacttcctgcatcgcctggatggcggcttcgcgcgggtgcaggcccttttcgcgcatcacgcgttccacattctccagcacgacgatggcgtcgtcgaccacgataccgatggccagcaccatgccgaaaagtgtgagcagattgatcgagaagcccagcagatacatgccggcgaaggtgccgatcagcgacaccggcaccgcgatgatcgggatcagcgtcgcgcggaagctctgcaggaacaggaacaccaccacgatcaccagcgcgatcgcctcggcgaaggtcttgataacctcctcgatcgacacctggacgaatttggtcgtgtcatagggcagcgcgtaggtgatgccttcgggaaaacgctccgacagctcgctcatccgcgtgctgattgcctgggcggtcgacagcgcattggcgcccggctgcagatagatgccgatcgcgaccgagggctgaccattgtaataggactggaacgcgtagtccttggcgcccagctccacccgcgccacatcgcgcagccggagcacggcaccgttggaatccgagcgcaggatgatgttgccgaaggcctcggcatccggcagccggccgggggtctggacggtataggtgaaggcctggccgccggcatccggctcctggccgaacttgccggccgcgaaattgtcgttctgctcttcgatggcgctggccacgtccgacggcgtcatgtcgtagcgggccagctcatccggcttcagccagatgcgcatcgaatagtccttggcgccgaacagcgtggcatcacccacgcccggcacgcgcttcagctcgtcgatcacgttcagcagggcgtaattgctgacatagatcgggtcgtagcggtcgaccggggcctgcatggtcaccacctgcaggatcgaagacgaccgcttttccacgcgcacgccctgctggcgcaccgtctcgggcagcagcggctcggccgcctgcacgcggttgttgatgttgatggtcgcctggtcgggatcggtgccgatctcgaaggtgacggtgatttccagcgagcccgcagccgaggcgttggaggtcatgtagagcatgccctcgacgccgttgatctcctgctcgatgggggacgccaccgattccgccagcacctccgggctcgcacccggatagctcgcgctcaccaccacctgcggcggcacgatttcgggatactgctcgatcggcagggcgcgcatggccatgaaaccggccagcacgatcacgatcgagatgaccgccgcaaagaccggccggtcgatgaagaagcgcgagatcatgcaccaccctccgggcgtgccggggcggcatcaccgcccttggcgacctgcaccggggcacccgggcggaccttgatcgtgccgccgacgatgacgtcgtcacccgaggccaggccctgttcgaccacccagtccttgccgacggtcgggcccagcaccaccggccgcacgccggccttgccgccctcttccacgacatagacgaaggtgccgttcgggccctgctgcacggcttcctgcggcacggcgatggcattgggcagggtgaggccctgcagcgacacccgcacgaactggccgggcatcagggtctcgtcggggttcgccacctcggcgcgcagccggacggtgccggtggccgggtcgatggtgctgtcggcaaagttcacctcgccgcgcaccacctcgtcacgcccctcgaccttgaccgccacgtcgagcttctgctcggtcgcaggcgtcgaggccatcagccgcagctggcgctgacgctcgctgtcggggaccgagaagttaatgtagaccgggtcgagccgggtgatcgtggtcagcaggctgtcggtcgagccggtaccgaccaggctgccttccgacacttcctcgatgctggtcacgccgtcgatcggcgcccgcacctcggtataggcgaggttgatcttggcggtgtcgagccgcgcctcggccgaggccagagaggcgcgggccagatcgcgggccgacagcagctggtcgcgttccgacgcactgatcgcgttctgctggaacagcttcgacccgcgcgcccagtcgcgatcggccttggccagattggcgcgggcctcggcgaccgaggcctcggcttcggcgaccgccgccttgtaggtgtcggggtcgatgcggaacagcagatcgcccgcctcgacgcgtgcgccctcgacataggtccgctccagcagaatgccctggacgcgggcgcgaacctcgaccgatttcgacccggccacacggccggcatattcataggacaatggcagattgcgcggcgtcgcctcgacgacgctcacctgtgccggcggcatctgcccgccctgctgctgcgccggcgcattggattccgccgcatcacacgctgcaagggcgagggcggcgatcgtcgacagaacgacagcggggccggcgcgtctgtcgcgccgcccgaaacggtaccggaccatggatcttcctcaattcctgtcgagacccgccgcctgccgctcccccggggggcgggctgccgccgcggcctgggtcttccgccctcacaaaagggtgtggcacgaagggggtggaggcgagtgcactgcacaagtaatatacgtgcatgaatgtatgtaaagtgacgtccatcacggcattcgccgccggatccgttatttttgcggaaacgtgctatatgcgccccgggcgcaaaccgcgcggggcgagccggggcgtccctgatcaccccctgcctgaggaagccgagaccgatcgtggccagacgcaccaaggaagatgccgaaaagacccgccagcagatcctggatgctgcggcggccgccttcgatgccgaaggtgtggccgcctgcgccctggaacatgtggcgcgtctggccggcgtcacccgcggggcgatctactggcatttcaagaacaagtccgacctgctcgacgccatgctcgaacgggtgcgcctgccccaggaacaggtgatggaggatctggccgccggccggatcaccgaccggcggccgctcgacctcttccatgaaacgagccgcgacgccctcagcatgatcgtaaacgacgagcgccgccgcctggtcttccggatcatcttcacccgcatcgatcaggcgcatgaacagtcgcccctgcatgaacgccagcaggccgaccgggtgcatttcatgacgctgatacgccagatcatggcccgggccgccgaggccggcgacctcgcccccggctggacgcccgagaccgccatgcgggtcgcccatgccatgttccacggcgcggtgtcggacatgctggtgctcgacgaagcccggctcgcggacgaactcgccctctacctcgacgccgccgacaccctgatgcacaccctcggcagccgctacgacccccgcctcaacgacggccagggctgcctgctgcggccggcgctgccggtgggtgaggggtgatccccagccgctgaggggcgctatgcccgtctgacaccgggcatagccggcgggaatgacgtgacccggcaactgccgctgctacaccacggggcgggacggctccagctgacgcgccgaggtctggctggcgtgaagctggtggtgtctgacgcacatgaaggcatcaaagccgcggtgaccagcgtgttttcgggcaacatggcagcgctgccgggtccacttcatgcgcaatgccctcgcccatgccggcaagcagggccgccgggtcgtttcggctttcattaccacggccttcgcccggaatgatgccggcgctaccagggcacagtggcgtcaggtcgccgatcagatccggcccaaagttccaaaactggcggtattgctggacgaggtcgaaaaggacgtgctcgcctgcatgacatttccgaagaaccattgggccaggctgcacagcaccaatcccatcgagcgcctgaacgacgagatcaagcgccggaccgaggtcgtcggcacctttcccggcgaggccgccatcacaaagctcatcggtgccattctcctggagcagaatgatgagtgggctatttagcgtaaccgatacatgacccttgagaccatcgcttctctcggcgatgatccacacatcatgcttcccgtcgtcgcagcatgagacagccggccagacatgccggaaacttcgacgctatggcgcgagctaaatcacggggtggggcacgatcgggaggctggttcatgagttcgcagtcgccaagcacacggctgaaagcagaggaagagccgcgcgaggctatcttcatcagtcacgctgcaccggaggacaatgcgttcacactctggctgggcgccaagcttgccgccatgggctacgaagtctgggccgacgtgctcaagctcaggggtggtgacgactggcaacgcaagctcgaaaacgcgctgcgccaccgcgcctgcaagatgctgctcgtcgccaacccccgggcggtcgacaagcagggcgtgcgcaacgaaattcagattgcttcagatgtcgcgcacaagctcggcgacgctgccttcataatccctctgcgtatggagccattcgaggcccccttcctgatcgcacatgctcaatacatcgacttcacccgcggctgggcgcacgggctttcggagctgttagagacgctgcaagaaacctatcgtgtcccgcgcaatcccgcgggtgaggagaagaactggcgcgaaatccaactcattcacggcaagacgcttgtcaccgaacccgagcggctgatctcgaactggctctcgatcgatcaactgccgacaaagatccgctactacgagttcaaggggcaggtgtccgagcgtcgagcccaggaacggatgagggaagcgccatggccattaaagcggtttcgcctgggcttcctcactttcgcgcccatccacgatctgcaagaccatttcggaccgaaccttccgatcaggccgaaagaggagcgtcgcgtcgcggactttctggaaagcggttggtccgagctcgatatcgtacggctcgacgcccgcaaccatttcagcgatctcgcccgccaggcgtttgaaaagctgttcgctgagcgcggccttcgccactacgcgctgtcaggtacccagtcggcatggtggcctcctgtccatatcgcgccgacgacgaagattggcttccgctggggggatgtcgccggtctgcgccagatccaaggcgtatcgcacaagcggcagatgaactggcatttcgctgtgagcgtcgccgcgcgctcggcgcctgtgccccatattcggatcgtcagccgccttgtctttacagaagatggcgacaagcccttcgacgatcttgcgaaaatgcataggctcaggcgctcctttgccaaaacctggcgcaacgcccgctggcgcgacatgctcctcgccttcctgcattggcttgccgaagggcaggactcgctctctgtgcccgtcacttccgaagaaggcgttgttctcggattgccgccgatgtcctgggaggtgccagtcagcctgcctgtcgaggatgaggcgcctgagcctgatgatgacgatcccagcgacgacgacgagccggacgaatccgacagtcccagcgcggtcggtggcccggaggaggcaggcgatgacgtctagaccgcaaccattcacgcctcggatgctgtatcttgaggaaccgcggttggaattccgtcacgggcagcgcctcgtctatccccgtgatggtctttatctctacggacctgtcggggatacaaaggaattgccgaccatccgctatggggtgatcggtacaccggacggcgtgcgccgcttcaagggctgggcaaagaccatggagggcttcatcgacatcccggccccggggccgcggtcgcgagccgtcgaaccccagcatgtgcctttccctggcttcgccgaagccttccatgccgcctggccggtcgaaccgccctgtgtcattgacaatcttgaccccgacgagatcgagagaactcttcggatcgccaaccgccatgaggccgtgcgcggtactgtagatatatttgtatcccgcctcgtcgcggagaacaaccggctagagagtgcgccgcaattctggttcgtcgtgattcccgaaaaggtctacgaactcggccggccgaaatcgacggtaagacgcaatgatcgggtcgccggtgcggtgaccatctcgcaacgccgtgctcgggcgttgcaaagccaacccaccctgtttggcgacgatgagcgcgaagctcaggtctatcaatatgcaacgcatttccgtcgacagttgaaggcgcgcctcctcaaggagcggatcgtcacgcaaatcgtgcgcgaaacgaccttggcgccaggcgatttccgccgcgagagcggaatgcctatccgccgcgtcgaagatccggcaacgatcgcctggaagcttggcacgggcgcctattacaaggcaggcggaaaaccatggcagctggccgacgttcgccccggcgtgtgctatgtcggtctcgtctacaagcgcagcgaattgacaagtgacaggcggcatgcctgctgtgcagcgcagatgttcttgtcggatggcgagggcgtcgtgtttcgcggtgcgctcggtccctggttccagaccgacacgaaacaattccacctcgatagagacgccgcccataacctcataaagatggtggtgggcgagtacgctcgtttgcatgacggcccgcccaccgaactcttcatccacgcaaagtccgccttcacggatgacgagtggggaggcttctcatccgcttgtggagagaaaacgaacctcgttggcgtgcagatcggcgacgcccacgatgatttgaaactctaccggcccggcgaatatcccgttatccgtggcacggcactccagatcggagaacgccacgcgctgctctggacgtccggttacgttccgcgcctcgacacctatatgggaccagagaccccaaatccggtctccgtgcgcgttcttcggggcgattgcgctttgacgactgtactctccgacgtgctcggcctcaccaaaatcaacttcaattcgtgccttcacaacgaccggttgccggtgacaatccggttcgccaacgccgtgggcgatgtcctgatctccgcgccgatggatggagaaccgaagctgccgtttaaattctacatctagtgccgcatgtcagcgccaagttgatgacgtgacagaaccgagaacaaaagatggctttcgtcacacaggcccgcctttcggggtgccgtcccaccgtggtgtagcagtacggtcacctgggcacatcttccaaccggctatgccggcctacaggtttgacccgccgagcggtcatcatggttcttcggtaaagcttggtcaccacaacaaaacccaaccgagggtgaccccgatgacgaacgcgatgatggcactgcacggcttttacgcccgttaaaacggtcatatcgtgccgacgcacccggcggatgtcaatccaccgccggtagccggcgcgccgcagacacgcaaaaggcggccccccctcacggagatgccgccttccgtcgtcaggccgcccgccgctgatcgtggcgggcgctgccgtcgtcacatattgggatagttcgggccgcccgcgccctcgggcacggtccagacgatgttctgggtcgggtccttgatgtcgcaagtcttgcagtgcacgcagttctgcgcgttgatctgcagccgcgggccggcgtcttcctgcacgatctcgtagacgccggccgggcaatagcgctgctcgggggcgtcatacgtgggcaggttcaccgtcaccggcaccgacggatccttcagccgcagatggatcggctgatcctcctcgtgattggtgttcgacaggaacaccgaggacagcttgtcgaagctgatctttccgtcgggcttgggatagacgatcttcttacaggccgaggccggcttcagcgacttgtggtcttcgtggtggtggaaggtccagggcgcattgccgcggaacagataggtgtccagcgccgaataggcgaggccggccagcaggcccctgttgaaggaggggcggatgttccgcaccttcttcagctcctgatgcacccagctctgttcatagagcgccggataggcgtcgagcacgtcgttcgcccggccgtccttcagcgcctcgaaggcggcttcggcggccagcatgccggtcttcatcgccgtgtggctgcccttgaccttgggcacgttcatgaagccggccgtgcagccgatcagcacgccgcccgggaaggccagctgcgggaccgactggaagccgccctcggtcagcgcgcgggcgccataggcgatgcgcttggcgccttcgaaatagtcgcgcagtgccgggtgctgcttcagccgctggaactcgtcgaagggcgagatatgcgggttctgatagtcgaggccgatcaccaggccgacggcgacctggttgttctccatatgatagaggaacgaccccgaataggtcttggtatccagcggccagccgatggtgtggatgaccaggcccggcttgtgcttggccgggtcgatctcccacagctccttgatgccgatgccataggtctgcgggtcgcaattgtcgcgcaggccgaacttgtcggtcagcatgcgggtcagcgagccgcgggcgccctcggcgaacagcgtatacttcgcgtgcagctcgacacccggggtgtagcccgacttctgctcgccgtcgcggccgatgcccagatcgccggtggcaacgcccttcacccggccctgctcgtcatacagcacctcggccgccgcgaagccgggatagacctcgacctccagcgcctcggcctgctccgccagccagcgggccagattgcccaggctgatgacgtagttgccgtgattgttcatctgcggcggcgtcggcagccggatatggttggactccgtcagcagcaggaaccgatcctcgtcggccggctggttcaggggcgcgcccttctccttccagtcggggatcagttcgttgagcgcccgcggctcgaagcaggcgccggccaggatatgcgcaccgacctccgaccctttttcgatgacgcagacggagacctcgtggtcgttctcggcggcgagctgtttgagacggatcgccgctgacagaccggccgggccggcgccaacgatgaccacgtcgaattccatcacttcccgttccatgacccctcctcaagccgcctcgtcctgcagtgcggccgggtgatctcgttctcgctcgtcacgcggcgccgctcgcgtccccctcgctacgttcggccctcgctcctcggatatggacccgatccgtgcccgtgacaggggtcgcctgatacgagacgcgaatcgcgattcagtaaggttatctatcagcgccgccgtgaaattgctacagtccaggccatgacgacgatcgatccgacaccggcagcggccatctccgcactcgccacgtggtatatggagtggggggtagagaccgccaccaccgataccccggccgactggtatgccgccgccgcggccgcccgggaaaggctgctgcgcgaccggcccagggtggccgaggatgccccggcgcgggcaggcgaagggctgcgtgcgcgtggcgcgctgctgcgtgacggcagggcgccggcgcctgccgtgccgcgggcggacccggcggccgtcgacccgctctcgcccgaaggggcggccgcacttgcccgcagccatgcgggggccgcccaaaacctggcggagctggaacaggcgatccgcgccttcgaaggctgtgcgctcaaggccacggcctcgaacaccgtcttcgccgacggcaaccccgaagccgatctcatgctggtgggcgaggcgccgggtgcggaagaggaccggcgcggcctgcccttcgtcggccagtcgggccgactgctcgaccggatgctgaaggcgatcggccgcgaccgcagcaccgtctatatcaccaatgttctgccctggcgcccgccgggcaaccgcacccccaccccggcggaaatcgccgcctgcctgccctttgccctgcgacatatcgccctggtccgcccgaagctggtcgtggcggtgggcggggtctccgccaaggcgctactcgaccggcccgagggcatcacccggctgcgcggacgctcggcaaccctcgatcttccggggctggcggggcctctgccggtcttcgcgaccttccaccccgcctacctgctgcgccagccggcgcagaagcgtctggcctggggcgactggctcagaatcgcggaaatccttgaaaagcaatcatccccggttccgtgacaatgtcgtgtcgcgaagcgggggcttgccgggacaccacatcctcccctataaacgttgccatcatggcttcggaaagcaacgacgcgcgtcaccaaccgcggtcggcacgtagcttcgcgcgtgcgatcgtggcgcctgcggtgacgctggccctcttgctcggcggtcctgtcgcaacgggtgtgttcatcacacgcgcgcatgcagagacctccctgccgaccggcctggagacggcggatgacgccgacttcggaatggctggattcggtctggtcgattcgttcgaagagtggccccaggtcctctctgatgcggatgccgagcgttatgcccggatttttgcactgcagtccgacggccgcttcgacgaggcggacaggctgatcgcgcggcttggcgaccggctgctgatgggccatgtgaccgaacagcgactgatgcatccgacggcctataccgcgagctacgacgagctgcgggactggatggcgttctatggcgaccaccccgatgccgaacggatctatgcgctggcgatgaagcgtcgcccgggcggcgaggcccgcccgcgcgagccggagcgtccggaagagaccgcgatgccggtggtcagccgccagcccagcaccatcgaccagctcgacagctattccgccgccgaccggctgaagggggcgcaggccaagcgtgcgcgtgcgctcgaagcccagatcgccgcccgtgtccgcaagggcgaggccgaagccgccgaaaagctgatcggctcggccgaggttcagaagctcttcgaccgcccggcgctcgaccaggcgcgcatccgcgtcgcctcgctgctgctgatgcaggggcagatcgcccgcgcctatgaactggccggccccgccgccgaccgttcggccgcgatcgtgccctatggccactggaccgcgggtctcgcggcctggaagctcggccgtgccgaaaccgcgcggcggcatttcgaactcttcgcccgcaccgccggcctctcggcctggaacgaggccgccggcgccttctgggcagcgcggaccaacatggcgctgggcgatttcgacaccgcgcagacctggctcgaccgggcggcccggcagccgctgaccttctatggccagatcgcgcgggcgatgctgggcgcgcccaccggcgatgtctggcagccctcgctcgccggcggcgtgacgccgggcctgcgccgggcgctgctgcagaacgagggggcccgccgggcgctggccctttcccagatcggcgaatacgaccgtgccgcgggcgaggtggagctggtcgcggccgcagccgcccccgaagaggcgccggccgtggtcgaactggccgagcaggtgaacgcgcccgaggccgccaccgtgatcggccgcaaggtcgccgccgcctcgggcatgcccgatgtcgcctcgatctttccggtgccggactacacgccccgcggcggcttctcggtcgaccgggcgctgctctatgcgctggcccgcaaggaaagcaatttcaacccgcatgccgtcagccccgcgggcgcccgcggcctgatgcagctgatgccgggcacggcgcagctggtggccaacagcctggggctgggcggcgggctgtcgctcaaccggccggacgtgaacctgcagctgggccaggcctatctccgccggctgatggacgagccctatatcggcaacaatctggtcaatgtgctggtcgcctataatgccggcccgggcaatctgcgccgctggcaggacggccgcggcatctctgccgacgatgatccgctgttcttcgtggaaaccatcccggtcgccgagacccgcgacttccttgagcaggtgctgaccaatctctggatctatcgcaaccgtctgggccagacctcgccgtcgctggcggccctggcggagggcgactggccgtcttacgagaccatcgacggcaatgttggcagcgacaacgccgccatcgcctcgcgccgctgatccacaacagctccgggggccgggcgtcgagccggtgtcgttcagagggacggcgccggtttttcattggccgggccgcaatttgcgaagcaccgccctgcaggcatcgcacttgccttcacagccggcccgggcgtagtttgcaaacgactcgcaattgcaaaccacaaacggccggtgccacatgctgcgatgtgcgccggtcctcgctcgaggcagtgcccacccgatgcgccacacggctttcagacacctcaccgccgccatcctgcttgcgatgacggcaacggccccggcgatggcccaaagccctgtgacggacccgggctctgcgacgaatccgggccctgcgacgaatccgggcatccaggccgcaccgcagccggtcaccggagaggccctgccagccgctgaagacgcggcgaccgaagagacggcaatcgaagaagacgccgcgatggccgccaccctgccccacgacctgtcgccgatcggcatgttcatggccgccgacatcgtggtgaaggcggtgatgaccgggcttgccctcgcctccatcgccacctggacggtctggctggtgaaaagcctggagctggccgccgcccgccgccgggtccggcgcgatctggcgatgctcgacgaggcgcgcagcctggccgaagccgtgaccggcatggacgggcagcgcggccccgccgccgccctggtccgcgcggcggtggccgagacccgcatcacccgcgaggtgaccgccggccgcccgcccgcatccggtgccggccttgaatcccgcgtcgcctcgcgccttgcccgcatcgaggcccgggcggggcggatgatcgcccgcggcaccggcatcctggcgaccatcggctccaccgcccccttcgtcggcctgttcggcacggtctggggcatcatgaacagcttcatcggcatcagcgaaagccagaccaccaacctggccgtggtcgcccccggcatcgccgaggcgctgctcgccaccgccatcggcctggtggccgcgatcccggcggtgatcatctacaacatcttcgcccgcgccatcaccggctaccgcgccgagctggccgacgcctcggcggccgtcgcgcgcctggtgtcgcgcgatctggaccgcggcggcatcgcggtggtgcccgcccagacgatcggaggctgaccccatggccgcgagattggacgacggcgacgatctgaccgaatcgcacgagatcaacgtcacgcccttcatcgacgtgatgctggtgctgctgatcatcttcatggtcgcagccccgctggccaccgtcgacgtgccggtcaacctgcccacctccacggccacgccgcagccgcgccccgccaagccggtcttcctgaccatcaagcaggatctgagcctggcgctcggcgaagaggccgtgccgcgcgatcagctgaaggccgcactcgacaaggcgacgcagaacaaccccgacgagcgcatcctgctccgcgccgatcagagcgtcgattacggccagctgatgggggtgatgaacgagctgcggaccgccggctatctcaagatcggcctggtcggccttgaatccgccaccgccgcggccgcggccgccgggcagcagcaggccgccgccagatgagcgccggcgccgacatgctgcacggccccggcgcgatgcgctggggggccgccgggctggtgatcctggcgctgcacggcggcgccctgctggtcgcggccgccccctgggagatgaccccgccgccgccgctgccggaagcggcggtgatgatcgatctcgccccgctgccggccgcaccgccctcgcccgcccccaccccgccgcaggaggccgcccccgatccggcgccggcccccgagcccgaggtggtggagcccgacctgcccgatctgccgccgccaccgcccgtgccggtgccggacccggaacccctgcaggtcgcaccgaagcccaagcccaagcccaagccgccggcaccgcccaagccccgggtccagaccccgcccaagcccgtgccgcccaaggtgcagaagccggtagagcagccgcccgaaaccgtgcccgagaacgcgaccgcccaggcatcgggcgccccggccgcaccgacacagtcgtcggccccggccggtccgcccacgcccgcagcgcctgcctcgtacatgaccaccgatgccgcgcgcagctggcaggcggagatgttcgcccatctggaacgccatcgccgctatccgcgccaggcccagctgcgcaaccagcagggccaggtgacgctgcgcttcagcatcgaccgcgagggccatgtgctcgcctcgtcgatcgagcgcccgtctggcaatgcgctcttcgaccgcgagaccctggcgatgatgaagcgcgccgatccgctgccgccgccgcccgacgacatcccgtcgacggaactcaccttcgtggtgcccgtcatcttctctctgcgctgagcgccgtcctggacctccgcccccggtcgggctagccttctcggcccacccgaccaccggcggaggaccgacccccatgcccggccgcatcgacgagagccgcccgtttctggccgtcaacatcgccctgctgacggtctccgacagccgcacgcccaagaccgacacctccggcgacctgctcgccggccgcatcgcagaggccggccacaacctcgccgcccggctgatcctgcccgatgacgaagaccgtctggccgcacaattcgccgcctgggccgcagatcccgaaatcgacgtcgtgatctcgaccggcggcaccggcgtcaccggccgcgacgtcaccccggaagccctgcgccgggtgatcgagaagccgatcgagggcttcggcgagctgttccgctggctgtccttcgccaagatcggcacctcgacggtccagtcccgcgccctcgccggcgtggcgaaaggcacctatttcttcgccgtgcccggctccacctcggcctgccgcgatgcctgggacgagatcctggtcctgcagctcgacaaccgtcaccgcccgtgcaatttcgtcgagctgatgccgcggctgcgcgaacacgaagcctgatcgcgggcttcacagccgggcattgcccccgtatagtgcagcgatgttcccgttatgttcgcggggaggtcgcccatggaccccttcaaacccctgacccgacggcccggccagcgccaggccgaggccgatcgtgcggccgccgcggcacggctcggtctcgacccgcatcgcggccggggtgccgtcagcaatcgcgacggccgcttcgaacgtttcagccaccaggccgccgatgacggctggggccgtcccgaggcggaggacgcttccgacgcggaggccacgtcgaaggcgccggccggcgcgcgccgcagaaccgaactgcgcggcgtggtcgcgcgcacggctcttgcccgcaacgacagccccgacatccccttcgatgcctcgatcaacccctatcggggctgcgagcacggctgcatctactgctatgcccggccgagccatgcctatctcggcctctcgcccgggctcgatttcgaaacggtgatcgaggtgaagcgcggcctggccgaggcgctgatccgcgacctgtcgaagcccggctatgttccgtccacgatcaccatcggcggcaataccgacccgtatcagccggccgaaaagaccgaggggttgaccagggcggcgatcgaggtgctgacccggcatcgccaccccttcgcgatcatcaccaaatcggcgctggtgctgcgcgatctggacctgatcgcgccggccgccgccgcgggacttgcccaggtggccgtctcggtcaccacgctggatgccggcctcgcccgcgccatggaaccccgcgccgccacccccggccggcggatcgacgcgatccgcggcctggccgcagccggcgtaccggtgaccgtgatggcggcaccgctggtccccggcctcaccgatcacgaattggagggcattctcgccgccgcggcagaggcgggcgcggtgcgcgccggctggatcatgctgcgcttgccgcgggaaatcgccggcctgttcgaggaatggctgcgcctggaacgcccggcccgggccgaacgggttctggccgccgtacgcgccacccgcggcggtgcgctctatgacagcggcttcggccggcggatgaccggcaccggcatcgaggcgaagctgatcgccgaccgcttccgcctcgcctgccgcaagcttggcctcaaccaacgctcctacaaactcaccaccgccctgttcaccccaccggcccgccccacaaaagcggagcgtgcgggccagatggatctgttcgggcgggggtaagcgcgcgtcactgcggccggtctgccgcccgccagaccgccatctgccggctgcggaagggctggacatagacggggggccagccgggtgcgccccgggcatcgatgcgtccggcgatgatgccgccggggttgtccgacgcccagcgggtgatgtcgccatcggcggggaattcggtcaccggcgccgtcagccggccctggaaatcgagcatgccgtcatggctgccgccgacgaacaccaccggcccgccatccgcggccaccagccgggcgacctcctgcgccgccggccggatgtcgaaggcccggaaggggccgagcccgccatagacggtcagcatcaccagcacgcccacccaggcaagcgccgcccgcttcagcgccgcggccgggtcgagatcgggcgaggcgtagatcgccgccgccaccaccgccagccccgccaccagcgccaccgccagcggcccccaggcgatgacggtcccggacataccggccagccgccccaccacaggcggcagggcggcaatgatgcccgccaccacaaccagggccgccggcagcagccaggtccggcgcagccagcggttcagcggccgcatcggcgcgccgtcggccatgcgggccagcagcagcgccaccggccccagcgccggcagcagataatggatctgcttggcgctgacgaagctcatcgtgaggaaggcgccggcggcgaccaccaggcacaggcggctgccggcatcgggccggcccaggctggcgcgcagccggcgccagaaggccggcaccaccaggaagggcagcagcatcgcgggcaggatcgccggatagaaccaccagggccgggcatggtcgaaagcctgcaccacccggccggcggtctggccccacagcagcatgcgcgcgaattcaggcccgcccgccagcgccgccggcagggcccagcccaggatcaggacgatgccgatcgccacggcccccagcccctgcagggcgaagcgcttccagccatgcggcggcacccggcccgcccagagcggggccgcgatcagcgccggcagcacgaacaccgccgccaccggccccttggccagcaggccgatgcccagccccagaccggtcaccaccatgtcccgcggcaggccgcgatgggccagatcatgcaggccgatcagggcgatcgtcacccccagcgccaccggcacgtcgaacatcaccatggtggcgaacagcgtgaccggccccatgcccaccagcagcggcagggcaagcggtgccacccccggccgttcgggccacagccggcggcccagcgcatgggtcgcccacagcagaccggcggcaaaccccaccggcaccagccgtgcggcggtttccgacacgcccgccaccgcccagaccaggcggatcgcccagaacagcagcggcggcttgtgggtatagccctggccgtccagatgcggcaccagcaggttgccggcgcgggtcatgtcccaggcaaccgtcagatagcgggtctcgtccaccggcagcggcgggcggaacagaatggcggtcacgcccagcaccagcagcatggccgccgccagcgcaagatcggccgcagccgtccgggccagacccggacgggcggcatgttccgtcgtggtggtggtcatccggccgataccgcgatatcggccggctggcgcgacgcagccgcttccttgcggatcagcaccagattgcgcagatagacaagcagccccatgccctggccggcgatgaacaccgggtcaccccgcttcaccgcataaacgaacagcagcgccccgccgcccaggctgaaataccagaacaacaccgggatatagctgcgccggcgccgttcactcgccacccactgcacgatgaaccgcgcggaaaacagcgcctggccggcgaagcccacaatcagccacaggtcgaaccagtcatccgaaggggtgatggcatcaaggattgcgccaagcagggtcatgctgcggcttctccgctgctgatcgccgcccgggatgccgccggttcggcggccgcagacggcttctgaagggcaaacccggccggcccggcagacaggggggccatggcagacggggcaggcatggccagcgcgcggccgatcgggtccaacggccgcagccggtgctgcagccaggcgaccccggccagatccacgatgccctgcagggcgcgggtcagggtgcggtatttggaccgcccgccccggcggcggcgatccgtcacctctaccgacacgacccggccgccggcggcggtcaccaggctcggcatgaaacgatgggcatggtcgaacagcggcagcgacagcaggtcgtcgcgcgcaatcacccgcagcccgcagccgctgtcgggggtgccgtcctgcagcacccggctgcggatgccgttggcgacccgcgacaccagcttgcgccaggcgccatccgcccggcccttgcggtggccggccaccatcaccccgcgcgcgggcccgcccgcctcgatcatccagcgccggatcagccgggcaagatcggccgggtcgttctggccgtcggcatccagcgtggcgatcacccgcccgcgcgccgcacgaaacccggtggtcatggccgcactctggccgcggccgcgatcatgggcgatcgcgaccagccgcggatcggccgaggccgcagcggccagcagacggtcggacccgtcgctgctgccatcgtcgacggcgatgatctcgtagccgccggccaggatgtccggcgtcgcgaaggcccggtgaatctcggcgatcaggggcaggatggcggccgcctcgtcgcggaccggcagcaccaggctgatcagcggagcggcggaaaccggattacggctggggagcatggctgggcctcgctcgctatgggttcggatcgatgccggcacggcatcctggtccgcatgaccctaggcttgtgcccttaccctgtgcttacaccaccctgtgcttacaccacccctccttgtcttgcgcccccctccttgtcttgcgccgcccgactcatccccggccgggtggcgggaagcgcaggcggaaccgcgccccgccttcgggtgcatcctcgacggtgatcccggcgccatgggcatcggcgatgcgctgcacgatcgcaagccccagcccggcgccgtcgccgcgccgccggtcggcccgccagaaacgttcgaagatccgggcccggcgatcgggcggaatgccggggccgttgtcgtccaccagcagctccggcccttcggcatcgccggtcggcgccggcaccagtcggacggtgacggtgccgtcttcggggatacaggccagcgcgttttccaccagattgcgcagcagccgggccagcggttcggccctgccctgcaccggcaccggccgctcggcaccatccagcgccaggctgcggccacgctgcacggccagcggcgccagttcggccagcacgtcccgcgccaccgcggcaagatcggcccgatcccccggcgccaccgccagcgtgtcgacctcggccagccgcagcagctgatcggccagccgcgacagccggtcgaaatcgggggtgatccgcgccgcctgatcgcggggcagggtcgcctcgatccgcgccctcaaggccgcgatcggcgtgcgcagctcatgcgccgcatcggccacgaacacccgctgggtttccagcgccccatccagccggtccagcgcgccatcgatcgcggcgaccaacggtgccacctcccgcggcaggtcgccaccctccgcgcccccgcccaggcgaaccccgctggtcgcgggtccgatcctggccgcactggcggacagccgtctcagcggcgccagtgccgatcggatcgtccagagcgtcaccccgatcagcacggcaaacgacccgatcacccaccaggcggcgttttccagaaactcttcgatcaggctgtcggccagcacgtccggatggtcgttgccctggcccacctgcaggatcagcggccggccgtcgacctgcacccggaaaccggtgccggtgaccgggcgcccggcggcctcgccgcggaagggccgccccagatcgcccagcccgtgcggatcggcatcggcggaggtgcggctgtcttcggccggcagcagctcgctcagcggcgcccgaaccccggccgagcccagcagaaaggtgccggcctcgtcgagcaacgcaaaggcctcgttgcccgccggatcggcataaagtgctgcgatcgcggccggcggatcgaaaaccggatcgcccccggccccgatggtcatgtaccgcagcacctggcgggcctgggtctgcagcgactggtcgtccagatcgccgcgaacatcctccagttccagcaccagcgccgccagcatggccgccagcaccaccagcgccgccagtgccgcgcggaccgcgaccctccggctcagcgaccagccgcgatcatacgcttcaggccccgccatcgacgccctctccgccgtccagcagatagccaagcccacgcaatgtgtggatgcgcacggccgatccggcgccctccagccgcttgcgcagccggtggaccagcacttccagcgtgttggcgcttgccgcgtcgtcgaagccatagaccgcggcttcggccgaatccttgggcaccacccggccctgccggcgcagcagcacctccagcagcgcggtttcgcgccggcccagcgccaccagccggccgccgacccgggtctcgcgcccgaccgtgtcgaacgacaggtcgccgcaggtgatcgccaggcccagcgccccgcccggccggcgcatcagcgcccggacccgcgccaccagttcgggcatggcgaagggtttgggcagatagtcgtccgccccgccatccagccccgccacccggtcctgaacgccgtcgcgcgcggtcaggatcagcaccggcacggcgatgccctgcccctgcccacgcccccgccagcggcgcaccagctccagcccgtcgacatcgggcaggcccagatccagcaccaccacgtcgaaactggtcacggccagcgccgcctcggcgccctcgccatcctccacccggtcgaccgcgaagccggccgcggtcagccccatcaccacgccttccgacaggcggtcatcgtcttcgaccagcagcacccgcatggcggttcccgcccctctccgccgtcagcccctcagccctcggccagccattcgtcgatcagccggcgggcgatcgaaatccggttgggcaggctgaccggcgacagttccgggtccttcagctcgtcgcgctgcacccagatcgcgtcttccagctcgtggcgatcgacgtccagcggcccgccttccagaatctcggcccggaagccgaccatcagcgaggccgggaacggccagggctggctgtggcgataggtcaccttcccgatcttcaggcccacctcttcggcgatctcgcgccggacgcattcctccaggctctcgcccggttcgacgaaccccgccagggtggaatacatgcccgccggaaagcgcggctggcggcccagcacgcaccagtcgtccttgtgcgccagcatgatcaccgccgggtcggtgcgcgggaaatgatcggcgccgcagccggtgcagtggcggacatgtcccccctgctccgaccgggtgggggcgccacagacgccgcagaaccggtggcggctgtgccaataggccatcgccctgccataggcgaccagggccgcctgctgcggatccagcgtcgcggccgcctggcgcagatcgatcgggatcgcggccgccgcctccatcgccgggtcgtccatgggcagacggccgatcagcccgggcagatcctccacccgggtcacgtccaccgcaaagaccggccggccgtccatgtcgcccagaaagaccggcgggtcttccagcaggtcgccggccgcatcgaccagccggcccagttcggccagcagcgccatggtcatgccgcccgccgtgggcgcgacgatggtctggtcgcgccagatcagcacgctgcgcgcttccggggcggcggcgcgggcggcgatccagtccggatcccgacggtgacgtccggcgcgatcgatgcgcaggccggcgagcacattggggcggtcgggatcatgcgggtcgtacatcggggtcgtcctcggactttggcggaacgttgcggctcttcacggcaatggcgggaacgatagcaccatcgcccggggctgtcccgccgccggcacgccgccgcatccgccggccccgcctcccgcggatgctgcacagcgggcttgcaaaccaggggcctcatccccatagtgacccgcggaaggctggcgcggacggagagcctcgccaacccggtcagggccggaaggcagcagccgtaacgagttgcgatccgggtcgctgtccagccttccacctcacttgccagccttccacctcgcttgtcttcgcctgcctgcttcgatccctcttccgggccgcgccgccctcttcccagagatcccgaccggaacccggcatgaccgcatccgacatcgccgcagagccagccccgaccgcagatgcggccggcggcgccacggcgacgggatcggctgcaacggggacacccgtcgaataccgcgttctcgcccgcaaataccgcccccgcacctttgccgagctgatcggccaggatgccctggtccgcacgctgaccaatgcgatcgagaccggccgcctggcccatgccttcctgttgaccggcgtgcgcggcgtgggcaagacctcgaccgcgcggatcatcgcccgggcgctgaactgcaccggccccgacggcagcggcgggccgacgcccgcaccctgcggggtgtgcgagaactgccggatgatcgtcgaagaccgccatgtcgacgtgctggagatggacgcggccagccgcaccggcgtcaacgacattcgcgagatcatcgagggcgtgcgctaccgcccggtgggcgcgcggttcaagatctacatcatcgacgaggtccacatgctctcgaccagcgcgttcaacgcgctgctcaagacgcttgaggaaccgccggcgcatgtgaaattcatcttcgccaccactgaattgcgcaaggtgccggtgacggtgctgtcgcgctgccagcgcttcgatctgaagcgggtcgagcccgaggtgctttccgcccatttctcccgcattgccgggatcgagggggcggagatcgacgacgcggccatggcgctgatcgcgcgggccgccgacggttcggtgcgtgacggcctctctctgctcgaccaggccatcgcccatggggcgggccgcgtcaccgaacatcaggtgcgcgacatgctgggcctggccgaccgggcgatcgtggtcgacctcttggaccggacattgtcgggcgatgtcgccggtgcgctcgcgatcatggacgatcaggcccgtgccggtgccgatccggcggtgatcgtggaagacatgctggcgctggtgcatctgatgacccgcgtcaagctggccggcgccgagggcaagggcccggtgctgaccgccgccgagcgtgatgccgctcaccgcattgcccagcgtctgggcatggctcatctgggccgcgcctggcagatgctgctcaagggtctgggagaggtgcgcctcgcccccgtgccccaggctgcggccgagatggtggtgatccgtctggcccatgccgccgacctgcccgacccggccgagcttgcccggatgctgaaggatgccgggacgggtggccccgcgggtggtggcccgggggggcccccgccccgccctagcccggccgccggggcgtctcaagcgccgaccccggcggcgccagaccggcgcccccccgaaccgccccgcgcggctcccccgccgccacgcccggctccgccgccccgtccggtggagacaccacgtccggtcgaggcagcgaaacccgcgccggctcctgcggccagggtgcccgcgcccaggcccgaaccggccgccgaacccgaacagctgctgcccgacgagatccgcacccggctcgatcgctggcgcgagatcatcgatctgctgcgccggcatcgcgagatccggatcgtgcccgagctgcgggccgccgcccatgtcgccgagatcaccgtcaccgcggccgagcgccggctggtgctggccttcgagccggggaccgatggcgggctcgccacgaaactgcaggatctgttgagtcggatcgacgataccccctggcaggtgctggcggccggcgccctcaacgatccggcgctcaccgccgccgcgcgggcgacgccgacgctggtgcagtacgacgagatgcgcaaccggcgcatgctggcgctggcccgccgccatccgatggtcgaggcggtgttcgcggccttccccggtgcgacgctcgaagccgtcaccccgatcttcgccgccggcgccgccgccgacgagagcggcggtcagaccgagatcgaacgcctggatgccgagatgttcgacggcgtcttcgacgaagaggcctatggggccggcgacgaggatgccgcgggggccgactacgacgcccggtttgccgatttctgaccgcgcatcgcccaagggtgccgcgcggggctggcgccggccgccccccgcctttatatagcagccaacatccgatcccgacccgaggagcccttgtgatgcgcaacatcggccagttgatgaagcaggcccagaagatgcagtcgaagatggccgagatgcaggagcagctcgccaaggtcgagatctccggccagtcgggcggcggcatggtcactgcggtgatgaccggcaagtccgagctgcgtagcctgaagatcgatcccaagctggtcgatccggaagaggtcgagatgctggaagacctgatcgtcgcggcggtgaacgacgcgaagaagaaggtcgagacctatgtgaacgacgagatgcagaagatgaccggcgggctgaacatccccggcatgggcaacctgcccttctgatcccgtcggcagacccatgaccgataccggcggggccgcctatgtcgagaccccgccgcccccggcccttggcgggctggtccgggcggtgtggtcgtcgcgggccgccgccgggcccgcggccccgttccgggttctgcctgatggctgcatggatctgatcctggcctggggtggcggcgccgatcccgaactcattctggccggcaccgatcccgtcgcccggatggtggaccaccggcccggccggcagcgtctgggcctgcgcttccgcccgggctgtctcggcgccctgatcgactgtaccccccgcgatcttctcggccagtcgcccgatgcggccccattgctgccgcagcccttgcgcgacgccgcccggcacctgcttgaccgccccgatgatgcccggtcccgccgggcactcgccgcagcactcgcgggcctggccgaaacccgccgccgccacctgcccggcccggcacttgcggccgcactcgcagcccttgacgccccggcgcttgtcggtcagacagccactgcccacggcttcggacagcgccgcttcgaccgcgccatccgccgcgccaccggcctctccccccgccacctcgcccggatcttccgcctgcagcggctgctcaccgccgtaatggccgatccgactatttctctcgcagaattagccgtttcggctaatttcgccgaccagccgcacatgacccgcgaaacccgcgccctcaccggcctctccaccggccggctgctggcggagctgggtgtccgaaagcttcaagacgccgcccccgtcctgggggcagactgatccggtatccaaccccggagagagcccatgacccccgccacgctcggctatgtcatccgccatgtccccgacgtcgcccgcagcgcccgcttctacgaagccgtcttcggcctcacggcccggctgatccatgaaagcggcagctatatcgaactcgacaccggcaccaccaccctcgccttcgcgaccccgggcctgatccgcaatctgggcgtcgaccccggcaccgccggcaaagccccgcccttcggcagcgaactggccttcgtggtcgccgatgccgaggtggaggccaccgtcgcccgtgccgtctcgtccggcgccacgctcgccgtcgcccccgtccgccagccctggggccagctggtcgccttcctccacgaccccgacggcctgctgatcgaggtctgcggcccggtgggcggctgaaccagccgggcgaacaggcatgacacgcacggataaaaccctttattctgaaaggctgtttgctttctggagcctgtgtcatgcctgtcgtggccgacgcgtcgatggccgatctcatgcccgcgcctggtgtagcgccggactggatcgcgcttgagtccgagctgccctggctgaacgacctcgccggctgcccgcacgatcccgttcatcatgccgagggggatgtgctggttcacacccgcatggtggtagaggcgctgacggcatccgacgcctgggcacggctgcccgagatggaccgtctctgcgtcttcgcagccgccctgctccacgacatcgccaagcctgcaaccacccgcatcgatgccgatggccgggtgtcgcagccaggccattcccgcaagggcgcgatcatggcccgggcgatcctctggcggatggggctgcctttcgccctccgcgagcggatctgcaccctgatcctgcaccaccagatcccgcttttcctgatcgagaaggacccgctggaagcgcggcggcgggcgatcgagatcagcctcggcgccccgaaccatctgctggcgatgctggccgaggccgatgcccggggccggatctgccgcaacccgcagcgcctgctcgacaatatcgagctgttccgcgagctgtgcaccgaggccgcctgccttgagaccgccttcgcctttccggacgaccacagccgggtgcggttcttcgaaacccgcggcaccgatccgggacatgtccagcacgacgatacccggctgacggtaacgatgcttgccggcctgcccggcgcgggcaagacgagctggctgaagcgcgcccggccggaactgccggtcgtggggctggacgagatccgcaccggcttcggcgtcgatcacggcgagatcgagggccgggttctgcaggaagcgaaagcccgggcgaaggctcatctgcgggccggcaccgatttcgcctggagcggcaccaatatcggccgcgaggcccgcggccagtggatcggcctgttccgcgcctatggtgcgcgggtgcgcatcgtctatgtcgaaaccgacgagcccgggctgcgccacggcaaccgcaggcgggccggccgggtccccgatccggtgatcgaccggatgatcagccgctgggaaatcccggatcggaccgaagcgcacgaaatcgcggtggtgctgcgctgagccgcgacagacgcacagtctgcccgccagatgtcatgacattcatgccgcccagccatccatctgccgggcttgtacggcagccgtggccgcccgacatgtcaggggcgggacaggccggaaccggcccatgtcccggcggatttcccctccagacccggaacacggagcccgagcatcatgccgaagaaaacgcccgccgccgacctcgccaccccgtccgatctcggcggcaagaatgcccgcggagtggccgaggtgctgaacgccattctggccgacagcttcgcgctctacctcaagaccaagaatttccactggcacgtgtcgggcccgcatttccgggactatcacctgctgctcgacgagcaggcgacccagatcctgggcaccaccgaccagatcgccgagcgggtccgcaagatcggccacaccacgctgcgctcgatcggccacatctcgaaactgcagtcgatcaaggacaacgacgccgagttcgtatcggcccgcgacatgctgacggagctgcgcgaggacaatctggccctggtgaagcagctgcgcgaggctaaggagatcgtcgacgaagccaaggacaacgccacctccggcatcctggacgagtggaccgatcttgccgagcagcgcgcctggttcctgttcgaggccgcgcgcgagggctgaacccggctcagacgctgaccttcgcccgccggagcaggcggcggagcccgtcatcgtccagatccgccacagccagcatcgccgcataagggtcgccttccagaccgagcaccgccgcgaaggcgggctcggtcttgaggcctcggttgcgcgcgccgatcacctgccgccgcaaacccggcccgccgagggcgagcagccggcgctccgcctcgaaatggcgccagcccggctgctccgccaccggcagcgggctgccgaagatttcgaccggccagccggccgagacgaagcgcaccaccaccggtcggccgtcgccgcaccagcgatgcaccgaaaagccgggcaggtggcggaaatcggcccaggccaccgccgccagcgcctcgggatcgggggcatggcacagcaggtcgatatcgctctccgcccggtcgaggccaagcggcggcgtgccggccggatgcggatcgaagccttccagacggccgggacagccgatccggcgcagggcttcctgatagggcggacgttgtcggatcatgccccgatcctgcaatcccgccctctcgccgtccagcgccacgcactgccgcaggcctaggaagcggcggaagactgacctatagtcggcatccgcccgccccgacgcgacccgcccccccgacacgccccaccccggacccacgagaccccatggccgcacccgagatcgagaagctcgtgaccctgctcgcccgcctgccggggctgggcccgcgctcggccaggcgcgcggcgctgaccctgctgagacggcgcgaggcgctgatgctgccgctggccgacgcgctggccaaggcggcggccgaggtcaagagctgcacgatctgcggcaatctggatgcccgcgacccctgcggggtctgcgccgacgagcggcgcgacccggcccagctctgcgtggtggaacaggtggcggatctctgggcgatggagcgcgccggtgctttccgcggccggtatcacgtgctggggggcacgctctcggcgctcgacggcatcggtcccgacgaactcggcatcccgaaactggcggcacgggtcgcggaaggcggcgtcaccgaggtggtgatggccctccccgccaccgtcgacggccagaccaccgcccattacatcgccgaccggctggcggaagcggcgcccgaggccaacatcacccgcctcgcccatggcatgccggtgggcggcgcgctcgactatatggatgacggcaccattcaggcggcgctcaaggcgcgccggccggtctgagggaacgcccgcgccgatggcccgcctgctgctgctcaccgccggaaccgagggggatgtccgccccttcgtcaatctggcgacgcggctggtggcacgcggtcacgaggtggggctggccgcccccgcaggcgatgcggagatggtcgccgaaagcggcgcgcagcatctgaaactcgccatcgatttccgcgacatggcccggcaggggcaagcccatgccgccggcctgcccgggctgatcgaccggctgacccgtacccacacgcttaccggggccggcacgctgacccgcgttgccgacgcgctgttcgagaccaccgcccgcggacgcagcttccggcccgacgcgatcatcgcccatccgaaatataccggcgccgccgatctggcccaggcgctgcaggtgccctgggcgcaggtggcgctgctgccctgcatcgccccgaccgccgtagtgcccaatgccgccctctttgcccgcgacatgggcccctgggcgaaccgggcgagctattgcctcacccccctgctcgcccggccgctggccggccgcaccgatcgctggcgggcggacatcctgggcctgccccccaggcgcaaggcgccgccgcctgcggcccggctggtgctcaacgccttttccgcggccctgctgccgcgtatcgacgactgggggcccgaggtcgtgaccaccggcttctggcgtgcggaagacgacgcggcggccgatgccggcctgccgatcgaggcggcggccttcgccacccgcgcaaccgcccgcaggcggccgctgatccatatcgggttcggcagcatgagcggggtggacggcaacggcgtcgcacgctctctggcccgcgcgatcgagcgcgccgacgtggcggcgctggtcaccaccggctggggcgggatcgacggccgggcgctggaccgcctggccggcgaccgggtgctggtgctggaccgcatgccccatgcccgggtcttcccgcatgtcgatctggtggttcatcacggcggggtgggcacgctggcgagcgggctgatggccgaccgcgcggcggtgatctgcccctggggcgccgatcagcccttctgggcggcccgggccgtggacggcggctatggcctgcgcgggcccgggctgcgccagctggcggcgggggggctgggcaccggcgaccggcttggccgcacgatccgccgcgcgctccgccacggcccgctgaccgacaccgcccgccggatcggccgcaggctgcgcgccgaggatggcgcgcatgcggcgatgctggcgatcgaggatatgctgcgcagcaggtgaggtcaggcggcgacgcaaccgcaggcggcgctgcggatgcggaccagcgagcccgcgcggccggtcgcggccgtgccggcgatgatgtcatcggcccgcggcccgaaaatgtgctggccgcgatcgcccagaatcgtgatcgccgggcagacgatgtccaggtgatactgggtgtggggtgtcagccccaggccgatatgaatggtgccggtccggccgccatagagttcgttgatggcggtgttggcgtcgtagagttccagtgtgcagttcaccgcgaagccgaactcccacatgatccgatagcggctgtcgacgtcgaacatccgctccagcatctccaccgccggcgccgcttcgggcgtcagtgcctccagccggacgatatggccgcgttcgatggtggcgagcatcggcccgcgctgcatggccgccaggcggctgtggatccgcgcctgatcggccggatgatagctgggggcgccattgtgcaggatcggatagccctcgatcaccatctgcccgtcgatgccgagcgagaggtcggcgctgtaatcatagacgtccagcggcagggcgctgacttcacccgacggcgccagctgctgctctccccagccgaggaaaccggcctgctcgttccagacgtacctgtccgacatgtggtcgaagcgggcgcgggtgccgtagcgcggatcaacgatctccatgaaggccgactgctcggccgtcgcgaagaactgatcgaccagctcctgctgggcggccgggtcggtcgcctcgatcatccggatgccgtgggccagcttgtccatgtcggtcggcgtcgaattgcaggccagcgccagaagcttgcgccgggcgccgatcgtgccggccggcggcgacttgtaatagacgtcgggagaaatgaccaggatatgcgccgtctcgggcatctggtccagaatctcggagaaggactgccccttctcgtagaacagcgtcatgtcaccggcatagccgccgccaccccgccccagccggacctcgaaacgatcggctgccgaccggttggtgacgaaaacgaaggtggcgccctccgggtcgccgaactgccgcatcgcggtcgggtcgatgatgatccggtccattgcccacctcttgcctgatcacatgacatgcaagtcttcatcaagtggcgtggtgcgacacgctgcgtgcgcgcaccacgccaccccgcatccgtcagtcaacggatgagaaggccgctggatcagcccagcaggctgccgagatagtcggcattcttcttacggttctgcatgacacgtctcccttggttgagagaccggaggaccccatccatccggtcgacttgatggtttcatgggagacggactcattcaactaacaaaagaatcataattatcatgtgcaaccgtaatgggaatgtcatcgatcggtcggatgggttcaggtagtgcccgctggataggcggcaatccggttcgtgcccaccatgctggtcgtcggcgacggcaggtcgagccccggggccccttcatagccatcaatgagattgccatcgatcagacagccggtgcctgtcacccggataccggggaagggagccgcagcagttcccgaacgccgcacgacattgccagtcacctggcagtcgtccgcccggacataaagcccatgctccacagagttggcgatgaggttgttcgagacctggacgcccgaaccatggatcagaatggtgggaccatgccgataggtggtcgggctggccagatcacaggtccactggcagttggtgatcgcaccattgatcgccttgctcgccgtgggtgtaccttcgggcaccgtttcgaccagcgtttcatagccccgataacctgtcacgccggtgatccgcatatcgcccatcgggccgtgatagaaacggcggcaatcatcagcatagcagtcggcgatcagcccgcccttcagggcatcggaaagccccgcgaccatgatgcaggtggacgagcggtcaaagagcccgccaccatttaccttttgaatggtctgagcggtggcgccccaggcttcgggggtaatgacttgcggatcaatcggcggtggtgtttcgtcggtctcgctctcttcctcgctcgcgtcttgtatgatgtacatgtccggtgccgcacggtcataaagaacaccatcagccccgacgacataaagcatgttgtcctcaagaccggtgggggcggttcctgcccgatagaccacgatgtcaccgacctcgaacgcgtcgagccccgtggtctgggtggtcacggaggacgtcagtaccacgtcgacctgctgccgggggccaccacaaccatggaagcggttggcgatgaaattgaacccgcggatcgtgacgtcattggtcgtggacttcgccgccggatggatcacgatcccatagcggcacgagctgaaatgggtccgggtcacgaggaagttgcggccgaagccgacaattcccatgcgcatattgtagaagcgacagaaggcgaactcactgtccaggtcggcccggcctgtggtgttacagagcacgaagccgatggtccgcgccccatacccgttgaccgatgtcgagatgccgtcgggcaggggcgcactgccgtcgatccagccttcgaaactgatgcccgtgacccagatgcgcgtggatgacgcgcgggtgaacatgaccttgagattctcccccgccttgatcaccggccggtcccagccctcgccttcccccttcagctgcgtggttgtcgggatgtggacggtacggtccagcgtgatggtaccgctgaagacgacgacaccaccgaatcccgcggcattgatcgcccgctcgatctgcgccgccgcgtgggggatcgttaccgtcgtggcgccattcgccctgacattgccgataccgtaccaggccgtccgcaccggcccctgatcgatccggcgccagaccccgatccgggtatcggtgtcggagttgacgcagtcgaagaccatgccctcgtcgatcctgtcggcatacgggccggtcgggacttcaagacgaaaggtgccgccgccatcatcgtcgtagacgtgatatccggcgacgatcgccacgtcgcccgggctcggcagggcccccacaggcggctgctgcatcgcggcgacggtctgataggtgaaagtggccattggcctcctgctcctgggatggaaggcgccccgtcggcaccttcggcatcgcccagcatggcaagcggcgtccgtcttcccgattcgtcttctgttgcaacatgttgcaacagaccggcgcaccctcagccggcctcgtcctccgtgccccggtcgcccagctgcagggcgtcgatgcgctccgcccggcgggcggcccggtcggccgacaggcggacgccgcgcagatcttctgccgcctgttcgaaatggcggaccagcttggccgcccggtcgtcgagccgggccagatcgtcgagcagggcggtgacctgggcccggatctcggccgcctgctcgcgcacccgcacatccttgagtatcgcccggatggtggtgagcgtcgccatcagcgtggtgggagaaacgatccagacccgggcgcggaaggccttttccaccacgtcctgaaaattgccgtgcagttcggcatagacggcttccgagggcaggaacatcaccgcgccgtccgccgtttcgccggggatcagatagcgttcggaaatcgccttcacatgggccatgaccgccgtgcggaaggcgcgcgccgcctcggtccgccgggcgtcgctgtcggcctggcggagcagatggaagctttccagcggaaatttggcgtcgacgacgatcggccccggcggatgcggcagatggatcaggcagtcggcgcggcggccgtttgacagtgtcgcctgcatcgcataggcgccgggcggcagcatctggccgaccagatcggcaagctggacctcgccgaaggcgccgcgggcctgtttgttggccaggatgtcctgcagcccgaccaccttctgtcccagatcggcgatgttgcgctgagcctgatcgatcaccgccagccgggcgcgcagatccgccgtcgcctgggcggcacgggtgccttccagatcgaagcgatgctccagccgggccgacagcgtggtcaggcgggcatccaccgtctcggcgatcatccgctcctgggtctgaagccgggcatccacctgcgcctgctgggcggcaagggccgccaccacctgctccatccgccccgcctgctgggcctgggcgcgggccagatcccccgccagccgttccaggatctccgcctggtcgagggcggcatcctcggccgcacgggcccggcgggcggccgccgccgcaacccagccgccggcgaccagcaccaccagcaacagggctgcgatggcgagcggaacggggtcgagggtggcgaaatcaggcatcggcgggtcgtctcccggatgaaacagggcccggacgggtcgccgggggcgggatcatgcgccggcacgggccccggtacaagcgacctgcacccccgcgcgcagccccgatgcagggctggccggcgccgggcgatcttgaccccgcgatgtcgccgtaatacctaacccttgaacagaattggagtcgtgacctctcatggccatcatgcccatcctcaccgcgcccgatccgcgcctgaccaagaccgcgaccccggtcgcgcgcgtcgacgacgacgtgcgccggctgatggacgacatgctcgagaccatgtatgccgccgaggggatcgggctcgcggcgccgcaggtgggcgtgctgcagcgggtgatcgtgatcgacgtctgctggggccgcgaaggcaaggagccgacgccgctcttcatggccaatcctgaaatcgtctgggtctcggacgaggacaagacctatgaagagggctgcctgtcgctgcccagccattatgccgatgtggtgcggccggccgccgtgcgggtgcgctatctggaccgtgacggcgccgtgcaggaaatcgaggatgacggcctgctggcggtctgcgtccagcacgagatcgaccatctggacggggtgctgttcgtcgaccatctgtcgtcgatcaagcgcaacatgatcctgcgcaagctggtcaaggcccgccgcctgggcaacgacaagcccgagaaggcgccgatcaccgccgcagtctgaacctcccctcttccatcgaaccgaaccggatccgcgcgcccgatgagcaccgacacccccgcccgcgccccgcaccgggcgcgcgtcgttttcatgggcacgcccgatttcgccgtcccctcgctcgatgccctggttgccgccgggcacgaggtgatctgcgtctatacccagccggcccggccggccgggcgcggccagaagctgcagcccacccccgtggcggcccgggcggaagcgctgggcatccccgtgcgcaccccggcgacgctgcgcgatccggccgaccgcgcggctttcgccgatcttggcgccgatatcgcggtggtcgcggcctatgggctgatcctgccccggccggtgctggatgcgccggcccatggctgcatcaacgtccatgcctctctgctgccgcgctggcgcggtgccgcgcccattcaccgtgcgctgctggaaggcgatgccgaaaccggcgtcaccatcatgcagatggaagccgggctggataccgggccgatgctcgccacctgccgggtgccgatcggcccgcggatgacggcgcaggagctgcatgaccggctggcggccgacggcgcggccctgctggcccgcaccctgccgggggtgctggacggcagcatcactgcggaaccgcagccggaagccggcgtgacctatgcgaaaaagctggagaaggccgaggggcggatcgactggacggccgatgccgcgcggatcgaccggctggtgcgcgccttcaccccctggcccggcgccttcttcgatctggagggcgaaagcctgcggctgatcgaggcggcaccgtccgatgccgcggtgccggccggcaccgtggcgggcacgctgttggccgacggccggtcggtcgcctgcggcgacggccgggcgctccggctgatccgcgcccagcgtgccggccgcaagcccatgaccctggatgatctggcccgcggctttccggcggttgcccccggcgcccggctcggctgatgcagccgccgcggatgcagcgctggaagttcaccgtcgaatatgacggcaccggctatgtcggctggcagcgccaggacgggctgccctcggtccagcaggtgctggaagaggcgatcgaagcctataccggcagcccctgcacgctccgcgcggcggggcgcaccgatgccggcgtccatgcctcggcccaggtggtgcatgtggatctgccccgcgccgacagccccttcaccaccatgtcggcgatcaaccacttcctgaagccggaagcggtggcggtggtggatgccgaagcggtgccggacagtttcgacgcccgtttcaccgccatcggccgtggctatacctaccggatcctgaaccgccgggcacagccggcgctggaccgcaaccggctgtggcatgtgccctggccgctggatctggaggcgatgaccaccgccgccgcccggctgctgggccatcacgatttctcaagcttccgatcctcagactgccaggcgaagtcgccgatgcgcacgctcgacgagctgaccatccggcgcgcgggcgacgaggtgctgatccgcacccgcgcccaggccttcctgcacaaccaggtgcggatcatggtcggcacgctcgccatggtcggccgcggccgctggacgcccgacgacgtcacaagggcgcttcaggcccgcaagcgcgccgccgccggccagaccgcaccgccccaggggctgtgcctggacctggtcgcctatccgccgccggagctttgggccgaaatggcgagccgccgccggctgcgaccggcatcaggagacgaggatggcggcgactgaaccgccgcgcggcgacaggtcagcctgagccagagcggcaacggcgccaccagtgccgccaggatcatggccaggatcgccatctctcccggggccagcccgatcgaggcgatctcgcccggcagcagcttcggccgggccgccaccacgccatagacccagctgccatggatggcggccagaagcagccccagacagggcaggatggtggcaagagcgcccatccgcacccgacccggggggcctccggcctgccggcggtccagccgcagccaggccccgatcagcccggccaggatgccggcgctggtgagcagccccgccaccagccacagaatgcgggtcgccacgccaccgaaggtgccgaaatgcagcggatcggcggtgttcacccagcgctgaagcaaagtgagcccggccgcatcgcggatctgaagcacggcgccggtcgtggggtccagggcgacaccctcggtaccgtcgcgcagcagcacgccatccccccggcccgccagcaccagcggatggcccggtcggcggggcggcatgatcgtggtcaccaccagcgccggaaaggcctcggcagcacgtgctacggccagatcgagatcgatcaggggggccgctggtgccggcaccgccgtgattccgggcagagccgggccttcggtgaagcccgtgccggcggtatcggccgccgtctcgaccagataccagaccccggtcagacagatcaggatgccgatcagcatcgaccacacgcccgcgaaacgatggagatccgaccagaacagtcgggcgctccgccccatgcgcaggatcaccgccgcctgccaccagcggcgggtggtgatcaggcctgtgaccagcgccaccagcagcggcagggccagcgcccccacgatcagcgccccgtgcaccccggtcaccccgggcacgatatagagctgcttgtggaagaccctgagccagagatgcaggtccagcccggccttctgggggccgggctcccccgtccagggatccaccggcacccggcggagatcgccttctcgccccgccaccagtgcccaggccggccggcgcagagcgtccggatccatggcgagccccaggatgctgagatccggatgggcggcggcgacccggtcgtacagcccctgccacgacatccgcggcgtgccggccgccggggccgcgacccgcttcgccggatcgcccagccaggcgagttcatggccgaagaccgccatcgtgcccgagaggcagatcacatagagcagatagccgaggaccagcccgatccaggcatggatccggaacagacccttgcggctgaagaggccgatgcgggcaggactggctgggcgatcgatcggcggcaccggctcagaacctgagcgtcagcgagccgagcaccgcgaagggctggcccggatgggcgatcgaccggtcgctggcgcggacgatatagtcctcgtcgaacaggttgtagaggttgagcccgacccggccgccgccccaggcataccagagcgctgcatcggtcacgatgtagtcgtcgagttcgatgctggggtcgaactgggccgtgctggtgccggtatagcgcacgccgccgcccagcccccagccatagaggtcgagcccgcccgcgcggtcgccctcctggaagtcataggtcatccacagccgcgccttgcggcggggtacgccgccgagcggctggccgaccgcggccggatcgtccggattggacagggtctcggtctcggtgaaggcgtagttcgcgatcaccttcagcccgtcagtgacctgaccggtcagatcgaattcgaagccacggctgcgctcgcgcacatccgccagataggcggaggcgccggtcgcgttgtagagggcattgtcgaagaccgcgacattctctttctcgatctgaaagaccgaaaccgtggccagaagctgctcgtcgaagaaggccgccttggcgccgacctcgtattgcagcccctcctcgggcaggatcggcgagccggagcgatcgagaatgcccggccgttgcggcaggaaggactgggtgacgctggcatagaccgaatattgcggcgtcagccggtaaagcaccccggcacggccggtgaaggcgccttcctcgatatcgggggtggcgacgccgttgctctcattgtcctggcggaaggtgtcgtagcgcccgccgagcagaagcttcagccggccgtcatcgagcagggagatctgatcctgaagatagaacccggcccattcggtcgtgccctgcacccgctcgacggcgagattggccggcaccggaaaatcgacctgcggatcatttgaaatcgggatgaccgggccgttgacccgcgaccgccggacgtcggagtcctgacggatcagttcggcgccaagcagcacttcgtggtcgaccgtcccggtctggaacgccgccgtggcatcgagcacgaactggatctcgtcctcgcgccggtcctcgttctggtagcgcgtcggcagaagcgagcccgtggcggtgtcgaccacaccccgcggccggagcgcctcgttcttcgaatccgcacgatggaactgaagctggttgcgcagcgtccaggtgtcgtcgaggcggtgggtcagctgataggcggcggtgtagtcgtcgatggtgcgtccgtcgaggtcgggatcgccgaaaaaggtcgacggatcgaccagcggccggccgtcggtgccgagcgggatgccggtgtcgtagggctgttcctcgtgcaccaccgcaaggtcgaccagaagctcggtgtcgtcatccggcagccagagcaggctgggggccacggcatagcggtcgacatccatctcgtcgcggaacgagccggcatcggtataggcggcgttcaggcgatagagcaggtcgcggtcggtggtcaccggcccggtcagatcgaccgacgtgcggaacagctcgtcggtgccgagttgctgctccagaacataggccgcctcggcctgcgggcgtttggtgacgacattgaccacgccgcccggctcgagcgcgccgtagaggatggaggccggccccttcagcacctcgacccgttccacattcaccagatcgaccgcaccggtcgacgtggcccgcagcccgttacgcagcaggccgggcgattcgaaaccgcggatcatcggcaggacttcggactgggcgttcagcgtattgccggcctgctggacgccgctcacattctcgtaaacgtccttgaggttgagcgacccctgatcctcgatcacgtcgcgcggcaccacctgcaccgagagcggggtctccaggatcgacgcatcggtcttggttgcggtgaagctgcgggtggcgagatagccctcgacggggccggtcgccgtctcaactgcccggcggctgccggtgacggtcagcgggtcgagccgggtggtcccgtcggatggcggggccggcagcagggtcacggtgccgtccgcctcggtgatccagccgatgccggtgccggcgagcagccggcccagcgcctcgtcgacgctgaactgcccctgaaccgcgccgccccgccggcccgcgaccacctcggccgcgccgctgacctgaaccccggcctggcggccgaaggcggccagcgcctcgtccagcggccgggccgggatgtcgaaggcgatccggtccataccggcggccaccgccaccgacgccccggccgtcagggccatcagcccgaccggcgccagcaccgtcatcagcccgaagccgaccccggcggcgatcgttacccgccctgccccatcccgcataccgtcgaacccttcctcgtcggagaccatctcacgcaaatgcggatcatttgcgttctcatcccaacaacggacggcgcgatttttcttttcaggaaaaatgaccgggcctctcagcccccggcggtgaccagcgtcagaagcggaccgaaggcgcggacttcgccgccgaccggccgcatcatcgccttcagcgcgcgctgcggatcgcgcagatcgtaaagcccggtcacccggcgggcgccgagtgccgcatcggtgatcacgatccagcccggctggtggcgccgcaattccgccaccacctcggcgaccgtggcatcggagacgaacagccggccatcccgccaggcaccgacatcctcgggcgccagccgcccccgggtgacggcgccgcttgcggtatcgaccgccagccggtcgccggccgccagctgctccacacgcctgcccctggccggcgccacccggacggtgccgctcgccacctcgaccaccacccggccgccatcggcagccacgtcgaaggtggttccggtgacggtgaccgcgacatcgcccgcccggacgatgaacggccgggcgggatcgggcatcacgtcgaagaaggcgccgccatcgatcagggtcacctcgcggcggccgtcgtcgaagcggctgcggatcgcggtgcggccgtcgagttccacccggctgccatcgtccagcaccacccggcgggtctcggccacaccggtcgcggcatcggcgccaagaccggcaaagccgcccggcctgacgctcgcgaccgccaccatcgcaacgaccaccgccgcggctgccatcatggcccggcgccgcaaggcgcggcgcgggggcacgaccccggtatcgcgagccaccggtgcgggaccgacctgcacaggcgccccccgcagggggcccgcctcccccagatcccgccaggtcgcacagacccgcgcccaggcggcctcatgcgccggatcggaccgccgccaggccgcccatccggcccggatcgccgggtcgtcgggcgcttcctgaagctgcagcagccagtcgaacgccgcttccagaaccggatcctcagccatgaccggcatcatccggcccgatcgccgcagcgatctgcatcagggccccgcgcaccatccgatgggcggtcggcaccgacacccccagacgcgcggcaatctcgcccagcgtatggccgccgaaccggtgcatctccaccgccatgcggatatcgggctccagccggttcagtaccgtcacgatccgcgccagcgtgcggcgatgggtgacctcttcctcgggcgtgcgcggcacagccggcagcatccaccagggggcgccttcgtcctggctgcggacctccaccgcccgtcggcggctccagtccagcgccagattgcgcacgatccggtacagatagcccagcggctgatccagcgccgcatcggcctggcctgcgggtacgaagcgcaggaaggcatcctgcacgacatcctcggcacgcgcgcgatcgccgcccgtgatcgacgtcgcatagtcgatcaggtccgcgcgatgggccatgaacagcgccagtttgccgtgatcttgggtcaatgcagccgcaccggaaatcattcagggctgaaccctagcccgaatgcgagtgcgtatcaatatcgagtggaatgcccgtttcaccatccggtcccggaacaaggccagcgcagtcagagcagccgggccagcaggatcggccagagaatcgccatcagcacgatcagcgtcaccgccccggaattgaggccaagggtcagccgggtcatgaaccattccatgccgatcagcgccgcaagcgccagggtggtgagcaggccggccagcggcgccggcagcacgccggcggtcgcgatcaccgccaccatcacatagacctgaaccatcgacagccagttgcgggcgacgacatagggcacgaagccccggtcgacaccggtgcgccgggccaggatcagcaacaccaggggaaagctcgcccaggcgaggagatcgaccagaacatcccccagcaggccgaaatgatcggtgccggcggccatggtcgcgatgacgtcggcggcggcctcttcatcgggcgacggcgtggccgccccctggccgggcacaggcaggctgtagagcagcagatagccggggatcgccagcagcagggccgtgaaggagtgccagaaaccgccgacgtcgatccgcaacagctccagcgcccgccggtcgaagcgggcgaggccaaggcctccgcggatgccgcggagcagatcaccgcccccggcgctcacgctccggccgtgccggtccgggcgggcggcgtcgccatgtagtcggcgatcacccgctcgtagatgcgcgacagcgcctccagcgccgcaaccggcacccgctcgtcggtcttgtgcatggtctggccgatcaggccgaattcgcagaccgggcagtaatccttgatgaaccgggcgtccgaggtgccgccggtggtcgaaagatcggggtcgagcccggtctcggccttgaccgcatgggccaccagcgacgagaacggccccggctcggtgacgaaggcatcgccggtgatgcggtaatccatctcccagcgcccgccgaccgcatcgaaactgcgccgcaaccaggcttcgaggctggccggggtgtgcagatcgttgaagcggatgttgaagctcgccttcgcaatcccgggaatgacgttggtcgccgggttggcgatatcgatggtggtgacctgcaggctggagggctggaaatagggcgtgccctcgtccagctcgtgctccaccacacctgaaagcatcttcagcagccgcggcaccgggttgtcggcgagatgcggataggccacatggccctgcatgccatagacggtcagatggccggtgacgctgccgcgccggccgatcttgatcatctcgcccagccgcatcgggttggtcggctcgcccaccaggcagtgatccatgcgctcggcccgctcgcgcatccagcccagcatcttgaccgtgccgttgatcgcgtcgcgttcctcgtcgccggtgatgaccagcgcgagccggggcttgccgccgcctgcgatatagcgcgagaccgccgccacgaaggctgcgatcgagcccttcatgtccacggccccgcggccgtagagatggccgtcgatcacctcggcgccgaaggggtcgaccgtccagccggcggcatcgcccaccggcacgacatcggtatggccggcatagcccagcaccggcagatcgccgtcgcgatcgccgatgcaggcatagagattgtcgaccggatcccagcccggctgttcgaagggcagccgatggcaggtgaagcccagcccctcgagtgccgcctggagcacgtcgagcgcgccggcatcggccggggtcacgctcggccggcggatcaggtcgcgggcgaggtcgagggtgtcgatgacggccatggggcggggatccggtctggttggacgatcaggggcggcgcggccggcgatcaggtgcgcagcaggtcgttgatgccggtcttctcgcgggtgcgggcgtcgaccgtcttcacgatcacggcgcaatagaggctggggccgggggtgccgtcgggcagcggccgaccgggcagagcacccggcaccaccaccgcgaaggggggcaccttgccgatatggatctggccggtctcgcgatcgacgatcttggtcgaggcgccgaggaacacgcccatcgacagcaccgccccctcgcccacgatcacgccctcggcaacttccgagcgggcaccgatgaaggcgccgtcctcgatgatcacggggccggcctgcaaaggctccagcacgccgccgatgccggcgccgcccgagatgtggacattgcggccgatctgggcgcaggagccgacggtcgcccaggtgtcgaccatggtgccctcgcccacataggcgccgatgttcacgaagctcggcatcagcacggcgccgggggcgatataggcggaacggcgcaccacgcagttcggcacggcgcggaagccggcggcgcgaaaacgattgtcgttccagccctcgaacttcgacggcaccttgtcgaaccagggcgcattgccgccgggcccgcccgggatcggcgccatgtcgttcaggcggaaggacagcagcaccgccttcttcagccactgatgcacgacccagttgccatcggccgccttttcggcgacgcgcagatggccgccgtccagcgcctcgagcgcggcatcgaccgcatcgcggacctcgcctttggtggcgatgccgatctcggcgcggttttcccaggcggcctcgatcacggcggccagttctgccgtggcgggtgcggcggtcgcggtcatgtcgtctccctcgggacaggttggggggcgcgcaggcgcgcacggatcgcagtttaggccgcgcggggcgggtgtcaacgtgcgctcccatcctgttctgccgtatccagatgggcgagataggcctccagccagagcgacaggtccggcgacacccagtcgatgtgatcgcccttcgatcccagcagcgagaacggctctccggtattgatccagaccgtgcgcatgcccagcgccgccgccggggcgagattgcgggcactgtcttcgaacagcaccgcggtcgcggcgtcgacgccgtagcggctgcagaacaggtcgtagacttcgggcgcaggcttgggcacgaaatcggcggcgacgatgtcgaagatcgcctcgaaccggtcgacaatacccatgcgggtcaggatgcggtcggcatgggcggtggaaccggcggtgaacaccagcttgcgccccggcagccggtcgatcgccgccccgagttcgggcgccggcggcagcaccgagacgtcgatgtcgtggacatagttcagatagtcatgcggatccaggccgtggcggagcatcagcccgcgcagcgtggagccgtgggcgcggaaataatcgcgctggagggtcagcgccgcctcgcggtcgagcgaaaagctctccatgatgaaggcggtcatccggcggtggacttgatcgaacagccgcgagccagccgcatacagggtattgtccagatcgaagatccaggtatcgacatggtcgagcgccgaccagtccaggcccggtttcagagcgacgggcccgagcaggctgtcctccgggggtgtggatggggtatgagtcatcggctgcggttcctcgaagcgaaggagatcctgcgcgggcccgccgcccgcacatcccggatacgacgttaaggcttccttgacgcacgttggagatatacttggccacgttcctggcggaagatcgggggacgaggttttcgagacaagggtccgatgtcccggcagagcgtgcagacgccagagcccattcgcagtctgaagcaggaacgcgaccgtttcgtcgcgctggcctttacggctgccgatatcctgctcgaactggacgaggcacggatcatccgtttcgtggccggcgccacctcgggcctgctgggccgtgaccaggaccggctgatcggcgtggcgctggaagagctggtggcggaagacgaccggcggatggtcaccgccgtgctggaccgccccggcgtcgccggccgcttcgaagcggtgatggtgcggctggccaacccgcattccgccgtcacgcggcgcgcgatcgtcagtggctatcggctgccggatctgggcggccattattttctggccctgtcgctgcccaaatacatggtcgcgaccgacgtgtcgaccgaggcgcgcgacgtggagaccggcctgatctcggcccggtccttcgcccagatcgccaaacatcgccagcaggaagccaatgatatcggctccaactacgagatgaccctgctgcatctcgaacggtttggcctgctgcgccagcagctcgaccggtcgctgaccgacgagttcatggccaatctgaccagcctgctgcgcgccaattcggtggtgggcgacagcgccgcccggctggatcaggacacctacagcgtcatccacggcgccgagaccgatgtcgccaagctccgcgaacaggtgagcaagctggcccgcaccgtcgacccgaagggcgatgtgctgggcctgcgcatggcgaccatgccgctggacggtgcggaactgggttctaccgatgtcgcacgcgcgatcagcttcgtggccgaacagctgaaggaacgcaagctgtcgggccggatcaacagcctgcgccgccagcatggcgagatggtcgacgacaccgcccggcggatttcggaatatcgcggcatcatccgccggagggatttccgggtggcgctgcagccgatcgtggatctggcttctcgtcaggttgagcattacgaggcactgctgcggctgaaacgggtcgatgaaagcccgttcgaggtgatcactttcgccgagcaggccggcttcatcgaggaattcgacctcgccatctgccggatggtgatcgacaagatcaagcgcgccgagcagcgcagccaggtgctgcggctcgcggtcaatctgtcggcgcgatcgatcgagagcgagagcttcgtgatcgccttcaacaagctgctggcgacgctgggccccatgcgcgaccggctgatgttcgaggtgacggaaaccgcgcggatcgacgatctgggccgcgccaacgccttcctgcaggatctccgccgcgctggccaccgggtctgcctggacgacttcggatcgggccaggcctcgttccagtatctgcggtcgctgaaggtcgatctggtcaagatcgacggatcctatgtgcgcaacgcgttgaagaccgatgacgaccgcaagttcctgcgcgcgatcattcaattgtgcaacagcctgggtatcatcaccgtcggtgaaatgatcgagaacgaagccacggccaatttcctgcgctccaacggcgtgcaatacggacaggggtatctgttcggacggccatccgtggacatctcggacttccatgaacagaataccacacaaaaataagcggtaatttatctacgtatttctgccgaccgtctgcaaagacctccgtcttcattttctagcaagttttctggtgttagatagatctcaccaccctcatgaacgaccaccccttcgcgcctcgagaactggttgagatcatcatgaattgatctcctggtgagactatgggcaaatcgccacagccgacggttttctcatgacatcggtacatcgaccttgtcatgttgcggcgtcgaacgatctcagcaccggccgatagggtagaccttctagttgcgagacgggaccgggccccatgagcctccagacgcttgacgacgatgagcgccgccgctgtgcggcctttgacctgaccgatgacgatctgaacgctctggccgcgtaccggccgcgggttcagcagcggcttcctgccctgctggatgcgctgcacgtgcgtttcgcaccctggcccgaaattcaggccgcgctaaaggatccggaggttcacgccattcgtctggcccattggagccgggccgccggcggccagatcgacaacggcttcgccgcctcggcccgcagcctcgcctcggccttctacgaccatggtgtgccgggctatgcggtcgcgatctgtcattccacggtctcgcgcgccatcatcgaggacatctccgccaccggaaccggcggcggcctgttcggccacaaccggcgccgcaacggcgatgccgccttcgccacggccctgtcgaaaatcgcctggctggatctggaacttctgctggagacctatgccgaagccgaagcgtcgaagcgcgcccaggtgatcgaggggttggccggcagtttcgatcgccagatggggcgcgtggtctcggccatgggccaggcgtcccaggatgccgatgccgccagccgccgcatggccgagacagcggtccgggcgctcgacgacgcgtcgaaggccgcggacatcgcccgtgatgccgccggcaacgtccaggccgtggccagcgccaccgaggaactggcggcctcggtcgccgaggtcggcagccgcgtggcacagtctgccgccatggcgacccgcgcagtggaggatgcaaagcgcaccgatgcagtggtccgcaccctggccgagaccgcccagcggatcgacgaggtggtcacgctgatcagcagcatcgcccagcagaccaatcttctggcgctcaacgccacgatcgaggcggcgcgggccggcgaggccggcaagggctttgctgtagtcgcgggcgaagtgaagaccctggccaaccagacggccacggcgaccgacgatatcggccgccagatcgcccaggtccagcaggcgacgcgtgacgccgtggaggcgatcagcgccatcaccagcggcatcggcgagatcgacgccatttcgacctcggtggccgccgccgtcgaggaacaggttgccaccacccgcgaaatcgcccgtgccgtggccgatgccgcccggggcaatcaccgcgtgtcggagctgatggacgggctgcaagccggatccggcaccagccgcgccgcggccggcgaagtgaacacggccatggcgatgctgaccgaccagtcgcagcatctgcgccaggcggtggacgccttcctcgacgaggtccgcaagacctcctgaccggtcgcaaactctgctgccgccaaaaaagagaggcgccgatccgtcggcgcctcccttctttttccagccccggagccccgtcgcgatcagccctcaggcgtggatcagcgtgccgatgccgcgatgggtgaaggtctccagcatcatgccatgggcgacccggccatccaggatcaccgccgcttcggtcgagccctcgaccgcggcgatgcaggtctcgaccttcgggatcatgccgccggtgatggtgccgtcggccatgtagcggcgggcctcggccacgctcatatccgagatcagattgccttccttgtcgagcacgcccggcacgtcggtcagcatcagcagccggcgcgcctggacggcggcggcgatggcgccggccgcggtgtcggcattgatgttgaaggtctcacccttggcaccgacgcccaccggcgcgatcaccgggatcatgtcggactgggcgatggtggtgatgaccttgtcgttgatctcggtcggctcccccacgaagcccagatccaggatccgttcgatattgctgtcggggtcgcgcttggtgcggcgcagcttctcggcccggatcaggttgccgtccttgccgcagatgccgatggcggtgccgccggccgcgttgatcgcgcccacgatctgcttgttgatcgagccggccagcaccatctcgaccacctcgaccgtcgccttgtcggtgacgcgcagcccgtcgacgaagctggaggtgatcttcagccgctccagcatctggccgatctgcggcccgccgccatggaccaccaccgggttgatgcccacctgcttcagcagcacgatgtcgcgcgcgaaggtttcggccaggctctcgtcacccatggcatggccgccatatttgatgacgaaggtgctgccggaatgacggcgcagatagggcagcgcgtccgaaatcgtcgcggccgtccgcagccagtgcttggtgtccgagatcgaattgggggtcttggaggtgctcatgcggcggcgctcctgaaagactgcgggtggcaggcccaagcttcgtgacggccggcccctgaggggccggccttttccaagccgggaccatacgccgaaccgggcggcgcgaaaaccgccggatgacgacaaaatgcgcgacgcccccggaaaatgcgcgacgtccggggcgatggttcagccgccctgattgttttcgagcagcagccgggcgatcgcggcgcgcagcgtctccatgccgcgcatcttgcggctgctggtgacgatgacctcaggataggccgccacatggcggcgcagctcggtctcgatcgcctgcagccgcttcgccagcaccggcgccttttccttgtcggccttggtcacgaccacctgatagctcaccgccgcatcgtcgagcagcttgaacacctcgcggtcgttctccttcacgccgtggcgaccgtcgatcagcacatagacccgggcaagattgctgcggccgcgcagatacgagaacaccatcttctgccaggccttgaccatggccttgggcgcctcggcatagccatagccgggcatgtcgaccatcatcatccggtcggcaaagcggaagaagttgagctgctgggtgcggccgggggtgttcgagacgcgggccaggttgccgcgctcggtcagcgcgttgatcaggctcgacttgccgacattggaccggccggcaaaggcgatctcgggcagttcgtcgggcggcagatcgcgcaggctggcagcccccatcacgaaggagacgggcccgagcaggagggtccgcccggcctgtacgaggtcgggatccagcgcatcggttgcgagatcgatcacgtccggttcggacgcagcccccccgaaaccggaaccccggccgcttccgcggccggggtcggggtggtcgcaacggtctccggggagatgtcgggaccgccgtcccgcgtctgatctggtccggcgttcatctccggcactcctcggatggttcgggtgatggcggacgtcgtcagaccttgacgcccatccgccgcatgatcagccactgctgaccgatcgagagcaggttgttccaggtccagtagatcaccagaccggcggggaagcccgcgaacaggaacaggaacatcaccggcaggaacatcatgatcttcgcctgcgtcggatcggccggcgcggggttcagcttctgctgaaggaacatggtgaaggccatgagcaccggccagatgccgatcgccaggaagtgcggcggggtatagggcagcaggccgaagaggttggtgatgtagagcgggtcgggtgccgacaggtcgtgaatccagccgaagaagggcttgtgccgcatctcgatggtcacgaacagcaccttgtagagcgcgaagaagaccgggatctggaccaggatcggcaggcagccggcggccggattgaccttctgcttcttgtagaggcccatcatctcctgattgagacggaccttgtcatccttgtagcgctcgcgcagcttcaccagttccggctgcagcttcttcatcttgctcatcgccacataggacttgttggcaagcgggaagaagagcgccttggtgcagagcgtcaggatcaggatggagatgccgagattgccgacgatgctctcgatccagagcagaaccaggaagatcggcttggtcaggaagtagaaccagccgaaatcgatcgccaggtcgaagttcttgatgccgagtgcgtcgccatagccatccagaacgtccagttccttggcgccggcaaaaacccgcgacacggtgctggcggtcgcaccgggtgcgacctcgcggacgctgcccagatagtcgacctgatatttgggcgtggtgccgaccaccgaatggccgaagcgtgcggtcaccgcctcggactgatcaggaatcacggcggccagccagtacttgtcggtgatgccgaaccagccgccggtcgagctggccgagaccggctgctgctgttcggccagatccttgtacttgtattccttgagggtgccgtcgacgacgccgagcggaccttcatgcaggatgtagtagccgagcgtctgcggcgtgccgctgcgcgagaccagcgaataggggtagagcgtgaccgccgcgtcgccggtgttcgtcaccttgtcggtgacggtgaacatatagttggcgtcgatcgcgatctggcgctcgaacaccagcccctggccgttgtcccaggtcagcgtcaccggatgttcaggcgtcagcggcttgtcgtcggccggcgtccagaccgtctccgcgcccggcagcttcacgtcgttggatgaggcgacccagccggtctgggtgtaataggcggccttggtgccgagcggcgagagcagctcgatccgcggcgaggtctgatcgaccgtctcgtgatagtcgaccagggcgacatcgtcgatccggccgccttccaggctgatcgagcccgacacgcgcggcgcatcgatcttcacccgcggatcacgggccagcgccgcttcgcggtcgagcggcgcgggggccgcaggcgtcgcaccgggggccgagggcgccgagccgccggcggtcgccggggcttcggtcgacacggcttcggcaggctgctgcggcttcggctgcgggaccaggaggtagtaaccgaagaggatcgcgatcatcaggaccatcgcgatcatcaggttgcgctgttcaggcatcggcctcacctgatttgccggcgcctggctcagcaccggatccggggcgcggcggcaccgggtcgtagcccgacgtcccccacggatgacacctcaggatccgccggagcgccagccaggcgccatggacgggtccgtgaagctgtaccgcctcgatcgcataggccgaacaggtcggcagatgccggcatcgcggcggcagatagggtgatatcacaagctgatagccccggacgaagacgatcatcagcatggcgaggccacgactgacgatgccctgccggggcttgcgaccggtggcgcgggaaccgcgatcgcccgggcccgaccgactctcgtcatggcccgaccgaccttcggccggcacgaccggacagccgcaaccggcgtgatggagatggccgctcatgcgtcgccgtctcccgccgggcctgcggaaaccacagccccggcggccggggccggccgcaccttcccgccatcctctccaccgcgccgggggcgcctgggccgcggcgccttgcgcagcgcttcggcaagatcggccagcaggcggtcatagtcgcggtcgacggtctgggtgcgcgcgatcagcacatagtcatgcgccggcatcgcatcggcgatgcaggcatcgaccgctgcgcgcaggcgccggcgggcccggttgcgcgccaccgaattgccgaccttgcggctggcggtgaagccgacgcggaccgaaatccgttcggcggcacgggcatcgcgttcggccgccgtccaaggacgggcctgcaccacaacccccggcgtcgcccatttcatcccgctgcgcgcagcggcaagaaactcaccgcggcgcttcaacccggctgcacccgccttcaccacccggccctcgaacgatcggggccgcgccaccgccggaaccgaacggtccggggtgcgcggcccgacgaagacggtccggtcaggcgctcaggcgcttgcggccgcgcgaacgacggttggccagcaccttgcggccgcccacggtcgccatgcgcgaccggaagccatgacggcgcttgcgaacgagcttgctcggctgataagtccgcttcacggtaggaactccatatctgctgtgaccggcactgaggccccgataccggcgccttttcatgcgggtcacgcacgcgccgggcgggccgcgcctgccggcgaaacccgaataaccacgggcttatacgggcacgccccctgcctgtcaatcgcaagcgagggccacgatcatctgttgccgcgcggtgggttgccgaagcctcagaagtccccgctcagcagctgggcacgccggcgggcatggtagtcggcatcgatccggccgcgggcaagcaggtcgtccagttcgaacaggcggtcttcccgcatgcgctcgtcggcgcgggcggcgcgggcggcatgcagggcaagcagttcccggcccgagaggtcgggcgccgcctggggcagcggccgcatggcggtgagcggcgggcagaaattggcggcacggccgcggccgtcgcggatcgcatagccatagcccgcgaaatgatcatccggatagcgataggaccagtggcgcgcctcggcgcagtcgcgatccgcgggttccagcgacatcaccaccggccccatgccgtcggcagtgggctggtcgccgacataatagcggtgctccacccgcccgagggtggagcgggtgccgaaatcatggggcgagcaggcggcggtgacgaggcctgcaagaaggccggcgacgagccccgggcgcatggcggttctccagtatggaccggttgtgggccgagtgtggcggcttcgcccggtgcgggcaagtgcggcgacttgccctggatcaaagcgggagatgctgcactgcatcatgctatcctggcgttcaggcgacgcgcccatccccccctcacttcccgtggacgaccgagcgatcatgaccagacagagccccggccccctgaccatcgccgagaccgcctggcacgcggtgcccccggagacggccctcgcagccctcaatgtccgggccgacggcctggcgggcgacgaggccgccagccgcctggccgcgttcgggcccaatcgcctggaggccaaggccgggcgcagcctgatcgcccggatcgccggccagttccgcgacgtgctgatccatgtcctgctggtctcggccgcgatctccatcctgctcggccattacgtcgatgccggggtgatcctgggcgtggtggtgatcaacgcggtgatcggcttcgttcaggaaggccgggccgaaaaggcgctggcggcgatccgcgacatgatcgcaccccgggcggcggtactgcgcggcggcgtgcgggtgggggtggatgcggccgaactggtgccgggcgatgtggtgctgatcgaggccggcgaccgggtgcccgccgatctgcgcctgctggatgcagccgggctgcatgtcgatgaaagcgcactgaccggcgagtcggtgccggtttccaaatccaccacccccactcaccccgaggccgccctggcggaccgcgtctgcatggcctattccggcaccatgaccacggccggccaggcgcgtgggctggtggtcgccaccggctccgccaccgaaatcggccggatcggccggatgatcgagacggtggagacgctggagaccccgctggtccgccagatggccggattcggccgccggctgtcggcggtgatcctggcgatgtcggccgtggtcttcgcggtggcggtgggcttgcgcggctatgccttcgacgacgctttcatggcggtggtggggcttgcggtgtcggccatccccgaggggctgccggcggtcatgaccatcacgctcgcgatcggcgtgcagcgcatggcccggcgccgcgcgatcgtgcgccgcctgccggcggtcgaaaccctgggcgcgatcggggtgatctgttccgacaagaccggcacgctgaccgcgaacgagatgacggtgcgcgactgcgtgctggccgaggggcggcttgcggtcgaaggccatggctacgatcccgacggacgggttgcgaccgaggccggcgaggaccccgccaccgcggcggcggccgtgcttgccgatctcgccctggccgggctgctctgcaacgacgcccggctgttcgccgatgaagagggccgttggcgggtcgagggcgacccgatggaggcggccctggtgcgcctggccgccaaggccgggctcgacccggaccagacccgcgccgcgcggccgcggatcgggctgatccccttcgacagccgccatcgctggatggcgagcctgcatgccggcaccgacgatcccgggccgctgctctgcgtgaagggcgcccccgaagtgctgatcggcctgtgcgaggcggaagccatcggcatcgatgccgggatcggcacccgcccgatcgaccggccggcctgggaggccgaagtcgaggccctggcggggcgcggccggcgagtgctggcgatcgctgcccgccgcctgagcgcaggcgccggaatgcccgccgcgggcgagatcggccaggggctggtgctgctgggcctggtcggcatgatcgatccgccgcgcccggcggcggtggaagcgctggccgcggcgcgcagcgccggcatcaaggtcaagatgatcaccggcgatcatgcggtcacggccgccgccatcgcccgcgacatgggcatggacgtcacccatccgccggcgaccggtgccgagctggatgccgccgatgccgagaccttcgcgaagcttgcccacgagcgccaggtcttcgcccgggtcagccccgaacacaagctgcggctggtggaggccctgcaggcgaaaggcgccgtggtcgcgatgaccggcgacggcgtcaacgacgccccggcactgaagcgcgccgatgtcggcgtcgccatgggcaacaagggaaccgaggcagccaagcaggcggcgcagatggtgctggccgatgacgatttcgcctcgatcgtggcggcgatccgcgagggccgcacggtctatgacaatctgcgcaaggtgatcgcctggaccctgcccaccaatggcggcgaggccatggcgatcgtggccgccatcatcctgggcctgaccctgccgctgaccgcggtgcagatcctgtggatcaacatgatcaccgccgtgggccttggcctgacgctcgccttcgagccgaccgagcccgccgccatgcgccggccgccccgcgccgccgatgcgccgctggtgacgcccttcctgttctggcggatcggcttcgtgtcccttctgttcgtcatcggcaccttcaccgtcttccatctgggcgaggcgcgcgggctggggctggagggagcccggaccctggtggtgaatgcggtggtggcgatggagatcttctatctcttcgccgtgcgctacatggccgggccctcgctgacgctgaccggcatcatgggcacgcgggcggtgctgaccggcatcgccgtcaccgtcgccgcccaggccgccttcacctggtggccgccgatgaaccggctgttccagaccgtgccgctgggcccggtcgagatcctgatcgccaccggcgccggtgtctccctcttcgcggtgatcgagatcgaaaagcgcatcacgcggctgataacccgccggcactgatccaccggcgcagaccgggctcgcgcggcgatcacggcaagtttattggcgggcgggtcgggcggtcgctacatctggatgaggggcgaccatcccggccgcccgccgatggacccgccgccgatgaccatgtgccgcaacccccgggatcccgagacagatggccgccgcccgctgctgcgctgcctgccgctcgcgatcctggtggctgccctggcgctggcgctggccggcgggctgcatcatcagctgacgctcgaggccctgacccgccatcacgaccggatcaccgggctgatcgagacccatccgctggcggcgatcgccggcttctgcctggtctatgccgtgtcggtcgccatctcgctgccgggtgctgcattgctgagcctggcggcgggggtgtttttcggcgtgcagctgggcctcgccatcgtattggtggcggcgaccgccggcgcggtgacggtcttcctcgcagcccgcggcgcgctccggccgctgatgctgcgccataccggcgcgaagctctgccgcatggagaccggtttccggcgcaatgccaccagctatctgctgtttctgcggctgatgccggtcttccccttcttcctggtcaatgtcgccccggccctgttcggcatgcggcttctgccctatgcggcggtgacgctgatcggcatcgtgccgggggcgctggtctatgtgtcgctgggcgcggggctgggtcaggtgatcgccgagggccgggtgccggatctggccgatctgatgaccgtcgagatcatggccgggctgtcggggcttgcggtgcttgccctgctgccggctttggtgtcgcatgtgaaggcccgccgcgccgcacggagacgcccatgaccagccccgagcggatgctcgacaccgacatctgcgtgatcggcgccggcgcggcggggttgagcgtcgccgcaggcgccgtgcagatgggcgcgcgcgtggtgctggttgaacgcaatcgcatgggtggcgactgcctgaacgtcggctgcatcccctccaaggcgctgatcgcacgggcgcgggcggtggccgaggcggcgcgctggccggagctgggtctctccggtgccgcgcccatggtcgatttcagggcagtgaaggacggcattgcgcaggtgatcgccggcatcgccccgcatgattcacccgaacgcttccgcagcctgggcgtcgaagtgatcgaagccgatgcccggtttctggaccgcaaccggctgatggcgggcgaccggatcgtcaccgcccggcgcttcgtgatcgccaccggatcccgcccggccctgccgccgatcgaggggctggagcgggtggtggtccacaccaacgagaccatcttcagcgaccggatgcagcccgaacatctggtggtgctgggcggcgggccggtgggggtggagatggcccaggcccatcgccggctgggatcggcggtcaccctcgtcacctcgggcagcctgctgccgaccgaggatccggagctggtggcggtgatccgcgcgcgcctgctggccgagggcgtggtggtgctggaacaggcccgcgccgtggccgcccggccacgaagttccggcgacggggtgcggctgcatctggcgggatccgccggtgcggggcaggtggtggagggcgaccagcttctggttgcgaccggccgcaggccggtgaccgaggggctcgacctcgcggcagccggcgtcgaggtcgatgccggcggcatccgggtcgatgcgcggctgcgcaccagcaatggccggatcttcgccatcggtgactgcatcggcggcatcgatggcgcggcaccgcagcgcttcacccatctggccggtcatcatgccggcatcgtgatccgccaggcgctgttccgcctgccggccagggtggagacccgggcggtgccgcgggtgatcttcaccgatccggaacttgcccgggtcggcccgaccgaggccgaggcccgcgccatacatggcgacatccgggtgctgcgctggcccttcgccgaggtcgaccgcgcccgcaccgaggagcgcaccgacgggctggtcaaggttctggtcgggcgccgcggccgtattctgggcgccgggatcgtgggcgaaggcgcgggcgagctgctgcaaagctgggaactggcgatccgcgagaagctgaagatcggtgccatggccgggctgatcaccgcctatcccacccgcgccgaggcctcgaaacgcgctgccggccaggccttcaccgagctgctgttcggcagccgcagccgccgtctggtgcggctgctgctgcggctgccctgaccgcgaagggtgatccttatgcccgacagcaggccccgccgccgttttcgtctgcccttcgtcgacagcctgtcgggccggctgctgctgctgaccgtgatcttcgtgatcctgggcgaggtgctgatctatctgccctcgatcgcccgctttcgcctggtcttcctggaggcccggcttgccgcggcccatctggccagtctggcgctggaagatcgcgacatggaggtgacgccggggctggagaaggtgctgctcgacaattccatggttgtcgccgtcacgctcagccgcccgggccggccggatctgatgctgggcgagctggcgccggccgcccggaccgtggatctgcgccagcagaccccgttcacgctgatccgcgatgcgctcgactgtctgctgaaaaccgaaccccggctgatccaggtgatcggcccggcgccgatggcgcccgagatgatggtcgacgtgctgttccaggaacgcgatctgcgcgacgagatgcgcgcctattcgatccgcatcctgaccctgaccatcgtgctgtcggcgatcgtggccgccctgctctacgcagccatcgaacggctgatggtgcggcccatgcgccagatggcggccgcggtgatcgccttccgcgaggcgccggaagatccggcccggatgatgccgacctcggggcgcagcgacgaaatcggcatcgtgcagcgggaactggcgatgatgcagcagagcgtgcgccgggcgctggaacagaaaagccggctggcggggctgggtgcagcggtcgccaggctgaaccacgacctgcgcaacctgctctcgaccgcgctgctcaatgccgaccggatcgagcgcgaggcaagccccgcggtgcgccggctgctgccgccgatgatcaccgcgctcgaccgggcgatcacgctttgcggccggtccctgggcttcgccaccaccgagacgccggcccccgacagaacccggctcgatctggcgcaggtggtggacgaggtgctggcgaccgttgaacccgacccgccggccgcccccgacgatccgctgctgccggccgccgatcccgggccgatcgcccggacctgcgccataccggccggcaccatggtgtcggccgaccatgaccttctctaccggatcctggccaatctggtgcgcaatgcgctggaggcgatgcaggcgaccacaccgccgcccgacggccaccggctggtggttgccatcggccgcggcagcggggacgagatcgcgatccgggtcgacgataccgggccgggcctgccgtccaaggcggccgcccatctcttcgagcccttcaccggctcagcccggccgggcggcaccgggctggggctggtgatcgcccgcgatctggcccgcgcccatggcggcgatctgaccctggactcgaccgggcccgagggcacccgcttcaccctgcacctgccggtcaggtagccccgcctctgtcagacggatgtcagacggaggctacccggatcagcatgaagccgtcatggcccttcacgcccacggtctgcagcaccgtcgcctcaagccgcggatcggccgcgaccatgccggtgaagctgcgcacgccctgtaccgaggcatcgccatcgggatcggtgacccgcccgtcgcgcaccacattgtcggccaggatcaccgaacccggcctgaccagcatcatcgaccagtcgagatagaccgggttcgacggcttgtcggcatcgatgaagatcaggtcgaagggcggctcggacccgtcttcgaccgcagcagcaagatcgggcagatgatcatgggccgggcccacgcgcagatcgatccggtccatcaccccggcggccgtgaggttggcgcgcgcgacatcggcatgatgcggattgaattccagcgtcaccacccgccccgccggccccagcgcccgtgcaagatgcagggtgctgtagccgccgagcgtgccgatctccagcacccgccgcgcgccgaccatcttcgcgaccatccccagaaaccgggcctgaagcggcgagacgtcgtggggcggcaggccggctgcggcattggcggcaagcgccgcttcccccgccgggtccaccggcagcaggtggtcggcaaaccagaggtcgaccgcctgccagcgatcggggtcggtcgaagtcatggggcacaggctccgcgggtggagagaagatcaggaccagaagggatcggcatccttcacgaaacgtttccaggcgctcacccccttgcgcagggcctcgtcctggccggccgcatgggcgcccgcgatcatgccggcaccgaaggcgagcgccggccgggccgacagctcttccagccgggagcgggcgacggcgatgtcgttcagcaggccgagcgcatcctgcaacgccttcagccgcttgccgaagcgggtcgcctgcttctggtcggtggcgagcccgccgaagaactcgcaggcatagcgcagcttcttgacctggatgcgcacctcgtgccgggcctcgggcgccagcttgccgagaccgcggccccggcgcagcaccttgcgcagccgcttgtcgagcacgcgggccgcaaaggcccccagcggctccagaccgggtgccggagacaggtggaccaccggcgcctcccctgcctcggaggtatcggcatccccgccggacagcgccagcccgtcgaagggctccggcgccacgccgccatcgggcagccagtggccggcctcgatccaggcgcccagcaccaggggcagccgggcgaatttcggatcgtcgagtgccgcggcgacggcatcccaggccgcgcgccggtcgtcttccaccgcaccgcgcagcgccgcgagcgggccggcccccagcagcttttccgccccggtcagggtttcgcccacaaagacgtcggcgtcgcgcgccggccccagcaccgccatcagccagcccagcgccgccttaacgtggcccggcgtcagcagcgccggatcgacacccggcgccagcgggtcggcgacggtcgccccggtcgcctcgccgaaaatctccttgaaggtggacagcgccgatttgagccgccggacggagacccgcatctgatgcacgccttcgggcagccccgcccgcaccgcaggctcgttggcgaccagctggcccagacaggcgcgggcgatcgcccggaagccctcggccgcggtcatgtcggggtcaagcgcgacgggggcggccttctcggcggtcacctcgtccgcggcagcggccccggcgaccagggcaaaaccgcgctccgatttgggcggcagcagcggctgcagccgcacccggtcgagcagggtgagcgccaccagatagagccggtcgggcgtgccctccagcaggcggagttcgatttcggcaaccggcagccggtgttccgggtcttcggcgtcggcgatgctgccctcgtcgatcaccagttcgaccgcccagccggcatcacccagccggtgcaggctgcgcctgagatcggtgacgaaaaccggcctcagcgcagcggcaagttcggtctcggtgcccagtacccccagcggcgtgccggtcagcagccggaggtccggccggtcgtcggccaccgcatcctcgaatgcgtcgcgccggatcagggccgagcccgccggcggctccatcgcgcatttcaccgactgcacatggcgccggccgatggtgaccaccttcaccaccgcgccgcggtcatgaagctgcctgtcttcggtatcgaaatagaccgcgctctgcgaccgggtcaccggcttggcaagcctgaggtcacgcagggcgcggtgctgccggaggcatttcagccccgcgggatcgagggcgaatttcagcccgagttcgacgcgatgcatgggggcaggtttcctgtgagacccggaacgattggggagatgcgccggaacgggcgcaggctgcgagaccgggcagggaccgcatgacacgcaagcgattatgcctgctgccggccacgtccgccagtgcacgcaatggcgtcgaagggtcgcagccggtggtcgcagagcgccgtataatggaaacatgcgacataacgatgagaatttattgacaaaatgtcgggaaaacaatttcgtcagagtgaggtgtccaatcggacgccggccagcaccgccaggacggggcggtgcgatgcatccggccggggcgggtcgggatgccgggtttcatgggagcaccgatgacgcaactgagccgagatcaccagctcgacggccccctgctcgacgtgcgctccctgagcgtccgcttcggatcgaaccgggtcgtggacgacgtgtcctttgcggtggcgcccggtcagacgctcgcgatcgtgggcgaaagcggatcgggcaaatcggtcacctcgctcgcgatcatgcggttgatcgaccacatgaacggcaccatcgatcagggcgagatccgcttcggccagggggcggatccggtcgacatcgcccgcgcctcccaggacgagatgcgccggatccgcggcaaggacgtcgcgatgatcttccaggagccgatgacctcgctcaacccggtcttcaccgtcggcgaccagatcgccgaggtgctgatgctgcacgaggggctgccgaaatcccgggcgctgaccgcagcacgggagctgctggagatggtccgcctgccggatgccgccgcgatgctgaagcgctatccgcatcagctgtcgggcggcatgcgccagcgggtgatgatcgccatggcgctggcctgccggccgaaactgctgatcgccgacgagccgaccacggcgctcgacgtcaccatccaggcccagatcctgtcgatcatccgcgacctgcagaagaagctgggcatggcggtgatcttcatcacccacgatatgggcgtggtggccgaaatcgccgaccgggtggtggtgatgtggcgcggccgcaaggtcgaggaaggcccggtcgaagagatcttcgcccgccccgcccatgcctatacccgggccctgctttcggcggtgccggcgctcggctccatgaccggcgagcccttccccaagcgcctgccgctgacggtgatggatggcgagcagtcgcgggtggtgggcgtcgagagcatccaggacaccgcccgctatgatcaggcgccgatcctgagcctgcgcgggctggaagcgcgcttcgacgtgcgccgcaacctgcttggccgggtcacccatcgggtgcatgcggtggaaggcgtcgatctggatctctggccgggcgagaccctgtcgctggtgggcgaaagcgggtcgggcaagtcgaccatcggccgcaccatccagcagcttcaggacccgaccggcggcgaggtgcgcttcgaaggccggccgatgtctgagatgtcggcccatgaacgccgcaggctgcgccgccaggtgcaatacgtcttccaggaccccttcgcctcgctcgacccgcgccggaccgtcggcttctcgatcgccgagccgatcaccacccacgggctgatcgacggcgcgaaggccatccgcagccgggtcgccgaactgctggaacgggtggggctgaagccggaattcgccgaccgctacccgcatgaattctcgggcgggcagcgccagcggatctgcatcgcccgcgcgcttgcctcgaaaccccggctgatcatcgcagacgaggcgctttcggcactggacgtctctgtccaggcgcagatcatcaacctgatgatggaattgcaggccgaagaggggctggcctatctgttcatcagccacgacatggcggtggtggaaaagatcagccatcgggtggcggtgctctatctgggccagatcgtcgagatcggctcgcgcgccgcggtgttcgaacgcccgatgcatccctatacccgcaagctgctgtcggccgtgccggtcgccgatccgacccgacgccccgaccggccgatgctcgacggcgagatcccgagcccggtgcgccgggtcggcgatgcgccccggatcctctccctcacatccgtggcccccgaccacaaggtcgccgaaacggcatgaaccgtgcccgcatcaagggccggggccacgtcctgaccagcagccgacccgatctgcccatccgaccgggccggccctgaggccaacgtccactcgcattccacgcggagacgacgcatgagacatctccagaccacgaaacgcctgctgctggccgcggcgctggcggcggccctgcccttcggcatggcggcatccgcctctgccgccggcaccctgacgctgtcttccccccaggatcccggcagctgggacccgatcgacaccttcctggtcaactggtcgtcggtggcgaccaacgtctatgaaggcctggtctatcgcacgcccgacctgaagatcgtcccggcgctcgccaccagctgggaggttctggacgagggcaagcggctgcgcttcaagctgcgcgacggcgtcaccttccataatggcgagcccttcaccgccgaagcggtgaagttcaccttcgaccgcctgctgggcgaggaaggcaagaagggcccgcagcgttccaactacgcggtcatcgaccgggtcaacgtcatcgacgaccacaccgtcgacctggtgctgaagcagcccgatccggtgctgatcaccaagctcgccggctatggcgcgatgatcgtgccgccgaaatataccgccgagcatgatgaggcctacatcaacgcccatccggtcggcaccggcccgttccgcatgaccgcctatgaccccaaggtctcggtcacgctggagcccttcgccgactattgggacggcgcgcccgccctcgacaaggtcacctaccgcttcatcgccgagcccgcgaccgcggttgccgagcttcaggccggccgcgtcgacgtggtgatcccgccgaccatcccgatctcgatggtcgacaccatcaaggccgatgcgaacctgaacctggtcagcgtcaccagccccacggtctatgcgctgcgcttcaacacccgcgacggcatcaccgccgatccgcgcgtgcgcaaggcgatgatcatggcggtggaccgcggcaccatcatcgatgccatcctgggcggccaggccaagcagatcgccagcttccagtccgagctgtccttcggctacgacccgaacatgaagccgctgcccttcgatcaggcgaaggcaaaagagctgctgacggaagccggcgtgaagccgggcgcagaggtgcagatcgacatccgcggcaacgacgccaccttcgccgaggtgtcgcaggcggtcgccagctatctgggcatggtcggcatcaacgccaccatcaagccttacgagaccaatgtgctgctgaacgacatcatcccgcagggcaagaccggcgcgatgttccagcagaaatggggcggctggaccctcgactacgacaacaccgcctatctgatgtaccacaccggcgagcgctggaacccctatgacagcgatcccaagctggatgcgctgctggagcgtcagcggtcgatgaccgaccccgcggcacgcgaaaaggtgctgcacggcatcgccgcctatgcggccgacagggcgctggaaatgccgctgttcaacctgaacgaaatctacggcgtctccaagcgggtgaagggcttcgtggccccgccggacaaccgcatccgcctgaccggcgtgacggtggagtgagtcgttagtttagtcccttgccgggcgggtgctccgcacccttggccgccgcctcaatggcggcttcggtggccggtttccggccaccgcctgaacacgacttgtgcctgggcacttgccgggcgggcgctaccgcgcccttggccgccgccgcaatggcgagagtctgtttggccctcgccgggcgggtgctccgcacccttggccgccgccgcaatggcgagagtctgtttggccctcgccgggcgggtgctccgcacccttggccgccgccgcaatggcggctggggcgcgaagcacccggctttcggggcagcacggcgcctggcgacaagtaccatcgcggatctgccgggccttcgggtccggcgggtctttcgtcgatccatcctccggaggctgacccttggccggctttctcctcaagcgcctgttgcaggcgatcttcgtcctcttcgccgtgacgctgacggtgtccttcgcgatccgcctgaccggcgatccggcgctgatgctggcgcagggggcgggcagcgtcacccaggaggatctcgacaacatccgccaggcgctgggcctgaacgagcccttcctgtcacaatatctcgatttcgtcaccggcctcgtcaccggcgatctgggccgcagcttcctgggcggcacctcggtgtctctgctggtttccaaggcgctgccggcgacgctggcgctggccttcacctcgatgatcgtctcgatcgcgctctcgatcccgctcggcatccatgccgcggtcaatcgtggccggccggccgatcaggtgatccgcatcctgtcactgaccggcctgtctttcccgaatttctggctggcgatcatgctggtgctggtcttctcgatcacgctgcgctggctgccgccctcgggcatggacgggatcctgagcttcgtgatgcccgccgtcaccatgggcatcatcctgaccgcgaccaatgtccgcctggtgcgcaccgccatgctggaaacgctccgcgcccagtatgtccaggtcgcccgtgccaaagggttgagcgagagcaaggtgctctacaagcatgcgctcaggaactgcgccattccgctgatcacctatttcggcctccagttcggcgggctgctcggcggcatcgtggtgatcgagcgggtgttcaactggccgggcctcggcacgctcgccttcgatgccgtcgccgggcgcgactatccggtgctgcaggcggtgatcaccgtgctcgccctgctcatcgtcgcgatcaacctgctggtcgacatcgcctatggcctggtcgatccgcgcatccgcacccgctaggagacgagacccatggcacgcgcccgcacgcataaaagcggcccgcagctggagctggtcctcggcctcctgctggccggcggcatgaccgccgcggtgctgctctcgccgctgctcttccccgatggcggcgagaagatcaacctgatggcccggctgaccctgcccttccagacctgggcccatccgctcggcaccgatccgctcggccgcgacgtgctcgcccgggtgatcaccggcggcaagatctcgctgctggtcggcttcacctcggtggtgggcgcggtggtgatcggcgtggtgatgggcctggtcgcgggctattaccgcggcttctgggacatggtggtgatgcgcttcgccgatgtgcagctggcgctgcccttcatcctgctcgccatcaccttcatcgccatcgtcggcggcgggctcaccaacaccatcatcctgctgatcgcggcccaatgggtgcagtatgcccgcctggtccgcggctcggtgctttccctggtcgatcgcgaattcatccatgccgcgcgcgcgatcggcgtgcgggacgtgaagatcctgttcatccatctgctacccaatctggcggggccggtggtggtgctgatgaccctgaacgtcgcgaccaacatcctgctcgaaagctcgctcaccttcctgggcctcggcgtcgacccgaccattcccagctggggcggcatgctcgccgacggccgcacctatctgcagaacgcctggtgggtcagcgtcttccccggtctcgccatcctgctgaccgtcctgggcctgaacctgctgggcgactggctgcgcgaccgcctggaccccaccggccgtacccaggcctgatccaccttctgctctcccgccctctccggagccggacatgacgctgctcatcgaccagaccttcgagcgcaccctcgaccggctgctcgccacctacgccacccccgactggcagggcgccagcctggatgcctggctgttcgaggatgccggccagcgccgcgccgccgaggcgcggttccgggcggccggtatcgatgcccggctgcacccggcctacaagccgctgatcggcttcttcatcgaggacgcccgcgccaaaggccccttcacccgggtggacctcggctatccggtggtgcccgaggcgggcgagaaccgcttccggctggaggcctatccgctggccggcatgatcggcgatgcccggctggatctggtgcccgaagccgtggcgccgggcaccatgcccgtctaccggctgcggctggaagcggccgacggcagcctcaccgacctcaccctgcccgcccccaaccatctggcggaagatcatgcaggcgaaatgcggctgtcgccgaccggctggctgaaactggcccatcccgatggccggcggatcgaccagcggctggaaaccgattacgaggcgctgtttcaccgcgccatggcggtgatcgcggcctgggactggggcgcggacgaacccttcttcgagacgcttgagatccgcgtcgagctgcccggcgccgatacgcgcctgccggtcggcgaggaggtgatcagcctgcacgaggcgctgcacgaggagctgtatttctcgctgctggaacatttccagcgccggtccggccggccgatcggcgcccgcgaccttcagcccggccggatcctgcccgagatccgcggctctgacgggctggtccggctggtcatcgagacccggccgctggatagcggcgaggccgactggcccgaccagccgctgcacgaggccgaagcccccttcggcatggctcagatcagggccgaactcgaccggatcggcggcgaggtcttcgtcgccggctcgcgcgcgggccggccggtgctcgcccgccatcgccagggcagcgatcatccggtgatgatcagcggcggccagcacgccaacgaggtctcgggcgtcgccggtgcgatccgtgccgccgccctgctcgccgatcgcccgaccgcgcatttcaccatcgccccggtcgagaaccccgacggctatgccatgcaccgccggctgacccgaagccagcccgaccatatgcatcatgcggcgcgctacaccgcactcggcgacgacctcgagtatcgtggccagaccgggccgctctacgaggctgcgatccgggtggaggcacgggcgcggaccggtgccgacctgcatctcaacctgcacggctacccgtcccatgaatggacccggccgctgaccggctatgtgccgcgcggtttcgagatgtggacggtgcccaagggcttcttcctgatcctgcgccatcatccgggctgggaagaccgcgcccgccggctgctgacccgggtgaccgccgaacttgccgacctgcccgaactggccgccctcaacgcccggcagatcgcgctttacgaaatccacgccggccggctgggtttcgagatgatcgacggcttcccctgcatggtctcggaacagccggcccaggtgccggcggtcacgctgatcaccgaatatcccgacgaaaccgtctatggcgcggccttccgcctggcccatgaggcccagagccgggcggtgctggcggcctatgatgcctggcaggagatcatgaccggcgccgactgaggccgccccccgtcattccggcccctcatcgcagacccagatcgtccagcacctggcgggtgatctgacggcggcgggtctccgcagccggtcccgtgccgcgggcctcgcccgtggtcaggatgcgcgagatccgccccggatgcggccgcatcaccacgatgcggtcgcccatccggatcgcctcgtcgacgtcatgggtcaccatcaccgccgtcaggccttcgctccggatgatgccggccacctcgtcctgcagccgacgacgggtgatggcatccagtgccgcgaagggttcgtcgagcagcaggatgcgcggtcgcgcgaccagcgcccgcgccagggccacccgctgcgcctgcccgcccgacagctgccccggccaggatcgggcatgggcggagagcccgacacgcgccagctccgcccgtgcccgcgccagccgttcccggcgcggcacgctgtgtgcgaccagagcatgggcgacattgtcctcgaccctggtccacgggaacagtcggtggtcctggaagacgatgccgcgatcggtatcgggcccgtccacgagccgtccatcgacgagaatccggccggtgtccggtcggtcgagccccaggatcagccggagcagggtggatttgccgcagcccgaggcgccgaccacgaccagtgtctcgccaggggcggccgcaagcgaaatccccgacagcacctcgacctcgcggccatcgagcgggaagcgccgcccgacccggtcgagatcgagcgccgcgccgcgtgccgcgacgaccggcggatgcgcagtcgccgcagcatcggcgggatccgcatcgggcagggcaaagaacggaaaatcgatcggacgggtctcggacatcacgacgtcctcctgaaaacggacgggctcctgaaaacggacgggctcctgaaaacggatgggccgctcacggccccggtcgggtgtcgggtcagcaggcgggtcagacgccgggcaagcagggtctgtgcggtaccgagagcgccgagcagcaccacgcccaggatcaccacctccatctgcatatgttcacgggcaccgctcatcagcccgccgatgccggggccgaccgtcatgaagtattcggcaccgatggtcccgagccaggcatagatcaggccctgatgcagaccggtggcgatggccggtgccgcggccggcaggatcaccgacccgaaccgccgcaatgggccgaagcgcagcacggcggccacttccagatgcctggccggcacggcggcgacaccgcttgcggtgttgagcaccaccggcaccagtgccgccagggcaatgaaggcgagcttggccgcctcgccgacgccgaaccacatcgagatcagcgggatccaggcgaagacggcgatctggcgcagggcatcgaagccgggcgccaccagccgggcggcgatacgcgacagccccagccatgtcccgagcggcaggccgatggccaccgcgatcgcaaaaccgccgagatcacgggcgagtgtcgccgacagatcccgtgccagactaccgtcaccggcggctgcaaggaacgccccgaccaccgccgccggggccggcagcaggggatggccggcaaacacggttcgtgtcgccaggtcccagaggacgagcaggagtaccggcaggatcaggcccctcatgacccggtcccgatcttccagcggtccaggcggcgctggatcaggccgagcatgcgatcgagcaccagcccgatcaggccgacctcggccatcgccaccaggaccatatcgagctggaaaagctggcgcccccagaccatcaggtagccgaggccttccgaggaggcgagcagctccaccgccaccagcgccgcccaggcgtggccgaggccgctgcggatgccggtgaagacggatggcaccgccgccggcagcacgacacgtgtgaggctgcgcagcggaccgaagcccagcacccggccgagatccagaaagcccgccggcacggcccggatgccgtcgagggtgttgagcgccaccggcaccatggccgccttggcgatcacgatgacggtcatgggctcaccgatacccacggccagcatgagcagcggcagccagcccagggccggtacctgggcaatggccaggaacaacggctccaccagccgccgcagcccctccgacagacccatcagggcgccgagcacgaggcccgcgagactgcccagggtgaagccggctgcgacccgggtcaggctgaccgcggtgtggtggccaagctcgccatcggcaatcagctgccgggccgtgtcgagcacgaagcccggctcgggcaggatctggatcggcaccagcccgatggcggaaccgacctgccagaccagcagtccgactgcaggcagaatcaggccggtgagcggctgaaggaccgtgccgaacagacttgcaccgtgctgccggcgggtgcgggcggccggtaccgccgggtgaatgaccgtgccgtattcggtttcgatcgacatgagctgtctccgccggtcatgagccgcccccggcgatcaccgcaccggtggcatcgtgtcgcggccagagccggtcggcatcgatgcccaggtcacggatcgccgtctcgacatagtgaggctcgaaccagccctcgatatcgaccgggcggcgaatcagtccgtgcttgcgggcggcctcggcctgatcggcgtagcgggcgaaaagaaaggcgtcgagacgcgggttggagcgttcggcaagcggggtgccgtcgaaatcggcgcggaagatgccgaccggcacgcccgacagaccccagatccgaaacagttcctcgcgattggcctcgtccgacgcccaggcggcggcgcgcaccaggccggtcacgatcttctggacgatctcggggtgtttcgcctcgaaagcccgggtcaccagcagatgggcatggcgggtgaaggccggatcgtcacccttggtgttgtagacgatccgggcgatgcccttctcctccagccccaggaaatccgcctgaccaaaggcggcatcgatatcaccggtcgccagtgcggccgtcgcggtcgggaagtccatgttgatgaacttcacgtcacgctcccccagaccatgggccgccagcaccttgtccgtggcgagctggaggttggtgccacggaactgtgccaccttgcggcctcgcagatcctcgaccgacgtgatgcccgaagcgggcgtggcggcgaggtagagattggaccggatgccgctggcggcgatgatccgggtttcgagcccgttggcccgccccacgatcgacggcaggtcgccctggagggcgaagtcgagctgaccgttggcgatcgcctcgttcaccgcagggccggcacccttgaagaacgaccagcggagccggacctctccctctggaaaggcgtcgcggagataatccccggcatgaaccacggccagcgtgttgccgctgccgtattcccggttgccgacaccgatctgagcgaagccgatccggacctcgaccggttcggcccgggcgggcgtcgttgtgacaaaggcggtgaggaggccgaagccgaccgcgaggatcgcggccagcttcggcccggcaggacggcggcgcatgcccgtcattccgccgccgcctgccggttcagcacctcttcaaccgcggtgccgcggaagaaggcggggttggttccggcatagaagcgataggggttttcaaacaccagactgcggaaattggcctcggtcagggtcccgcgctcgaccagatcccaggtctcggccagaaccaggcgcagatccggcacgtcccaatggccgctgtccgaggcccagaacgcattcagctccacgcccagcggattgacgcgggtgttgaaggcatgggccacggtcgggtcgtcggcctcggagccgaaatagaagttcggcacgaagcggtcgcggatatcctcgatccgctcgatgccggccgcggcgaagtcgtcgagcgcgttgcggtcctggggaatgcgacgggcctgattggcgccgaacgcgacctctgccagatcctgagccgagcccagccgctccagcaccggcccgtcggcatgaagcaggtaaagatcgtggagcagatccgcatccagccggtcgggatcgtagcggccgatgaagggggccccgcgcttttcccagtggccgaccagatcggcatagagcgacgatgcgaagcccgccccgccttccagcagccccagccgcagatcagggaaacggcgggtgacgccagcgaagaagagtgatttggcgagcgcttccgacgcggaggcgaaatggccgatatggttgtacatgtagttcgaccaggacgaccggctggtccagcccatgccgatcgaatgggtggtcagcggaaccttcagctccaccgccttcgcccagaacggatcatagtcatgggccgaatcgacgccgaaagtgtcgagccaggtggtatagcggacgagatccgggaaggcatcgcggggatagcggcgggcgagttccgggatcggccggcgcagattgcccgggatcagcgcgaccttgaggccgagcgtgttgaccgcgaactccagttcctcgatcccctcctccggtgtatgcagcgggatcgccgccaccggggtcagccggtcggcataggggcggaagacatcggcattgtaggtgttcaccgcgcggatgatcacccggcgcagctccggatcaccgatatgaaccgcaaaggtcgagatgttgggatagagcaccgcaaaatcggtaccgctttcacccagccgctcgtgcagcagccgcgggatggataccgtggcaagatcgagcgtgttttccgacggcagagcccaccacggcggccgtggtgcggcacggtcgcggcgctcgtcgggggtgagggcataccagtcattgccgagctggccgaagccgcggaccagcgccgcgcgccaggcgtcgaccgcgcgggcgccgccgatgtcgtcgatataggcctcgaccagcgggccgtattcgacggtgtgcaggtcggtgtcgatcacgggatggtcgagcaggtcgcggatcttcgccgagggtgaacgctccgcgggcgaaattctgcggccagacggcctggacgaccggggggtcggagatgaaaaggtcatggacagggcctccttggtgatgcctccattaaacagtctatattttctgtagaaaaattagatattcttcccagaacggcaaaatcaggctttcaacgcccaagcctcgtgaatttccagagtgccgtgaattgccggaagaccgccaatcaaccgccaatcaacggagagctgcgccatgaccaccccgtctgccgtatccggtgcgagcctgcggcgcctgccaccgctgacgtccctcagggccttcgtcgttgccgcccgccagctcagcttcacggcggcggcggacgagctgttcgtcacacctgccgccgtcggccagcagatccgccagctggaagcccatctgggccggccgctcttccgcagggtcggccgcagccttcagctgacggaggacggacgcgatctgctgcccggcctggcacgtgcctttgaaaccatggtcgaaacccttgcccgattgggcgaagcggcggatgccgccacggtccgggtctcggtgcccccggccttcgccgccaaatggcttgtcccccgactggccgacttctccgccagccatcccggcgtggggctgtcggtcgccgcttcgatggctctggtggactttgcccgcgaggaagcggactgcgcggtgcgctacggtgcgggacaatatcccggcatgcatgtcacgcggctgatgaccgagcgggtggtgccggtctgcgcccccactctgatcgacgggcctgaaccgctggaccatccccgccgcctggccggccgcgtcctgcttcatgacgatgaactcagggacgatcccggctgccccgactggcggatgtggctgcgtgcagccggcatccgggacatcgacgccacccgcggcccgcgcttcgaccagtcgaacctggcgatcgaggccgcgatcgccggccagggtgtggccctgacccggcttcgcctcgccgaggccgacctcgccgccggccgcctggtccgacccttcggcggcgcggtgccggtcgacttcgcctactggttcgtctgcccgcccgaacggctggatcgcccaccggttcaggcttttgcaggctggctggtcgcgcactgcgccaccctgtgacacagtattggataatttaagaataattctaacttgcaaatcttgcggcgaagcgtagatctgagaatgagtatcattctctgatgaggccccgccatgggcatgcgttccatcgccgccgttctgctcgccctcgtaatgtccggcgccgcggccctgccggcgcaggcggcggataagctgaaggtgctgaccaccttcacggtgatcgccgacatcgccgccaatgtcgcgggcgatgcggccgaggtcgtgtcgatcacgaagcccggtgccgatatccacacctacagccccacccccggcgacatccgtcgggccctgggggcggggctggtgctacgcaacgggctcaacctcgaactctggttcgagaaattcctgcgcaacctgggcgaggtgccggccgcgaccgtctcggacggcatcagcccgatcggcatcaccgagggcccctatgagggcaagcccaacccgcatgcctggatgtcgcccgaggcggcgaagatctatgtcgccaatatccgcgacgccctctcggccgccgatccgggccatgccgcaacctatgccgccaatgccgccgcctatacggcccggatcgatgcggtggcggcaccgatccgcgaacggctggcggccctgccgccggaccggcgctggctggtgacgagcgaaggcgccttctcttatctcgcccgcgatttcgggctgaaagaagcctggatctggccgatcaatgccgatggtcagggcacgccccagcaggttcgccgggtgatcgacaccgtgcgcgagcatcagatcccggtggtgttctcggaaagcaccgtctcgcccgatccggcccggcaggtcgcccgcgagacaggcgcgcgctatggcggcgtgctttatgtcgacacgctgaccgacgccgacgggccggtgccgacctatctggacctgcttcgcgtcaccgccggccgcatcgccgacgaactctcccgtccctgatccgacaggatgcccgtgcgatgaccctgtcctttccccgcaccgccgcccgcgcccgcgcccggttccccgaaaccgtcgccggtatcgaggtcgagggcgtcaccgttacctatcgcaacggcctgaccgcgctccgcgatgccggcttccggatcccgcccggcagcatcaccgcgctggtcggcgtcaacggtgccggcaaatcgaccctgttcaaggcgatcatggggctgatccggccgcgaggcgggcggatcagcattctgggccggcctgccgcccaggcgctcaaggccaatctggtcgcctatgtgccgcagagcgaggaggtcgactggaccttcccggtgctggtggaggacgtggtcatgatgggccgctacggccatatggggctgatgcgccgggcacgcccgcgcgatcatgccgccgtcgcggccgcactcgatcgggtcggcatgaccgccttccgccgccgccagatcggcgagttgtcgggcgggcagaagaagcgggtcttcctggcccgcgccatcgcccaggatgcccgggtcatcctgctcgacgaacccatgaccggggtggatgtcggcaccgaagaccagatcatcgccctgctcgaagccctgcgcgacgaaggccgggtgatgctggtctcgacccataatctgggcagcgtgcccgaattctgcgaccgctgcgtgctggtgaagggcacggtcctggccgctgggccgacggccgaagtcttcacccgccgcaatctggaagcggccttcggcggcgcgctccgtcatgtggtgctggaagcggccggtgccgacggcgggtcgctgggcgtgatcaccgatgacgagcggccgctgctgctgcgcggcggccgcgccgccacccgacgtgatggctcgggggatgtggaggtgccgcgatgagcctgctgctcgaacctttcgcctatgactacatggtcaacgcgatctgggtctcggccctggtcggcggggtctgcggcctgctctcctgctatctgatgctgaagggctggtcgctgatcggcgatgcgctgtcccatgccatcgtgccgggcgtggccggcgcctggatgatcggcctgcccttctcgctcggggccttcctggccggcgggctcgcggccggcgcgatgctgttcatccgccgccgcagccgcctgaaagaagatgcggtgatcgggctgatcttctcggccttcttcggcctcggcctgttcatggtctcggtctcgccggtgcccgtggacgtccaggcgatcgtgctcggcaacatcctggcggtgacgccggcagacacccttcagctcgtgttgatctcggccgtcaccctggccgtgctggcggtgacctggaaggacctgatggtggtgttcttcgacgaggtccatgcccgctccgtcgggctggcggtcacccgcctgaaactcatcttctttaccctgctcgccgccgcaaccgtggccgccctccagacggtcggcgcctttctggtgatctccctggtggtggcacccggtgcaaccgccttcctgctcaccgaccgcttcccaaggctgctgatcatcgccggcctgatcggatcgctcaccagcctggccggcgcctatgtcagctatttcctggacggcgccaccggcggaattatcgtggtgctgcagaccctggtgtttctcgccgccttcgtcgccgccccgcgccatgggctgatcgccgcccggcgccaccgcgcctcgccggagggaggatcggtcgcatgaacccgatcgacgccctgatcacccccttccgcttcgccttcatggcggatgccctgatcatctcgctgctggtggcggtgccggcggcactgctgtcctgctttctggtgctgaagggctggtcgttgctgggcgatgccatctcccatgccgtcctgccgggggtggtgatctcctacgccctgggcctgccctatgtcgcgggcgcctttgtcgccggcctcgcctgtgcggtggggaccggctatatccgcgaccattcgcgcgtcaaacctgatacggtgatgggcgtggtctattcgggcatgttcggcgcggggctggtgctctatgtctggatccgcccggatgtgcatctggaccacatcctgttcggcgacatgctgggggtcgcgcgtgccgacatcctgctcaccggcgggatcgcactggtgaccaccgcggcgatcgccgtcaaatggcgcgacctgcagcttcatgccttcgatccggtgcaggcacgcgcagtcgggctgccgacccggcttctgcactacggcctgctctgcctgatttcggcaacggtggtcggcgccctggccgccgtcggcatcatcctggtgatcgccctgctgatcgccccgggcgccatcgccctgctcgtcacccgcagcctggggcggatgctgctggtcgccgtggcggtggccgccggcgcctcggcagcgggcctcatcgccgccttctacatcgatgcggccccggcaccgaccatcgtgctgctgctggcggccggcttcgtggtggccttcgccatatcgggtcaacgggcggcgatcgcggcacgcggctgacatggcgccgtctgcggcgcccggctattctgggcatcgtgcggcccgcccggtgccgcggccaggacccggggtgcggcgcgcgcatgaagcttcttctcgccgatgatcacgagatcttccgcgatggcatccgcatgctgatcgaggcgcgcaccccgcatcgcatcgtctgcgagacggcatcggggagcgagatcggccggctggtccagacccatgcccccgatctggcggtgctggactatcagatgccgggggccgagatcaccgcggtgaccgcctggctgaagaagcggtttccggcgctcaggatcgtgatcctgaccggcaccacctcgggcgtgctgcatgcaaggctggtcgcggcgggcgccgatgccgtgctgcccaaggcgggcgatgccgaaaccctgctgaaggcgctggaggcggtcgccgccggccggcaggtgctgccccaggcgatccgcgaggggatcgcggccggggcagaggcgctgtcgctcacccagcgcgaataccaggtgttgcggctggtctgccagggattgagcaatgccgagatcgccgcccgcttcaacctgtcggaccggaccatcgccaaacatcgcgagaacctgttccgcaagctcggcgtcggcagcgccgcccaggcgatcaaccgcgccgccgaactggggctgatctgaccgtggcggccgggatgctacggctgctgacgatgatcccgggcctgctgccgctcgtcttcgccgccgctgccatcgcctcgcccgcaaccgggccgctgcgctggaccgccctgccggtcgagacggcggcggcgggggaggcggcggcgggagatttcgtgctgagcttcggggttgccgatgccgaagcgctgatcgtccggctcgaccatgacggggaaagccgcctgctgctggtccagacccccgacagcggcttcgccacccgcccgatcgcggcaccgatgctggccatgcccgtgcagcttccgcccggcatctcgaccctggtgatcggctaccggctgcatgccgacaccccccttcagctcaggctccgcacggccgcggattacgaccactggcaggcgacgcggcatctgctcgacggtgtgctgcttggcctgttcgtggcgatgatcctggtggcgctgctgcatttcttcgccctgcgcagcccggaatacctgctctatgtcgcgacctgcggcatggtgctcgccttcctggcccagatcggcggctatggcttcatgtatctctggccggaggcgccgggctggaaccaggtggcaccgatcctgttcatgggcggggtgcagctcgcccatctcgccttcaccatccgtctgctcgatctgcgccggcgcgcgccacttctgcgccgggccatgctcctgatcgtggcggcggtgccggcgggcttcgcggtcttcttcctgaccggaacgctggcgccgctcttcgcgctctcggtgctctacacgcccctgctgctgatcgcaggtctgggggcggtgcgggacggggtggccggtgcccgcttcttcctggctggtgccgccgcgctggtgctgttcgtgaatctcgccttcggggccggggtggtcggcggggttccgctgcccgggggcgatgttttcctctatcccaagctcggctatctgatcgaggccgcctgtttcgccggcgcgctggccgaccggctgcgggtggcgcgggcacaggccgaaacggcgctgcggctgcggctgatcgatgccgaggaactcgcccgcgccgaggccgggaaataccaggcgctgcgcatcgctcatgaccggcagctgcaactcgccgcctcgggccacgatctcgcccaacccctgcaatcgatccgcctggccctcaccgccatgcgcgacgacgaggacaaccgccggatccgggcgcatatcgaccgggcgctcgacctcacccggctgatgatcgacgagctgatccagggggcccggcgcgcacccgccgtgctgccgctggatctcgccgaggtgttcgaggatctggccgaacgccaccgcccccaggccgcggcgcggcggatgcggcttcgcatggtgccgacgaccgcccgggtcgaggcctcgcagctggtgctgacccggatcctcgacaatctgatcggcaatgcgctgcgctatggccgcagccgcgtggtggccggggtgcgccaccggccgggtttcctgtcgatcgagatccatgacgacgggccgggtatcagcccggcagagcgcgaccgcctgctcgcccccttcgtccagggcggcggccaggccggggccgagggcttcgggctcggcctgcacatcgtgcagcggctgtcggcccagtccggcttcgggctcgacatccgcgcgcgccccgggcggggcagcgtgttcacgatcagcatccctcgcaagccccgctgagccgcgaaaaccgcgcccgccccccgcgaattacgcgcctgagcgtattcatcgcccccggccccgcggcctagtctgccgccatgacgacgcgacgggcgttgcgggacagacggggacgagaacgatgctgagtgacatctggcggggaatggtggcccttgcggactggcagggctggctgcggatcgcaaccggacgacccgaggtcgacgtggtgttcatcaccaatctgcgggacgaggccgaccggcggcgcttcttcggccgcaaggcgccggtattgggccatgccaacgggccgcgcatgcatctggacggtgtcgccggccgggtgcgcggcatctatgtcacggcggccgagatgatgaccagggacggccgccgcgaggcccgcgaccgcttcatcgccgcctgccagtgggcagaggcccgcggtgcccgcacggtgctgctcgccgcctccaccaagcggctgttcggccgcgacggccgggcgctgaaagagatgttccccaacctggtcttcaccatcggcgacaacggcacctccagcctgctgatccgcgacgtccgcgccgccctgtcgcgggcggatctcgcccccggccgggcacgggtgatggtgatctgcccctatggcattctgggccggatgatcacccgccggctggtcggcgacggtttcgaggtcgtcggctatggcgccaacccggccgccctggccgagaccgccgcggagttcggcatcgccaccaccaccgatctcgatcgggtgggccgggtggacgcggtcgtggcctgcacccataacgacgcgtcgaagctgacggctgagggcatcgccatgctacgccgccccggccgccgcctgctggtggtggatgtggccgagccggccaatctggatcaggcggtttacgaacgccagacggcggtggtggtgcgccaggatgccggcaacggccatgccccggggctgcgctatgtgctgggcgccttgtcgtggcgcaagctcaccctgtcgcgcggcgtggtcttcggctgcttcgccgaggccatgaccctgcaccacgccatccaccgccagggccgcaccgacctcgccgcccgcgactggttcgtcatcgacgacgccaacctcgccgaggtcgaaaccctgatgaccggcatcggcttcgaaccccctgcaccacgctgtttcgggcggccggtggagagtttccggctggcgatcaaagaggtggacgagttgccctcctcagcctctccgacagttccagtcagcgtcagctgaaggccgcgatgaccgtctcgatcggaagcaggagcaggcggctttcttccgggtactcgatgaaatcagcgcagttcaggtagaagcgcctggcgcgttcgtccttcgcctgtacgagcacggcacttatgccaagggtgcgagatgcggcggcgatacgaccaaacgcgtccaacaacagatcggcgccgaggccctgcccggcgtgatccaggctgaccgccagacggccgatgaccgacacaggtatcatgtcgggggcattccgacgcagcttgccgggaacggcagcacgcccgagagcccccgctgaaatgcagtaatagccaaccaccttccggccgcggcacatcacataggttcttgagaaacggccttcgttgcggagggcacgatgccgcagccaggcatccagctcaggcgtcccgcaactaaaagttgataaatcatgctcagggctgaggggctggggagaggtcagcgcctctccaccctcgatctcgccgcctatttctcccatgccggtgtccgcttgacgagtttgcggagcttcggtccgggcgcggggggattgtcgagcacctgcagaaaggcgtcgtaacgcgccggatcgagcagaaagagccgctggtcgaggatcacgtcaatggcgagactgcgggcactttcgaccatgaactcggtgcgggtcttgcccagtgcctgcgctgcctcgtcgataagctgccgggttccggcatcaatcctgagattgatgctggccttggcatccggcgcagcgccacgctccgcaactgtggtcgcgaaggcatccggagcatcatgcatggcgggtctgcggatcctggtcatgatccgaatatggctcggcgtatctacatcgtcaatacgccgctcaccaagacgctgaagccgcagctgtcaaggtgttggcgaagaagggccggacaggtcaccccgtccggcccgtcgcttgcggatctccgtccccgcggtcaggcggtagcgaatttgccggccagggcgtcctcgatcaggcggatggtctcgggccggccgtagagctggatgaacgagcccatgcgcgggccctgttcctggccgagcagcacttcgtagagcagcttgaaccaggcgcgcaggttctcgaagccatgggccttgcccacctcgtagacctcgtcctggatcgcctcggcggtggcgtcggccggcaggtcgccgagccttgccgccagggcctcgatcgccgcgcgctcggccgcatccggcagcttgtagcgcttctgcggcttcacgaaatcctggtaatagttcaccgcatagccgaccagccggtccagatcgggctgggtttcgggcgtcgcctcgggggcgtagcgggtgatgaagccccacagcaccgacttgtcctcggcattgcaggcgctggccaggttgagcagcatcgagaagccgaccggcggctcgcccgccggcgggttgccgccatggatgtgccaggccgggttctccagcgtcttcgccggctcatccgcggcgtggaagccgcggagatgggcataataatcgtccaccgcccgcgggatcacatcgaaatacagccgcttggcgcgcttgggctgctggaacatgaacagcgacaggctttcgggcgagccatagcgcagccagtcttcgatgctgagcccgttacccttcgacttcgagatcttctggccctcggcatcgaggaacagttcataggcaaagccgttcggctggcggccgcccaggatgcgggcgatcttgcccgacagctcggccgaggggatcagatccttgccgtacatctcgtagtcgacgtcgagcgccacccagcgcatcgcccaatcggccttccactgcagtttggcccggccaccggtcaccggctgctccaccgtcgtgccgtcctcgtcctggaagacgatggtggcggcggcggcgtcataagacaggatcggcacctgcagcacccggccggtcgaggggctgaccggcaggatcgggctgtaggtcttctgccgttcctcgcccagcgtcggcagcatgaccttcatgatctcgtcatagcgctccagcacccggcgcagcgcatcgtcgaaggcgcccgcgcggtagcagtcggtcgccgagcggaactcgtaatcgaagccgaaagcgtcgaggaaggcgcgcagccgggcgttgttgtgggcgccgaagctcgcatgggtgccgaaggggtccggcaccgcggtcagcggcttgcccagcgcaccgcgcaccagttcctggttcggaatattgtccggaaccttgcgcagcccgtccatatcgtcggaaaaggcgatcagcttggtgggcatgccggtcagctgctcgaaggcccggcgcaccatggtagtgcgggccacctcgccgaaggtgccgatatgaggcaggcccgaagggccgtagccggtctcgaacagcacatagcccttcgcgggcagttttccgtccagccgctttgccagatcctgggcttccttgaacggccaggccttggcctcggccgcgagacggcgatcgacggtcatgatgggacgcatccctgcgaaggggttgatggatgggaacgcggcgaaggtatgcgcagcggcggcaagggtcaatcgagccgatctcatacaaggccggcttcatctgcatggccgaactggtacaagacgcgaacaacccctataacctacgggcacgcccgcgcgatcgcagccatcatccctgacgaacgagccccgcgaccggaccccgatgccagcccaagacgacgccttccggggtctcgatcccgcccgcaccgacccgctgaacgcgcccgtcctggtcgcgcgtcgcggccgcggctattggagcgcgcggccgggcgagacctcgcgggcgctgcgtcccgaccgggtggcgaccgcctggcacgatcatcagccgctggtgatccacaagccggcgacggcgcgacggctggggttggaccccgtccagctcgaagccttcgacctgctggaacttttcgccttcatcaacccggcggaaaccccgccgcccaccgcgcgcggccttgccgcggcgctggacgtggagctgcccggcgccgatcccgcgggcgagatcgcctgcatccgtgccatcgcccgccggctgctcaaggtcgcctcgatcaagctgcgcctgccggaacccgccgccctgctgcacgaggcggcgcaggccggctggatctgggcccggccgctgatccaggcctcgggcgcggtgccgcccgccgacagctgggggctgagggtctggggacggctgcccgaatggcaggaacagccgcccgaaggccgtcccacccagcttggcgtgctgcccgaagaggcggtgcagcggctggagcggctgaccggcgccggcgccgagccgcgcccggaacagcgccgctatgccatgcatgccagcctgaccttcgccgcccgccatgaaggccagggcccggccctggtgctggccgaagccggcaccggcaccggcaagacgctcggctatatcgccccctccagcctctgggccgagaagaatggcggcacggtctggatcagcacttataccaagaacctgcagaagcagatcgacgacgaactcgaccggctctatcccgatccggacgagaaggcgcggcgcgtggtggtgcgcaagggccgcgagaactatctctgcctgctgaactatcaggaggccatgcgccgcaccgataccggccccgaccgggcggggctggtgctgaccgcccgctggatcggcgccacccgcgacggtgcgctctatggcggcgatttcccgggctggttgtcggaactggtcggccggcgggcgacgctggatctcaccgatcatcggggcgagtgcatctattccgcctgcgagcactatcgccgctgcttcatcgaacgcgcgcagcgccgctcgcgccgcgcgcggatcgtggttgccaatcatgccctggtgatggttcaggcggccaccggcggcgatgatcaatacggccccgaccgcttcgtcttcgacgagggccatcacctgttcgacgcggccgatgccgctttcgccgtcgacctgtcgggccgcgagggcgaggagctgcgccgctggatcgccggccgcgagacccagcgccgcagccgtgcccgcggcctgcgcgaccgggtgggcgatctggtcgccggccgcccggctgcggaagaggcgctggccgaggcgatgcgcgccgcccgcgccctgccggccgagggctggcgccagcggctggaagacggcctgcccgaggggccgttcgaggtgttcctggcccgcgcccgcggcaccgtgcttgcccgtgccgccggcgatgccgatgcgccctatgggctggaggcgccggtcgccccgccggcccccgatttcatcgtggcagccacagagcttgaagccgcactccgcctgctggaagtgccgctcggccggctgtcggaagcgctggccggcatgctggatgaagaggccgacacgctggagccgggggaccgggcgcggatcgatgccaccgcccgggcgatcagccgccgcgccgcaggcctggtcaaatcctggcgcgagatgctgggtgcggtggaagagggcccgcccgcccatcatgtcgactggctggcgatcgaccgcgccttcggccgtgatgtcgatgtggcgctgaagcggcgctggatcgacccgatgctgcccttcgcgcgggtgttcggcgaacgcgcccgcggcctgctggtgacatccgccaccctgaccggcggacggctgcccgcccgggccaaagcgacggcgcccgacggcgacggcgacccgccagccacggcggaaacccgcgacggtctggactggcggacggccttcacccgctcgggcgctcgccacattcccggcacgccgcagacgttgagcctgccctcgcccttcgactacggcgcctcggcactggccctggtggtgaccgatctgcgccggtcctcggccgaccagatctcggccgcctatcgcgaactgtttctggcggcagagggcggcgcgctcggcctgttcaccgccgtgcgccggctgcgcgtcgtgcacgaccggatcgcggcggcgctggaagaggcgggggtgtccctttacgcccagcatgtcgatccgctggacaccgccaccctggtcgacatcttccgcgccgaggaagaaagctgcctgctgggcaccgatgcggtgcgcgacggcgtcgacgtgcccgggcggtcgctgcgcctgctggtggccgaccgggtgccctggccgcggcccgacattctgcaccgggcccggcggctcgccttcggcggcagccattacgacgacgccatcgtccggctgcggctgcgccaggccttcggccggctgatccgggcgcgggaggatcgcggcgtcttcgtgctgctggacggtgccctgccaacaaggctgaccaccgccttccccgaaggcgtgacggtggaacgggtcggcatcgccgaggcaatccgtcgcacccgtgcctttctgcacccgcaagccggccaggatcgggaccggcgggacggggccggcttgcccctgcccgaggcttccggtaacaatcggggaccggcggtgccgggcacccggcaaccgggcgaccggcaacaggacaaccggcgcccggacgacatctccggctgacgacaccacctcctcatcgcatctcccgcccctcgacggttgacggtaaatggctgctcatcactccgcattgatccacaccatggttctgatctccgccgccgatcgcgagatgaccgatttcgagatgaaggcgatcggcgacacggtgcagggcctgcccgtgttccgcgatttcgacgcgaccacgctgcccgccatcgcatcggattgcgtcggcatgctccagaacgaggacgggctggatgccgttctcgaccatctggcagccgacctgccggcgaagctgcgcgagaccgcctatgcgctggcctgcgaagtggccgccgccaacggctcggtcagccaggaggtgatgcgcctgctcgaaatcctgcgccatcatctgaacatcgaccgcctgatcgcggctgcgatcgagcgcggcgtccgcgcccgctatgcccatctctgatcggcagagccggtgaacgaaaccaccccgccccgaccgtcgcgcgcaaggcgcagaccggccgcccccgccaccgaagcggcgccacgcaagcgtggccgcagggggggtgaacgggcggccgcggccatggctgcggccgaggcggcgctggtccgcgaactgaccgatccgctggccgtggtcggtatcgacgaggccgggcgcggcccctgggcggggccggtggtcgcggcggcggtgatcctggatcccgcgcgtccgatcgaaggtctggccgacagcaagaagctgagccgcaaaaggcgcgaagccctgttcccgctgatcatggaacgcgcccgggtcggcatcggcgaggcgtcggtgcgcgagatcgaccggctgaacatcctgaaggcgagcatgctggccatgcgccgcgcctttgccgacctcgatgccggcggccggccgccggaactcgcgatcgtcgacggcgaccacacccccgaactgccggtgccgacggtgccggtgatcggcggcgacggccgctcggccgcgatcggcgcggcgtcgatcatagccaaggtcacccgcgaccggatcatggccgaactggacctgatccatccgggcttcggctgggcgcacaatgccggctatggcacggccgagcatctgaccgcgctggaacgccagggcaccaccggccatcaccggaccagtttcgcgccgatcgcccggctgatcgccggtgcaccggtggagaccgagccggcagcagacgaggttgcggccgaatgaggcgccggcgcagcgacaggacgtccgctccatcgccggcagagccggcgcccatcgacccgatcgaccccgacgccgtggccggcagcgtgcttgccggcgactgcatcgaggtgatgcgccgcctgcctgcgggatcggtggacatgatcttcgccgacccgccctataatctgcagctggccgggccgctgcaccggcccaacaacagccgggtggccgcggtcgaggatgcctgggacaaattccccgatttcgccgcctatgacgccttcacccatgcctggatggccgaggcccgccgggtgctgaagccccagggcacgatctgggtgatcggcagctatcacaacatcttccgggtcggcgccgcgatccaggatctgggcttctggatcctgaacgacgtgatctggcgcaagaccaacccgatgcccaatttccgcggccggcgcttcaccaatgcccatgagaccctgatctgggccgcccgcgacgcccgcacccgctatcgcttcaactacaaggcgctgaagcggctgaatgacgggctgcagatgcgcagcgactggctgctgccgatctgttcgggccccgagcggctgaaggatggcgagggccgcaaggcccatgcgacccagaagcccctggccctgctctaccgggtgcttcaggccgcgaccgcgccgggggatctggtgctggatccgtttttcggcaccggatcgaccggtgtcgccgccaaggcgctgggccggcgcttcatcggcatcgagcgcgacccgggctatgtcgacctggcgatgcggcgccttgccgaggcgcccgagacgccggacccgaagctgctgggcggcgacggggtggagcgcgagccgcgcatcgccttcggcctgctggtggaaaccggcctgctgccggtgggcacgaagctttgggaccggcaggcccgccattcggtcaaggtccgcgccgacggtctggtggaaaccggccgcggccgcaacgccgccttcggctccatccatcagatgggggtaaaggcctcgggcggcccctcctgcaacggctggaccttctggcacacccgcgcccgcaacggcacgctgaccccgatcgatgaactgcgccgccggctgcgcgccgaaatggccgaagagccgctgaccgccgcggaagaggatgctgcagaagagaatgcggccgggaccgacatcccggcccccctctccgtcacgacctgagcgtcagccgcgatagcggcgggtcagcgcgtcggcatgggtcagcagcgcctgggcacgggcatccagaccaagcctgccatacacattcgacagggcccgcagggtcgccggcacctcgggcgtggccgcccggcgcagttccagcatctgctgggccggcaccagccggtcggccctgatcagggcatccagatagacctgttcgaacaggtcgcgctgagcatggctgccgccgatctccgtcatccgcggcagggcctggcccaggccgcggatcgccgcctgccattcgcccttcgcatgggccagcaggccgtccgcggccggaaccgccacctccgcccaggccggcaccaggaagggcggcacggcgcgggcatgggcatggatcgccagccgcagggcatcggccttctcggtcaacccggcgcgggccagaccgtagagatattgcaggtccaggaagggctggacatggtcgccggtgcgcagcgccagatagctgccgagatcggcccagcggtcgccgacatcgatcccggccagttccagccgcatcagcaatgagaccgcattgatctggtcctgggaatattccttccacaccccccagacccggccgtcatagatcgcgaaaatctcgtccacccggtcgcgatccagcagaaacaggcagagatgccaccaattgtgggtcgacatgaacgagttgagcccgacccaggtctcgctcatctcctgcatgaaggcgagcccgtcatcggtgcggccgcggctgaggcagacatgggcgatggcatgatgggcccagggctcgtcgcggcgcagccggatcgcctcgcgcgcttccgcctccgcctcgtcgatcagatggcactgttccagcgcgaaggcgcgcatgccgtgcagttccgccacctcgggcgcatggggcacggcatggtcgacgatgcgcagcatggtcgggctgtcgcccagattgaaggcgtgatactggccgagcttggcggcgaccagatcgcggggaaagcgcgccaccgtctcttcatgcagacggatcgcccgcggcatgtcgccccggacccaggcgcccaccgcctctaccgtcagccgctcgcgcggggtggcatcgccggccgcggcctcggcccgggccagatagggcgtggcattggcgaccgcatcgggggtttcggcgaacatgtgcagggctgccgcataggcctgggccagggccgaatcatgatcggcatccgccgccggcagcaggtcgaccgcctcggtcctgtagcccaggaaaccgccgatgaaagcgtcgatgccgtcgatggtgcccgaccggccggtggtcacggcattgtcgagacggtcggtctgtcggctgatcggcatgtccaggcatcccctgctgtcgcgctgcggcgggcggtgaccgggccggatggccgtcaccgccgcctgcaccagtctgggtgcgccgggcccggcggatcaagggttccgtttgccgcagcccccctgatccaccggccggggtcagaagggcagcccctgctggcggccaccgacaccggcatgttcgaccagcttggccatcacgctcggcaggccggcgacgcccagatgttcgggcttgcaccagcgcggatcgcccgcctcccccgcttcggccgcatccagggccgcggcttcggccctggtcatccggcgcagcatcacccgcgcctccagccggaaatgggtgaagacatgaaccaccgtgcccggcagcatccgccagccggtggggccgagcggggcatgggccagggcctctgcctcgtcccagggcgccccctcgcgccagggcgtggccggcacttcggtcatggcccccagcagcccgccttcggggcgggtgcggatgcgcagcgcatcgccgggcgccagggccacgaaggccacggcatggcgcaccggccgctcccccttgggcaggcgggcgggcaggtcgtcggcgatctcccgtgcctcggcagcgcattcgccggtccaggggcagcgatggcaggcggggcggcgcggggtgcagagcgtggcgcccagatccatcatcgcctgggcgaaatcgcccggccggtagtcatgggcgaactgggcggcgcgggcgcgcagttccggcttggcatccggcaggggcgtcgtgacggcataaagccgcgcggtcacccgctcgacattgccgtccaccggcacggtcggccggtcgaaggcgatcgccgccaccgccgccgcggtataggggccgacacccggcagatccagcagcccagcctcggtatcgggaaagcggccgccatgatccgctgccaccgcctgagcacaggcatgaaggttgcgcgcgcgggcgtagtagccgagccccgcccagcgcgccagcacctcttcccggggggcggcggccagatcggtcacccgcggccagcggtccaggaaggcgcggaaatagggcccggccgcggcaaccgtggtctgctgaagcatgatctcggacagccagacggcgtaaggatctgcggtctcgcccggcgctgcccgccagggcagcacccggcggttgtggtcgtaccagtgcagcagccgcatgcgcagccggtcgcggcgcgcgggatcgatcggcggcacggcaggaccggcggcgatccgggtcttgggcgggcggcctcggggcatcggcggcggacatcctggctgaacgagagaaggccctgacatagaccggagcaatgccggcggcaaggcccggctgcgcctcaaccgccgccccgcggcggcggcagggccttcagctggcattcggcttccgcctgaatccaggtcaggaaatcgcggatcggccgcgcgccctcgcggtcttcgggatagaccacccaatagtcgtgggggacgtccaggctttcggcgaagggccggaccagcgcgccggtcaccagtgcatcgaccgccagccccagcggcacgatcgccgcccccatgccggccgccgccgcgtccaggcacagaaaggtcaggccatagcgcggcccccggccgccatcgacgcccgacagcccatgatggcgcaggaaatcggtccagcccggatcgacgaaactgccggccgggtcgatctcgtcatgcagcagggtaacgcgggccagatccgccgggctgcgcagccgcgcagccatcgccggcgcgcaaaccaccaccatccgcccgggcaggatccggtgcgccaccagccccggatagcggccaccgccatagcggatcgcgacatcgacgccgtcgcgattgaaatcagccagcgtcgaggcggcaagcaggctgacctggcggccgccgagcgccgcggtcagccgctccatccgcggcagcagccagcggccggcaaaactcgccagcgtcgagacggtcaggccgaattcggaggtgacctcctgcacccgccggatttcggtttccagctggtcgaactggtcggtcagcgccggctgcaggcggcgggcatattcggtcatctccaccccacgcgcatggcgggcgaagagcggccggcccagccagtcttcaagctggcggacctgctggctgacggccgcagccgtgacgcccagctcttcggccgcgcgggagaagccgccaaggcgcgcggcggcctcgaaatgacgcagcgccagcaagggcggcaaccggcgacggcgaagcggcggctggctcacgcaggtggatcccgtcctggagggcgagccgtcgggtccgggtcctgcccgacccaggctcagcctgattgaggctatgggcgagaaaggctccgtcgcggccggggccggctcgccgtagtctcaggaccgtatcatgaactccggagacgaaccatgtccccctccccgtcggccccctgcatggaccggcggcgcgccgtctttccgtcggtggcaccgctgtctgcggccctgatctcccttgtccggcacatcgaccgcctggtgcggagcgaccgtcccggccggattccggccgccgaacgccaggcctatggcctcggcgatccgtattgcgaaccgccccgtccctgctggcccttctgaaaccggatccatccgccgcccccaacggaaagccatgccgatgccactgactgccccggccaccaccctgctcgcccatgccggcaccacgcttcagccggccgaaccggcgcgggccgccctggtgctggtcgccgtgcaggaggaatatcgcaacggccggctgccgctggtgggggtggatgcagcgctggatgaaatctgccgcctgctgcaccgcatgcgccggctggaggtgccggtgatccacctccggcacctcgatcggcccggcggcgggctgttcgatccgggcggaaccggggcgctgatcatcccggccgccggcccccgcgacggcgaaatcgtgatcgacaaatccctgcccgacggtttcaccggcactgatctggcggcgcggctgcgggcagagggccgcgaccaaccggtctttgccggcttcatgacccatctctgcatctccagcaccgcccgcgccgccctgcatctgggctttgcgccaaccgtggtcggccgcgcctcggccacccgcgacctgccggccgcggcgggtgagaccgagccggtcccggccgaaatcctgcatcgcgcaacgctcgcggccctcgccgaccgcttcgcggcggtggtgccggatgccggcgcctggggcggctgaccccgtcgttcaaaaaatctccgcaggctgtcgattgcggcccgaccggttcgtcgtcatgtcagggggcaacggagccttcatcgacaacggagataagacgatgcgtgtcatggttctggtaaaggcaacggccgacagcgaagcgggcatcatgccctcggtcgatctgttcgaggcgatgggccgcttcaatgaagagctggtcgcggccggcatcatgctgtcgggcgacggcctgaagccttccgcccagggcaagcgcgtggcattcgacggccctgcccgcagcgtgatcgacggccccttcgccgagacccgcgagctggtcgccggcttctggatctgggaggtgaaggacatggccgaggcggtcgaatgggcgaagcgctgccccaacccgatgcccggccccagcgagctcgaaatccggcccttctacgagatggccgatttcgccgatgtcctgacccccgaggtggcggcgatccacgaccgggtccgcgatgaccttgccggacactgaccccgacgcggcggtccgccgcgcggtcgaaaccgtgttccggatggagcgggcccgcctgatcggtgggctcgcccggatgctgcgcgacatcgatctggcggaggacctggcgcaggaggccctgcttgccgccctggccgactggccgcgcagcggtattcccgtccggcccggcgcctggctgatggcgacggcgaagcgtcgggcgatcgaccgcttccgccaccggcggatgcaggcgcgcaagctcgccgaactcggccacgcgcccgaggatgacggcgcggcacaggtgacggcggcagaggcggcgatggatgatgacctcggcgacgaaatcctgggcctcatcttcgccgcctgccacccgctgctgacggccgaggcccgggtggcgctgaccctgcgcctgatcggcgggcttaccaccgacgaaatcgcccgcgcctttctggcgaaagacgccaccatcgcccagcggatcctgcgggcgaagaagacactggggcgcgccggtctcgcctgggagatccccgagggcgacgccctgaagccccggctcgcctcggtgctggaggtgatctatctggtcttcaacgagggctatgccgccaccgccggcgacgatctgatccgcccggcgcttgccgacgaagcccgacggctggggcggatcctggccgcggcgatgcctgccgaggcggagatccacgggctgtgcgcgctgatggatctgcaggcctcgcgcttcgcggcccgggtcggccctgacggcctgccggtgcccctgaccgatcagaaccgccggctctgggaccggacgctgatccgccagggactggatgctctccgccgcaccgaagcttcgggcggtgccgacggcccctatgccctgcaggcggccctggccgcctgccatgcccgcgcgggccgggcggaagacaccgactggccgcggatcgccgggctctatgaccggctggccgtggttatgccctcgccggtggtagaggtgaaccgggcggtcgcccatggcgtggccttcgggcctgcggcggggctcaccctgctggcaccgctcgacgggctaccggcgcttgccggctatgcgcccctgcaggcggcgatcggcgacatgctcgcccgggctggccagccgggggaagcgcaggcgcggttcacccgcgccgcatcccttgccagccatcccagggagcgggatttcctgctggcgcgcgccgccgcctgcgtcgtctgacgatgcggttcgccttccggcccgcacggggctagaatgggcgccgaaccccgccagccgccggagccccgatggcagagaccgccgccgataccgcccccgagcgccgccgcgccgccagccgccgcgcagcgcggcccgctggcccgcgcaaagagggggaggccgagcggatccgggcggaacgccggctggcggatctggtgcccgggcttctggaccgcgatctcaggcgccggggcttcatggccgggcgcatcgtcaccgactggccgcagatcatcggccggccgctcgaccgggtgaccatgccgctggaactgaaattcccgcccgggcgccgcgccggcggcacgctgatcgtgaaggtcgccggccccttcgcgaccgagatccagatgctgagccatctggtgatcgagcgggtgaacgcctatttcggctatggcgcagtggagcggctgcgcatccagcaggggccgatccccgccccccagacccgcccccatccagtggtccggccgctgccgcccgcggaagaacgccggctgggccagctggtcgccaccgtgcccgatgccgatctggccgcgcggctggaacggctgggccgggcggtctatgacaaggcggcccgccgacgtgcctgatgcggttgcgccctgtggggttccgcaccgtcatgcaccggctgcggcccgccgccgcaggatcgagactggtttgcagcgccgtcccgcactaaactccggtcgcgcggcgggtctcgccgccgacgcatcagcgatttccacccgtatttccagttgttagggagcttcgtcgtccggtgcgcaatctgacctatggcctgatcggcatcgccgccgtcgccgtcgtcggcctcggtgcctggcagttcgccctgaaggacgaagccccgacaccgacagcggcgccggccgcccagcacggccaggccagccagagccccgccacgggcggcaatgccgcagcccagctcgcccaggcgatgcccggcgatcatgtgatcggcgacccggcggcgccggtcacgatcatcgagtattcctcgctgacctgcccgcattgcgccgccttccatgccggcaccctgcccgagctgaagacccgctatatcgacaccggcaaggccaagctggttctgcgccacttcccgctgaacgagccggcgctggtcgcggccaagctggcggaatgcgtgcagcccgaacgctatgccggtttcgtcgacgtgctgttccgctcgcaggccgaatgggccgtgatgcaggatccgaccgaggggctgaagcgttatggccgccttgccggcctcagcgatgatcagatgcaggcctgcctgaccgacggtgccatcgaggagaagatcctgaaccagcgccttgaaggctcgcgggtcttcgagatcaacagcacgccgaccttcatcgtcaatggcgagaaggtggtgggcgaccagccgatcgatgccttcgccaaggtgatcgacgacaaactgccgtaaaccggcagaccaccgcgcttcgcgccgatgcaattcgtccggctggtcctgagcgggttcaaatccttcgccgatccgaccacggtcgagatcgcgccggggatgaccggcgtggtgggtccgaacggctgcggcaaatccaacctcaccgaagcgctgcgctgggtgatgggcgaggcgtccgcccgcaccctgcgcggcaccgagatggacgacgtgatcttcgccggggccgaaggccgtggccggcgcaacctcgccgaagtcaccctcgtcctcgacaacgacgacggccgggcgccgccgccctggaccgaagccgagaccatcgaggtccgccgccggatcgaacgcggccagggcacgcaataccgggtgaacggccgcccggcccgcgcccgcgacgtccagatcctgttcgccgatgcggccagcggggcccggtccaccgccatcgtcggccaggggcagatcggtcagatcatctcggcccgcgcctctgaccgccgtgcgatcctggaagaggcggccggtatcggcgggctgcatgcccgccgccgcgaggccgaacagcggctcggcgccgccgaggccaatctcacccggctcgacgacatcatcgctaccctggccgagcgggtgacggcgctgcgccagcaggcgcgcgaagcccggcgttacggccggctgtcgcagcgcctgcgcctggcccaggccgagttgatgctggcccggcggatcgccctggtggaacgccgggcacgcgccgccgagcgcgaggccatggccgaggccgggcttgcccaggccaccgccacagccgagcgcgccgcccgcgcctctgccgcggccggtgctgcggcggaggccgcccgcgccgcactcgacgcccccagaaccgcccgcgatctcgcccaggccgatggcgcccggatcgccgccgagcgcgcccggatcgacacgctggcccaggaactggcccgcgcccgccttgccctggacgaggaccgcgaggccgccacgcgcgaggccgggctggcggaggcggaagccggccggcttgccgccgaggcggagacgctgcaggccgaagccggccgggcggccgaggcggccgccgccgacgacgccgccgccgcagaagccgaggccgccctggcccgcgccgaggccggacacgcagaggcccaggccgcgcgcagtgccgccgaagcggccgccgccgccgcggcacgcgaccttgcggccctggcccgcgaccgcgaccggttgcaggaagcggcccgcctggccgcccgcgagctggaggatctgcgccgccggctggacgaccgccgccgactggacgaggccgaaacccgcctgggccggatggaggccgaagccgcccgcgccgcagcggcgcgcgatgcggccgaggcggcgcttgccgcggccgacacggcgctcggcgccgccgaagccgcccgcgacccggcggtttccgccgcagccgaggccggccaggtgctgggcgcccgcaaacgcgccctggacgaggcccgcgccgcggcagaggccgcccggcgccgcgcgcgggagatcgaggcccggctgacggccgcgaccgcccggcgcgaccaggcgcaggccgccctgacggccctgcccgacccggccggacgtgccgccgccgcggcggaagccggacaacgcgcagccagggcggcagaggcgcaaaccgcggccgacgccgccgaagcggaagccgaggccggatttgccgcggccgaaacccggctgcgcgaggcccgccgcctgcgggcagaggccgaggcgacccgcgcggcgctcggcgccgaggccgcctctctcgaccggctgatcgcggccgaagccgcgggtggaccaggggaaagacccgtctcggcaagcctgacgctcgacgacacccatgccgccgccctggccgcggcactcggcgacgggctcggcgccgggctggatgcggcggcgcggcgccattgggtggcgggcagcacgccgcccgccatgcccccggcgatcatcgatgccggcgcccggccgctgctggagctggtgcgggggcccgaggtgctgacgcccgccctcgccgcctgctggctggtggcggatgccgcgaccgcgcagaggctcgcgcccctgctgcccgccggggcggcgctggtgacgcccgatggcgggctgtggcgctgggacggctatcgccgccggggcggggcggccgaggatgccggcaccgccgatctgcgccgccgggcgcgccgccggcagctggagaccgagatcgccgcggccgatgcggcacaggcggcggccgcaaccgccggcgacgccgcagccgcggaccagacggccgcactcgcccggcgcgatgccgcgcgcaaggcggcggccgaggcacggcgtcaggcaatggcggccgccgatgccgccgcccgggccgacagcgccgcccgggatgccgcggcccgcatggcgcttgcccgcgagacgctcgccgccgccgaagagcacctggcggatgcggccgccgcggcccgcagcctcgccgacgcggtcgatccggaagccgccatcgatccggcgcgggccgcggttgaacaggccacggccgaagaggcccgcgcccgggcggccctggccgcggccgaccgggccttggccgaggcccgccggggccgcgccgaggccgaccaggccctgcgtgcggcggatggccggctgcgccagctcgaccgccagaccgccgaggcgcgcggccagctcgaccgggtggaggctgaacgcaaggccctggcgcggcgtctggaacaggccgaagccgccgccgcccgcgccgatgaagaggcccggacggccgttgcccgccatgacgcgcttgccgaccgcctcgccgccgatccggcggtggacgaggcccgtgccgccgtgacccgcgccgaggccgcgctggcgccgctccgcgcggcccgtgacgagatcgcccgccgccgggcgggccatgcggcggagattcaggcgctcgcgcgccggcgcgaggggctttctgccgatagggcgcgggcggcggagcgcgcgcgggccgccctggaccgccgtgcggccctggaccggcgcgccgccgagatcgaccggcgcgcgcaggagattgccgggcagcccgaggcgctggaggcggcggcccgcgccgccgaagccgcgcttgccgaggccacggcccggctggaggccgcgaccgaaaccctgcgtcaggccgaagctgcacgggccgccgccgccgccgaggaacgcgccgccgaacagaagctcgccgaggcgcgcgaggccggcacccgggccggcggccagcgcgaccaggtccgcgaggcctggaacgccttcgtcgccgatctgcgcgaacggctcaatctgggccccgatgcgctggaggatgcggtgcgcgccgagcgccgcgccataggcgaggccggcgaggacgaagatgatggcgggtccgacgacggagagccagaactgccgctcgcgccgccgccccccgtggcggagacggggccgcgcttcgtggcgccggtgctgccatcggccgaagaaccggtgcttgtccgccgggtggccgatctcacccgcaggcgcgaggcgctgggcgccgtcaaccttcgggcggccgaggaatatgccgcggccagggccgcccatgatgcgacgctcgccgagcgcgaggatgtccagggcgccatcgaccggctgcgccgggcgatcgccgacatcaaccgcgacggccgcgcccggctgcttgccgccttcgaagaggtggatgccgccttcggccgcctgttcgaacggctctatggcggcggccgtgcccggctggagctggtggagaaggatgatccgctggatgccgggctcgaaatcctggcgagcccgccgggcaagaagcttcagtctctgggcctgctctcgggcggcgagcaggcgctgaccgcgctggccctgctcttcgccgtcttcctgtccaacccggcaccgatctgcgtgctggacgaggtcgacgcgccgctggacgacgccaatgtcgaccgcttcctgtcgctggtagaagaaatcgccgccgccggccgcacccgcttcctggtcgtcacccaccatcgcatgaccatggcccggatggaccggctctacggcgtcaccatggtcgaccgcggcgtcagccgcctggtctcggtggatctgaccgaagcggaacggatggtggattgagcggggtcagccgacccgaaggctggggatcggctgatctcaccttgtcgtcaaggctgcttccgcgcatgtccaggctcgcgcagaacctccgccgcgcgtgccaggaccctttcgcgaacagcagggtgcagagtccgatagcgggaaccgtcggcgcggtcgactaccacaaacgctccgtggatgcgccggagttcggagaactgccgccgtgccgccgtcgtcttcaccagagacgcacgagcggccgcgaccgcacatgccatgacatcagcccgcaagctgcgtcggaatgcgccatcgaacccgcggaccagcacgaagagtgactggaacggctgctttccaccgccgcttgtcgggctgacaccgccgaagatccgcctgaaccagagagccatggaacatcccctgcgacgaaaggccagcggccggccagcctctgaccagaacatttcgtgatcagacgccacccgcgtcaagggaaagagacggcattcatgacgtttacaacggttgatcccggccgcagcctcagaactcaacgcccgcctgcgccttcacgccgtcgcggaaggggtgcttgatcatggtcatttcggtcaccagatcggcggcctcgatcagcgcatcgggggcgttgcggccggtggcgatgacatgggtgtccgggtggcggcgcgacaggccctcgaccacctcttcgaccggcagatagccatagcggagcacgatgttgatctcgtccatcagcaccatgcgataagacggatcggccagcatttccagcgtcgcatcccaggcggcgcgggcggcggcgatgtcgcgggcgcggtcctgggtttcccaggtgaagccttcgccaagtgccttgatcgtcacctggtcggggaagcgctccagcaccgtgcgctcgccggtgtcccaggcgcccttgacgtactggacgatccccaccttgaagccgtggccgatcgcgcgcagcaccatgccgaaggcggcggtcgacttgcccttgcccttgccggtatggacgatcagcagccccttctcgatggtcttgccggcgacgatcttgtcgcgcaccgccttcttcttcgccatcttctctgcatggcggcggtcctgatcctcggacagtgcgtcggcagcggtgggggcagcggtggcggcgggggtctcggaagcctcggtcacggggtggtctccctgatggcgcgcgcctcggcgcgaagttggacgagttcgtcctgaacggcattgcgggcgggctgccagagcccgcgctcgatcgcctcggcaaagcgggcggccatctcgtccagcgccggccggttggccccggcgatgaaatcgcgcacccgcagatcgcccagataggcgtcgtagagctgatcgaaatgatggcccttcaccgcatcggtggtggcggcgaaggcgaagagatagtcgaccgtcgccgccatctcgaaggcgcccttgtagccatggcgcatcacgccctcgatccatttcgggttggcggcgcgaccgcgcaccacccggccgatttcggcacccaggctgcggatcaccggcagttcgggccggctgtgatccgggtgccagaccacgggcgccttgcccgacagcgcctccaccgccgcagccgcgccgccttcgaactggtagtagtcgtcgctgtcgagcagatcatgctcgcgattgtcctggttctggaccaccgcatcggcgcgcgacagcgccgcctcgaacagcgccttcgccccctcaccctcggcgccggcaccataggcatggccgccccaggtgagataggcctcggccagatcggcccggccggaccagccgccctcgtcgatcagcgcctgaagcccggcgccataggctccgggggctgagccgaacacccggaagccggctgcacgccgggcaaggtcgggttccatgccgtcggccacaaagcccgcggcctggtcgcgcatcgcggccgcgatcgggttggtctcgtcaccttcgtcgtcgagcgccgcgaccgcgcgcaccgcactgtcgaagaggtcgatctgggccgggaaggcatcgcggaagaagcccgagacgcgcagcacgacatccacccgcggccgccccagaacccccgccggcagcacttcgaagccgatcacccggcccgaggcgtcgtcccagcgcggccgggccccgatcagggccagcgcctgggcgatgtcgtcgccgccggtgcgcatattggcggtgccccaggcggtcagcaccatccgccgcggccagtcgccctgttcctgaacatgggcatcgaccagcatgccggccgatttccagcccagcgcccaggcggccggcgtgggcagtgcccggctgtcgaccgagaagaaattgcgcccggtgggcagaacctcgggccggccgcgggtcggtgcccccgaggggcccgggggcacgaaccggccgtcgagcccggcgagcagcgcggccatctcggcgcccccgcaggcatcgagcgcggggccgatcaccgtctccgccgtcttcagcacggccgcggtgtcggtccaggcgggatcgcaggcgatctctcccgccaccagcgcccgcgccagggtctccagccgctcgaccgtatcgcccaggctgcgccagccggcagaggggcccagcaccgccggacgcggccccgtccagggggcggcgaaatcgcgcgacagcgggtcgaagccctcggccatcagccccagatcgcgggcaagcgcccgcaggatcgaggcatcgccgccctcgcccgcatggcgggggctgcgcagaatggcgaccagcagatccaggcgccgggccgcatcggggctttcgccgaagatgtgcagcccgtcgcggatctgaagttccttcaggtcgcagagatgggcgtcgatccgggccagcgccgcctcttcggccatgccggtttccacgccgcaatcccggtcgagccccagcctcgccgcctcggcgacgatgccgcggccaagctcgggcaggcggcgcggatccatgcccgccgcctcgtaatattcatcgaccagcgcctccagccggccgagcgggccataggtgccggcgcgggtcagcggcggggtcagatggtcgaccaccaccgcgccgatccggcgcttggcctgcgcgccctcgcccggatcattgacgatgaagggatagagattgggcacgggacccagcaccgcctcgggcaggcaatcggccgacagcgccagcgccttgcccggcagccattccagattgccgtgcttgccgacatggacgatggcatgggcgccgaaattccgccgcgcccagccataaaaggcgacatagccatggggcggcggcaatgccgggtcgtgatagctctcggacggatcgatgttgtagccgcgggccggctgtaccgcgaccgccaccttgccgaagaggtgcaccggcagccggaaggcgccctcggccacgaaggggtcggcctcgggcgcgccccagcgatccccgatccgggcagccgcaccgggtgacagcgtctcgaaatgtgaccggtagctgtcgatgctccaggcgacgccgccctggcgatcgcgggtcagatcattggtcggccccgccagcaggcgggccatcagcgcggcaccgtcggtgggcgcatcgccggtgtcatagccggcatccttcagcgccgccaggatccgggccacgctctcgggcgtgtcgagcccgacgccgttgcccagccggccatcgcggttgggataattggcgatgaccagcagcacccggcgatcggccgccgccgtgcgcgcaagccgcacccaggcggcggcaagctctgccacatgatcgatccggtcgggccggggtgcctgaaccaggatcgggcattcggtcgcctcgtcccagcgcgcctcggccttgaaggcgacggcgcgggtcagcacccggccgtcgatttcgggcagggccacatgcatggccaggtccgacgggcccagcccccggctgctgccggcccaggccgcctcggacgcgccggacagcaccacctgcagaacggggccgggcaggccgtcgaagggggtgcgcgccgcgccccggccattggcatcgcccagcgcgaaagcggtggtgttcagcacgatcgcggccttcgcccgctccagcgccgcgcgcacgaaagcggccgctgccgggtctttcagactttgggcgtggaccatcagcggtgccagaccgcaggcctccagccccgaggccagcgcctccaccgccgccgtctggccgccgagcgccagagagcggtagaagacgatcgccgccaccggtcggccgccggccaccagggcgtcgatgcgcgccagatccgccccggtcagcccggcatcggccgggacggcgccggtggtcgccggatgcagccccgccggcggcagccggacaggtgcgggaccgggcacatcccgccgacccagcagatgctgcgcatggatcagcagcccggcggcattgtcgatgccatagccgttgaaataggcccagatcagcgcccgttcccgcgccgagacggtcgacaggccgtcgagcgaactgtcgggccgatcgtcgccgggaatgaccaccaaagcgatggcgcggctgcgggccagcgccgtcaaccgctccagcccataggaccagtaggcggcgccgcccagcaggcgcacgatcaccagccgggcgcgggccaacgtgcggtcgacccagaggtcgaccgacatcgggtgcttcagccgctgaaggttgaccagccggagatcaggcgcatcggcgcccagccgggccttcgcggccgaaagacaggcgagttcggtatccgcagccgtgaccacgaccatctccgccgggctctggcggaggtcgatcgcctcgtcgccatcgtcgatccggccgggttcggctgcaagcagatgcatgacgccgataccctcagctcgccggacggccgccgagggcttcggccaccgcggcgggatccagcccctgggccccgatcaccaccaggcgcgagcggcgtgcctcgcccggctgccagggccggtcgaactgctgctgcagccgcgggcccacgccctgaaccagcaggcgcatggccttgcccggcacggccacgaagcccttcacgcgatagatcgggtgcgcctcgaccgcggccccgatgcggcccggcagggcctcgtgatccacgccctccggcagttcgaccacgaagctcgcaaaggcgtcgtggccgtgctcttcctcgctttcgccgtcgtgatggctggggcgggcggcaagatcgtcctcgaccgcagcccccaggcccagcagcacggccgggtcgaccatgccgcgcgccgcctccaccacccgggtggcggggcggagttccggcgcgatcgcggcccgggcccgggccataccgtcggcatccagcatgtcggccttggtcaccaccaccatatcggcgcaggccagctgatcctcgaacagctcatcgacctcggcctcgtggtcgagggtctgatcggcggcgcgctgacggtccagcgcctcggggtcgttagcgacgcggccctcggccagggcggcgccgtcgaccaccgcgatcacgccgtcgacggtggcgcgggtcttcacccccggccaggcgaaagcctgaaccagcggtttgggcagggccaggccgctggtttcgatgatgatgtgatcgggccgcggctcgcgggcgagcagggcttccatggtcggcaggaagtcgtcggcgacggtgcagcagatgcagccattcgccagctcaatcacgttttcatccgggcacgtgtctattccgcaaccctttagcaggtcaccgtcgatgccgacatcgccgaattcgttgacgatcagggccaggcgacggccgccggcattctcgatcagatgccggatcagcgtggtcttgcccgcgcccaggaagccggtgacgatcgtcgcaggtattttcgcccgggtgctcatgcgcgcctcgcgttggttcgatccgatcgcggcaacggtagaggccgaatggccgcgtcgtcaatccactctctgacagccggtccgggctgcgaaatcacgttgcacgcgccggatcgggccgctagcatcgtgcccgcacgtggtgccaccccgatccaggcggagggggtggagaattgggaaagcggtacgcggaaggctcatagccccgcaaagccgctgctgcccccgcaacggtgtggaagcttaaaggccgtcgaaaccactgggtcggaagacctgggaagggacggcccccggtccggatctccggtccggcttccgagcccggataccagcccgtgacatgaccggcaggccgcggtgggcggtgagcgctgatcccaagggggtagccttccgggccgtgttccggccgccatctgcccccgttccggatccgtttacagaccagtctagctgcggtcgttgtcccgttccgtcgacgaggatgcgaccctgtttatgcgtttgacctattggattcaggggcttgcagccctgccaccccttctcgccgcaggccttgccggcgcggcggaaacccacctcgcccccctggcggtcgaagcgccgggcatcgaggagacggcgacgtcagacctcgcccgcctgggctgggagatggaggtggtgacccgcgcccagatcgagcgggccggcccctcggccgacgtcacccgggtgctgcagcgctatgtgccggggctctacgtcgcgcccaagaacggccccttcgactacggcacctattcgctgcgcggctccagatcggcggatatcctgatcctgctcgacggggtacggctcaacaaccggctctatggcgggctctacatcgacacgatatcgaccgccgcgatcgagcggatcgaggtcgtgaaaggcgcccaggggctgatcttcggcactgaggcggtcgccggcgtgatcaacatcgtcacccggcgggtgaccggcgacgatccggagggcgcgatcacggccgggctcgccagcgacggcgcccgccatctcgacggccgggtcggcgaccgcttcccgaacgcgctcggtgccctggatctgatggtgttcggctcccacgaccagagcaacgggtatatcccctatcgcagcgaggacatcgacgccacggtcagcgaccgccgccggtcctatcgcgtcgccaatctgggctttcgcgccacgcagcatctgggcgataccgcacgcgcggatctgttttaccagtatgccgccggcaagctggattttgcccgcccggtgtcgaaccacgataccttcaacgaccgcacccagcacatcgtgaccgcaagcttcgagcacacgccctctcaggctttcgactacgcactgcgtgcccatctcaatgtctgggatacggactatacccggatctacaatcagcccggcggcggcacgaccacggtcaatgacggcgactattggggcttcaaggattacgggctgaaggcccagggccgctggcgcttcgccggccaggaactgctcttcggggccgacagccagttctaccggggcgccgacgatgtgctggtcatcggcaagcagaccggtgaggcctatggcctgttcacccagctccggccacatctggaggccctgcccgagaccgatctgtcgatcggcacccgctacaactggacggccgacggcgccgaggccctggtctggtcggccagcatccgccagggcttcggtccggccttcatccgcgcgcttgccggcacctccttccgcctgcccaccgccgagcagctctatgccaacgacgattgctgcgccaagggcaatccgggcctcgatcccgagaccagccgcgaggtggaactgggcggcggcgtcgacttcgatctcggccgcgatgcccgcctcaccctggaagtcacggccttccgccgcgagatcgacgacatgatcgacggctccggcgaccgcttcgtcaacatttcggaaggcgtgctctcggaaggcgtggagcttgaggccgggctcgatttcgcccgcggctggtcgaccggggccggggtcactttcgtctcgaccgaacgtcgggacaccgggctgcagctcgacaacatcccgacccgccacggcttcgtccgcatcggctatgaaacgccggatgacacgcggggctttgcgccgggtgacagttggggcgccgatctctatgcccgtcatgtcggcgatgtccgcgcgcgtggcacagaatatggcgactatgtcgtcttcgatgcctcgggcttctatgccttcggcccgaacggcgctcaccggctgaccctgacggtcgaaaacctcttcgaccgcaactacgccaccggccgcaccaccggcgcctcgggtcaggtcgaccagctcggccggccgctcaccgcggaactgcgctatggctacagtttctgagcgatcccccgatctgatccttctgctcgtccgtcgcggctatggcagtccgcggcggctggaggccctgcgtgccgcggtggcggcgcgtctcgccgacgagaccggttttgcagggccggtggtgctgggtttcgcagaactggcggtgccttcggtctcgggcgcactggatggcctggccgatcaaggccggatccgggtgctggtggtcgatctgatcgtgcccgcggatatgagcctgcggggctggctgcccggcgcgctgcatgactgggccaaccgccggggcgtcgcactcgacatcgccttttcggacccggtggacggcgaccccgccttcgtctcggcggtggtctcgcggatcaccagcggggcggcggaagatgtccgccagagccccgccaccgacagccggccgtcctggaacgacccgccggatcatgccttccatctcttcgcctgcgacgggccacgctgcgcccatcgcggatcgggcgccgtctggacggcgatgctggatgcgctggaagaggcggggctgcgcggcaagacggcggagcgggtgatggtcacccgcacccgctgcctctatccctgcaatcgcgggccggtggcgacgatccatccgggcggcttctggtatgcggtgcccgatgccgaggccgcccgccggatcgcggtcgagcatctgaagaacggccggccggtggccgatctgctgttccgggagcggggtgattgaggcgtctggtcgccctgctcctgctctgcacagcgctcggggccggccccgcccgcgcggcggatgcctgtggcaacccgcccctgccccagatccccccgcagcgggtggtcgtggtgcatcagcaggcgatcgagatcctgctcgccctgagccttgaagaccggatcgccgccgccggttatctcgatgacgctctgccgcccgatcttcagaccgggttcgaccgcatccccatccggttcgaccgctatctcgcgaccgaagccgtcgcgggtctgctgccggatctcgtgctgggcggcttcgccgcggccttcggtgccggcgggctgggcccgcgggagaccttcgcggggctcggcatcccgacccatgtgctggcctcgggctgcatgaccgcaggcgatgatccggtcgcgaccgccatcgccgacatccggcagatgggcgcgctgttcgatcggcggcaaagggccgatgcgctcgtggcggagatcgaggccgggctggaggccctgcagcccgggccggcactgacggttttcatctatgacggcggcgagaaagcgccctataccatcggccgcgacggcctgctcacccgcctgctcgcccgcggcggtgcgcgcaacgtcttcgacgacacgcccggccgctgggcgacggtatcctgggaggccgttctggcccgcgacccggatctgatcctgctggtcggcaccacggccgaccctgccgccgagaagcgccgacggctcgaagccgatccggcgcttgccggtcttcgtgcccttcagaccgggcatgtggcgaccatccccttctccgaaaccgtcgccggcatccgcaccggcaccgccgcccgccatctggcccggatcctggctgcggcgcgccaatcggccgcagacgcaccccttgccggagatgccccatcgccccataacattccctgaaaatgcatctatggaggccgacatgaccgcacatcccgaaggcgggcccgcccgccgccaggcactgacccgcgaggtgatggcggccaccggcctcgacgatgcgatgatcggtctggtggtcgaccgcttctacgatcgggtgcgggccgatcccgtgctggcgccgctcttcgccacccggctgtcggatgcggattgggggccgcatctggcgaagatgaagcgcttctggtcatccctcgccctgatgaccggcgattatcacggccggccgatgcaggcccatctgccgctgccggtctcgggcgccgatttcgaccgctggctcgccctcttccgcgagaccgccaccgacctctgcacacccgcgggcgccgccctgctgatcgacaaggccgaacgggtcgccgccagcctggaactcggcatcgccgccggccgcggccatatgctccgccggggcgagcggctgccggcgacagaggcatagcgcccgccacaccccttatttaaattttcgcgattttctttaataagcccgccggctgattaaacgccttaaataagcgtggggccagcccccgggccggaacggccgggaccggctcaatagacgacgttgcgcaggaaacgcagcaggcccggccccgggttcacataggcgaaggggcggtcggtggggaaggcgtggaagtcgcccgcctcgacgatgcgggtgatgccgtcgacctcgacatgcagccggccttccagcacatagaccatgtcctgccagccggcaggatcggggcccgaggcatagcggtcgccggggccgagcgaccagagccagagttcggccgcctgggctgccgcgacgccggtcagcagcgtaccgcggctttcaggtgccgcaccggcccaggcgagagccgcgatgcggccgcgatctgccgccgggtcggggctgcggaccagatcgacgaacagcacggccagcgccgccgccagccggtcgagcgtggcgaggctgacattggcatcgccgcgttcgatgttgaccagcatccggcggctgaccccggcgcgcgcggccagcgcttcctggctcaaccccgcctcctggcgcagccggcgcagattgcccgccacatgctcaaggatcggcggccgctccccgtcttgactgtgcattatattgcccatatcctccgctctgagcagtatactacaccatgctccggtcaccggaagcacctccctcgcacccgccccgcccgaaagccgctgcgcaccatgtcctcccgtcatcagggctcgatcctgctgcccgtcgggctgctgctgatcgcgatcgcctccatccagagcggcgcctcgctcgccaagacgctcttccccgagatcggggctcaaggggcggtgacgctcaggctggtcttcgccgcgatgctgctgatggcggtgttccggccctggcgggtgcgcttcaccacctcggcgctgaaatccgtggcggtctacggcctggcgctgggcggcatgaacctgtcgttctatatggcgctgcgcaccgtaccgctgggcgtggcggtggcgctggaattcaccggtccgctggtcgtggcgctggccggtgcccgccggccgatggatttcctctgggtagcgctggcggtggcggggcttgtcctgctgctgcccgtaggcgggctggaaaacggcatcgatccgctgggagccgcctatgcgctgggggccggggcctgctgggcactctatatcctgttcggccagaaggccggcgccacccacggcatgcagacctcggcctatggcgcgctgatcgcggcggcgctggtgatgcccttcggcatcctgcatgccggcaccggcctgctcaaccccacgatcctgccggtggcgctggtggtggcggtgctgtcgaccgcgctgccctattcgctggaaatgatggcgctgacccgcctgccgacccgcaccttcggcattctgatgagcgtcgagccggccatggccgcgctgtcgggcctggtcttcatgggcgagcagctgtcgggcctgcaatggctggcgatcggcgcgatcatctcggcctcggccggcaccacgctgaccgccaggcgcgaggccgcccccgcccctgcccgggctcagcctgcgaccgactgaccggccgcgatcaggtgcaggaacgagccggcgacccgtccggcgcgcaagccccgcgccccttcgaccgcggccccggtcgcatcctccaccgacgaccagagcgggtcgccccgctcggcgatgatggtggcatagtggaattcatggccgcgccagagcctgccctccagcggccctgtgaccatccggcccaggcgatagccgagatgcagccgccgtgcggcaaagctggtggaaagccccagcagcccggccatcggccagtcgcggccgtcggcatcggtcagcacctcccccagcgccatatagccgccgcattcgccgaagatcaccgcaccccggtcgcgggccgcgaccagcccgcgcacccaggcgcgatcggtcgcaagccggccggcatgcagctcaggatagccgccgggcagccagacggcatcggccgacgggtcaggcgcctggcccgccagcggcgagaagggcagcacctcggccccggccgcgtgccagtccgccagcagatgcgggtagatgaaggcaaaggcatcgtcgcgggcaagggcgatacggccgcccggcggcggcaccgccggcccgggttccgccgccaccagccgggcacccgggctcgcaggtcgggccagcgccaccacggcatccagatcgacatgggccgccaccagatcggccaaccggtcaagcagcgcgtcgagatcggtggtctcgcgggcctgcaccagccccagatggcgcgacggcagggcgatatcggcccggcggggcacgaagcccagcgccggcacccccgcctcggcggcagccgccgccagcacgcgccgatggccggggccgccgacccggttgaagatcaccgccgccacctgaaccgccggatcgaagctgcggaagccgtggatcagcgccgccgccgatcgcgcctgggccccggcatcgaccaccagcagaaccggcaggctgaacatacgcgccagcgccgccgccgacccgtcgccactggcccccggcgcgggcgcgccgtcgaacagccccatgaccccttcgatggccagcagccccgaaggcgcctgcgtctcgatcaggcgagccagccggtcgggggccatcgcccaaccgtcgagattgaccgacggacggcccgcggcgacctcgtgaaaggccggatcgatatagtcggggccgatcttggccgcagcgggtgccaggccacggcgccggaaggcgcgaagcaggcccagcgtcatggtggtcttgccgcccgaagaggcgggggccgccaggatcagcgctggcggcggggtcacgaggcggccttgtgtccgcgggtgccgagcgggtcggccttgggcgtgcggctgccgtccagcacccccatccagtcgagcgcggcgcgcagccggaccaccggccccatcaccacgatcgacggcgcttcaagcccggccgccacgacatcgtcatgggcgcgggcgagcgtggtttccagcacccgttgatggggggtggtcgcccggctgatcaccgccaccggctcttctgcgtcgcggccaccggcgatcagccggctcgaaatctcgcccagatgcttgaggcccatatagagcacgatcaccggcgagcccttggccagcgccgcccagtcgatgctgccggtcacgccgccggtggtgtcgtggccggtgatgaagctgaccacatgattggtgtcgcgatgggtgacgggaatgccggcataggcggagccgccgatcccggcggtgacgcccgggatcacccggaagggaataccggcctcgaccaatgccagcccttcttcgccgccccggccgaagacgaagggatcgccgcccttgagcctgagcacccgcagcccctcacgcgcaagcgcgatgatcctgagcgtgatgtcggcctgtttgggcgagggccggccgccgcgcttgccggcatattcaagccgcacatggggcccggccagggccaggatccgttcatccaccagggcgtcatagacgatgacgtcggccgaggcgatggcatgggccgcccccagcgtcagcagcgccggatcgccaggccccgcccccaccagccagacctggccgggcgcgaaggcaggcaggcccagcaggccgggcagcaccatgccggcaccacccggggccgcccccggcatctccttgccctctgcctcgctcatcgcgccattcctccgtttgtcacggccgggcccatgacccttccgccgcttgatgatatcgtcgcgccatgaccacgacccgcgccataccggaaaccctgcccggcaatcagacctccggccgcaagccggggggcgggccggctgcgcctcagctccgctcgggctggaccaccggtgcctgcgccaccgcggccaccgccgccgccttcaccgcactcgccaccggccgcttccccgaccgcgtggagatcaccctgcccaaggccaccctccgcacggggcaacgcccggttttcgatgtcgccgagcgccgggtggagcccgacggcgccatgaccgcgggcatcgtcaaggatgccggcgacgaccccgacgtcacccatggcgcactgatcctggcgacgctgcacccggggccccgggggacgggcgttaccttccgcgccggcgccggcgtcggcaccgtcacccggcccggcctgccgatcccgcccggggaaccggcgatcaacccggtgccgcggcggatgatgaccgataccgtggccgaactcgcatccctgctcgaccatccgggcgatgtcgtcgtcaccatctcggtccccggcggcgcggcccttgccgagcggacctggaacccgcgcctcggcatcctgggcgggatctcgatcctggggaccaccggcgtggtggtgccctattcctgcgccgcctggatccattcgatccatcgcggcgtcgatgtcgcccgcgccaccggcctcgacatggtcgccggctgcaccgggtcgacctcggaagccatgctgcgccggctgctgcccgatctgcccgaccatgccctgatcgacatgggcgatttcgcgggcgcgctcgccaaatatctccgcagccaccccgtcccccggctggtggtggccggcggcttcgccaagctggtcaagctggcccagggggcgctcgacctgcattccagccgctcgacggtggatttcagccgtcttgcgggccttgccgccggcatcggcgccggggcggagctgaccgccgcgattgcgtccgccaacaccgccaaacaggtgctcgacctctgcagtgccgccgggctcgacatcgcccggccggtggccgaggcggccggagcgacgctcgccgccgcggtcgcacccgccgccgtggcgatagacgtggtggtcgccgaccgggcgggcaagcccgtcgccgccaccgccgggatccggatctgagccgatggtcgagccgctcaagcttctgatcctcggcggcacggccgaagccgccgccctggccgaggccgccaccgccaccggccacgaggtctggacctcgctcgccggcgccacccatgcaccgcggcgcccgcccggccggctggtttcaggcccgctcggcggcatcgacgggttgacccggctgctgaccggcgagggcttcgaccggctggtcgatgccacccatcccttcgccgagacgatctcggccaatgcggtcgaggcggcgctgcgcgcaggcgtgccgcggatcacgctccgccgtccgccctggaccgccggcatcggcgaccgctggtacggtgtggcggatctggccgaggcgctggagaccctgccgcgcgcggccgcacccgaagacgggcgggtcttcgtcgccaccggccggcgcgggctgaacctgctggcggcgcgggcagaatacagtttcgtggtccgcacgatcgagccggtggccgtgctgccgcccggggtcgacgtcacgctgatccgcgatcgcggccccttcgaccttgccgccgaacgcggcttcttcaccgaacacgcggtctcggcggtcatcgccaagaatgccggcggcaccggtgccgaggccaagatccaggtcgcgcgcgaatgccacatcgccgtgctcatgatcgaccgtcccccctcgccgccgggcctctgggccagccgggtcgacgaggtggtcgactggctggcccggccggtggcggaagaccaggcgctccccccggtcagccgaccatgagcaccagaccagcggcggcgatgccggcgccgatcagacgctcgaccctggccacctgcagcttctgcagccccatggcgatgccgatgccggccagatgcagcaggccggtcgccgccaggaagcccagcgcataaagcgccgccgagccgtcgcccgccatctcggtgccatgggcatggccgtggaacagggcgaagacgccggcgatggccgccgccgccaccgggttcgggcggaaggcgaaggcgatcatcaggccgaagaccacgatcgaggcgacgatgcccagctccacccccggcaggccgatcccggccatgccgagcgcaccgcctgcgatcatcagcgccatgaagccgagcggcgccgcccagatcatccggccgccggtctgcccggcccagaagccgaccgccagcatggccagcacatggtcgagaccaccgatcggatgggcgaagccgctggcgaaaccggccacctcgtggccggtatgggcgaaggccgggccggccaccagggcggcagcggcggtcagcggcaggatcaggctgcgtcggaacatgggatcgtgtctccgtcgtcggggcgtccggtgcggacagggtttggacaaggctcctgagggagcgccagagtcgaggggggaggccggatcagcggaagatgacatcggcgtccccgacgcggggggcagcgccggccacgggatcgggcaggctgccccggggacgtttcggggcagcacgcaccggccgcagcacatgcgcatgtcccggatcataaagcgcgctgtcggcgaagtcgccgggctcgaagacccggccgaccaggatcagcgcggtgcgggtgatcttcgccgcgcgcacccgggcggcgatatcggccagcgtgccgcggatgatcatctggtcaggccaggtcgcccgatagaccaccaccaccgggcagtcatcgccgtaatagggggccagcgtccggtggatctggggcaggaaacggatcgacagatggatggccagcgtcgcccgcgaccgacccagctcttccagcgtctcgccctcgggcatgggcgacgaggcatggccggtgcgggtcacgatcaccgtctgcgagatgccgggcagggtcagctcgctctgcaacgctgccgcggcaccggcgaaggcaggcacccccggcgtcacgtcgaaggggatgcccagcgccttcagccgacgcatctgctcggccgtcgccccatagatcgagggatcgccggaatggacccgggcgacatcctcgccccgctcatgcgccgcccgcatctcctccacgatctcgtcgagggtgaggggggcggtgtcgatgactcgggcgccccgcggtgcccaggccaccacctccgccggcaccagagagccggcatagaggcagaccggggcggcggcgatcaggtcgcggccgcggatggtgatcagatcggccgcaccggggccggcaccgatgaaatgaaccgtcatgccacggcctcccctgatccggtccggccgaaaccggcatctgcaaaactgtcttcgccgcggctgccatagccgcggggggtgtagacccgggtgccctgccccagttccagccgccggctgccccgggcgccgaccatcaccagggtcagcatgtccaccgcatcgaccgccagcccgtccagatcggtgatcgtcaccgtctcgtcgggccggcccagattgcgggccaggatcaccggggtggcgccgccgcgcgcctcgatcaggatctcgcgggcacgggccagctgatggcgccggcggcgcgagaccgggttgtagaaggcgaccacgaaatcgccggcggccgcggcccggatccggcgttcgatcaccgtgaacggcgtcatgagatcggacagcgagatggtgcagaaatcatggccgagcggcgcgcccgcccgtgccgccgcagcctggagcgccgagatgccgggcgagacctgcaccggcacatgggcccagccggggcggggctcgcccagatcctcgccgcgctcgatcagctcgtagaccagcgccgccatggcatagatgccggcatcgcccgaacagaccagagccacgctccgcccctccgccgccagatcgagtgccgcggcgacgcggcgttcctcttcgcccagctcgtaaccgtggcggcgcttgccggccgccgccggtcccagcagatccagatagaggccatagccgaccaggtcggtcgcctctgcgaccatgcggtcgacctcgggcgtgcgccagtcgggccggccggggccgatgccgacgacatagagcatgcccggcgcgcgcccgacgtcgcccgccatgatcggcgccggggcgagcgccaccgcacaggtcgcgcgcggcgatttacgcttggccacgatcagctcccccgcggggcccgccgccgccagggccgccgcctcggcgacgcccgccacccccaccgtcgccctgacatagtcggacggcgttgcgagccgcggggtttcctcggcaagccgtgcggcggggaagacccgcaccggcaggccgcgcgcggcggcggcggcggcgatcccggcctcgtcggccttgatgtcgatggtcgcgatcagggccacggccccgggtgccagaccggcaccggccagggtctcgtcgatcagcccgccgatctcctcggccccggcaccgcgttcgcagccgatgccgacggcaaggcgggccggatgatagagcagcccgcccgccggcacctcccggagccggtgatcgatcaccagcggcacgccgccctccgccgcctgcggcaggggggcaagccagtcgggaagatccgcctcgacccgcacccaggccccggcgaccagtgccgccatggcgggtttcggatccagccccgccgccagccgccagccggccggcgggtcgtcgagcgcgacgccgaagcgcagatcgcccgcggtcgtgacggcggccaccgcccccagcgccgtcgccagctgtcgggccagatcattggcgccgtgatggccgcccagaagcggcacgaccgcgctgccgtcctcggcgagtgccagcaccggcggctcggccgtcttgtcggccaggaccggggcgagcatgcggatcagcgcgccggcagccgcaatgcccaggatcggccggccggccaggaacaggctgcgcagcccctcagcgacggggtcgagcggcgcgaccagggcgcgatcatcggccgcaagccgggcatgggggccggtgatcacggcgccgggcagcagtgcctgaacccgccgggccagcggcagccccgaaggtcccaggatcagaacggccggagcggcggtggaaggaatgtcggtcatgctgtcgcctcgccgcgccggtgaaccaggatcaggctgaaatagggcgccacctcgtcggggaggtcggcaagcttcaggatgcgctcccccggccaggtggcgcgctcgacataccaggcccgggccagcaggccggcttcctccaacacccggcgcagcttgggcagatgccggccgaccttgaggaaggccatgccgtcggccgcggctatccgcgccgcaagctcgggtgcgggcagggtggcggggatcatcgccagacagtcggtgcgggcggcgagcggcaggccgatccgcgccgccgccccggccatggaggtgatgcccggcaccacctcgaccggaaagcggccctggagccgggcggccagatacatgaacgagccgaaggtgagcgggtcgccctcgcacaagaggccgacatcgcggccctccgccagatgggcggcgatggccgcggcgccggcatcataggcagcggccccggggctgcggtcgtcgcgcatcggcatctcgatctcgaccagcaccgccccgggcgcgatcagcccgcctgcgatgctgagcgccatcccccggccggcgccggccgcgcggatatgggcgatcacccccagcctgccgagcagccgggcggccttcagcgtgatcagctccggatcgcccggcccgaggccgagaccaatgagccggccggtcgtcgaacctgccccgctcatgcgcgccgccaggcccattgggtgaccggcatcgccgtccgccagcccagatgcggcccgaccggctcggcgcgggcgatctggatgcgggtcagatcgccgccatggcgggcctgagcctcgatcagcgccgcctctcccgacagcgtcacggcattggccaccagccggccgcccggcttcaacagagtgaccagttggtcgatcagccccgcctgggccacggcgccgcccaggaagatcgcatccggaaccggcaacccggccagcgcctcgggcagatggccctcgatcagcgtcagtcccggcacgcccagcctgagcgcattggcccgcgcccgatccagccggtcgggccgctgttcgatgccgatcgccctggcggtcggctcggcccgcagccattcgatcgcgaccgaaccattgccggcacccagatcccagagcagcgcaccgggtgccggcatcagccgggccagggtgatcgcccgcacctcgcgcttggtcagctggccgtcatgatcgaaagcgtcgtcgtcgagcccggcgagggtcggcagccagtcggtcgcgggtgccgccaccagttcgaccgcgaccgtgttgagatcggccgccgggcgcggatcccagtcgccggccgtcccgcggcgcagggcttcgcgcgggccacccaggcattcgagcacgaccatcgggctggcgccgaaaccgcgttcggccagacgggcggcgatcgccgccggggccgcgccgtcgtcggtatatataacgagacgcgcgccgggctgaagatggcggtcgagcagcgccagcggccggccgtgcagggtgatgatccgcacctcgggcagcggccagcccagccgggcacagaccaggctggcggccgagggggccgggtgcacgcagagcgcatcggccccgaaccagcgggcaagcgtggtgccgacaccccagcagaaggggtcgccgctcgccagcaccaccagccgccggccgcgcgcggcctcgatcgccggccgcagatccttgagcgggctgggccaggccaggcgcgggcgggggtcgtcatccggcagcatcgccagatggcgatcgccgccgatcagcagctccgccgcgaccacctcggccctggcctcggtgccgagcccggccagaccgtcctcgccgatgccgatcacggtgatccagggcgctggtgcggtcgtcaggctggccccgtccatcatccaccctcctcattcggtgcccagagggcgttgaccgcggccgaggccatggcactgccgcccatccgccccggcagggtgaggaagggcacgccgcaaccggcctcgatcagcgcctgcttgctttcggccgcccccacgaagccgaccggaaaggccaggatcgccgccgggcgcggcccgccggcggcgatgatctccagcaggcggaacagggccgtgggcgcgttgccgatcgcgaccacggcgccggccagccggtcgcccagcgcgtcgagcgccgcggccgagcgggtggtgccgtcgcgcgccgcgatcgccgcggtctcatcgcagtccagcccgcagagaatctcggtgccggccggcagccggcggcggatgatgcccgaggcgaccatgcggcaatcggcgatcaccggccgccctgcggccagcgcggcacggccggccgtcgccggatccccctgccaggcaagtcgggaagccacttcgaccatgccgcaggcatgaacgaccctgagcgccagcggcaccagggccggcggcagccggtcaagctccgcctcggcccggatgatggcgaaggatcgggcatagatctggtcgggcacacgcagccaggccgtgctcatccgcccgaagccttcttcaggctggccgcttccctgttcaggctggatgggccgagcggatggtcggcatggggataggggtggtggtgatggccgtgatcatggccggccccatggtggtggtgcccgtggtcgtgcccatggggatgatcgtgatcatgatggtgatgatggtcatgggtctgcgcaggcccgtgatcatgccccgcggcaccggtgccgatgccctccacatgatggtggtggctttcctgcggcaggccgcgctcgccctcgaagcccagcacctgaacgcggtatttgcacatctggcagttcatgttgccggtgccctgcaggatttcctgcacccggtcgatcatggtttccaccacctgcgggtggtcgcgcagatagcgggccttcacgaattcgatcccggggaaatcggccgccacccggtcgacggcgtcgtagatccggttgaccagaatgccggtgaacaggaaatacgggaacaccacgacccgccggaagcccagccgcaccgcatggcggagcgccggttcggtcagcgggaaggtgacgcccgaataggccgtctcggcccagccgaggcccagcccttcccacagcatgcgcccgaccttggcgacattggaatttgcatccgggtcggatgcgccgcggcccacgaccaccagcagggtgtcgtggcgcgggatggggtcggtggccgggcgggcggcgtcggcacgggcgatggccgcctctacccgctctcccgccgccttcagcatccgcgggtcgatacccagttcacggccatagcggatggtgaagccgggatcggcccggccgccggccatgtcgccgcccgaccgcacgctttcctgataggtgttcagcaccgaggggatgtcgttcttggcatggccggcggcgaacagcatgcccggcacggccagaacctcgcgcaccccctgggctcgcagccggtccaggccgtcgcggatgatcgggcgggcgaattccagatagccgtattcgacgggcaccggggcaaagcggcggcgcagctctatggccagctcggcgaattcgtcgaccgccccctgatcgcggctgccatggccgcagatcatcaatccctgaccggctccaagcccgaacatcgcgttccgtccctccgtcacactgctgtcggtgcggaagcggccgatggacgaggggcatatatataccgagaggaagcgcgctgcgtcggcgtcgcgtggcagcagaaaaccgtagccgccggcggggtgcaggcggcgatgccatcgcgatcgtccacgcgggcttccatccaggatccgcccgtccgccggcgatgatcccgcccgcgaagccccgtcgcgtctggcgtcccggggcgtggtggccggtcccgcatcgggccggccttgtgcaaccaccatgcgtcaaccgcgcgaaggatgcaacatctcgccgattttcaatcaatgggggagaattcgtcccgtcacgcatcccggggcatcgaactctgtcccccaccatgctgcggatgcccgcgccggataccctgaggttgcaccgcccgcacctgcgacaccggggcacagggtgcccgggcgggcacgagcctgaaaggcgagtgctgaaaaatcaatgggttggccaagccaatcccttgtaaagcaaggggttttcattcttgacacgcatagggcttccccgtatggttcacgcgccttcggcagcgctgttgcggcgcggccggcgtgcccgggtgaccgggtgccaaggtgcggcagcagagatgcggcccgcctggtgccggaaatccagaggcgccttccaccgaccggatgctcaaggcgggccgacgctcatggatgaccgggacgactcgggactgaaagagcttgaagcccgactgaagcaggcacgatcctccaccggccgccgcacgggcgacggtccggggaattcgcgtgagccggtgaagggcatcgggttcgccgctcgcgtcgggacggacctcctggcggctctcgtcgtcgggctcgggcttggctggtttatcgaccgctggctcggcacggcacccttcggaatgctcgtcttctttctatttggtgcggcggccggcatacgcaatgcctatgccttcgccaaacggacgatgaacgagatcgatgaaggcgaagcgcagggcaacggcccggccgggcccccgcaaggggatgggtcgggacgacaggacggcacccgtgatgccggacggaaagattgacgggtctgcgggtcgaccgcgggcaagggtgcggaaggtggccggcatgcgggaactccccggtgccgacggctccggccagggttgagttcttaacgaagagcgagggccacggtggcggaagcacatagcccgcttgagcagttccacatcaagcgtctggtcgacctccagatcggcggcgtcgacatctccttcaccaactcgtcgctgtggatgttcatcgccatcgcggccgttacgctgttcctgacgctgggctcgcgcaatcgcgccctcgttccgggccgcggacagtcgatggcggagatgtcctacgagtttgtcgcgaacatgcttcgagacaacgtggggtcggaaggccggaagtacttccccttcatcttcacgctgttcatgttcgtcctgttcgccaacctggcgggcatgctcccctacagcttcaccaccaccagccatatcgtcgtcacctttgcgatggcgctgttcgtctggctgctgaccactgtgatcggtctggtgaagcatggcggtcacttcttcagcttcttcgttccccagggcgtgcccctgtggatgatgccgctggtggtgccgatcgagatcatctcctatctgtcgcgtccgatcagcctgtcggtgcgactgttcgcgaacatggttgccgggcacacgatgttgaaggtgctggccggcttcatcgtcgcgctcggtgtcgcgggcattgcgcctctcgtggtggtcgtgggcctcaccgccctcgaactcttcatcgccgcgctgcaggcctatgtcttcgcgatcctgacctgcatctacctcaacgacgcgctgcacctgcattgagatccgggaccggatccgaccgaccggcgatgtcgccggccggtccccggtcacgggcaggtatcaggcgatcgcctctctgaaaaccagtccctttgtcaagataaggaagttgagcgatggaactggaagccgcaaagatgatcggtgccggcctcgcggtgcttgcgctgttcggcgtcggtatcggtatcggcaacatcttctcctcgctggtcagctcgctggcgcggaacccctcggtccgcaccaccgtgttccccctcgcgatgctcggcttcgcgctggtcgaggcggtcggcctcttcgccctgctgatcgcgctgatcatcctcttcgtgttctgatcagcacgacggccgggaaccggtaccgagcgggcccgaggggtgtgaaaacaccgcctcgggcgcgttcgtgagggcggggacggcagacggcctccggaatgaagcccgtcagggtacgactttccgaccagggcacgatccgcctgccacgccagactttcgccatgacggccggccccgcggggccccgtccacgaaatgccccgggagacccatgcctcagttcgaaccgagcacattcgcgtcgcagatcttctggctggtggtgtccttcggcctgctctatctgctgatgtcgaagatcgcgctcccgcgcatcgccgatatcctcgaggtgcgccaggaccgtatcgccgccgatctcgatcgtgccgaagcgctgaagcgcgaggccgaagaggcgcgtgcggcctatgaagcggcactcgccaatgcccgcgccgaagcccagaagcttctggagcaggccggcgagcaggcccaggccgaggcccagcggcagctcgacgcgcttgacgagcgtctggccgccaaggtccgcgaggccgaagccgccgttgccgccgccaaggcggacgccatggccgatctcgcgtcgctcgcgaccgagaccgccgaggcggccaccgcgaagctggccggtgcgccggtcgatggtactgcggtccgcagcgccgtcgatgccgccctggctgccacctcgtcgcggaaggagtgaggccgatgttctccgatcccactttctgggtcgccgtcgccttcgtcctctgcatcgccgggcttggcttcctgaaggtccacaaggccatcgggggcatgctcgacgcccgtgcagccgcgatccgcgccgaactcgatgccgcgcagaagctgcgtgaggacgcccaggcgctcctcgcccagtatcagcgcaagcagcgcgaggcgatgcaggaagccgagcagatggtcgcccatgcgcgcaccgaagcgaagcgcatcgtcgagatgggccagacccagctggcccagtcgatcgagcgtcgcgagcgcatggccgccaccaagatcgcccaggcggaagccgatgcgatcgccgaggtccgtgcgaccgcggtcgatgtggcgatggcggcgaccgagcaggtgctgcgcacccagctctcggccgaccgtcaggccaaactggtggacgacaccatcgccggcctcaagaccctgcactgatccgcgtctcccgcgatccgggcagttccgaaacgccccgccggttttgccggcggggcgtttcgcgtttcgggaccggcccccgcaggtactccgacgtcaatataatgctgcgtcattggtcagatgtatcgacgtcgatgtaatgtcgcgtcaccggaatgatcctccggcgtcgatgtaatgttccgtcaccaatgtggcccaccgttgacccggtgcgtctggaggctcgccatgcggccggtgatcaggcaggatgcaccggcgggagaaatgacggccggccgggcgaagacctgccggacggccggggcatatggcgacggggacagggcgtgcggcagtttcgatcactgagagtggcggtgtttctgggcgtggccgccatcctgggcgtcaccgccgccgtgatcctgccatcgaccaccgccctgctggagcggagcttcgtctcggaacgggagcgcgaggcgaccaacaccatcgatctcttcgccaccagcctgcgcgagcgtttccagtcgctgatccgccagaaggtcgatgccgtcgaacagcgcaagacggcgctgcgcgaccagggagaccaggtggtctcggtgctctcggcccttcgccgcctggccgccaatggcgggatgagcgagaccgctgcccgcaacaccgccctgcaatggctgtcggaccagccgcgcagcgaggcccgctatgtcatcgtctatgacggcgagatgcgggtgctgatccacccggatgcatcgctgctgggccagacgctgatcgacggccgcgacatgaagggtcgcccggccttcagggcggcgcaggaggacgtccttcagtatggcgacaccttctccaccttcccctggcagagcctggacgccaccgagacccggctgaaatttggctatttccgcaatttcgagccctggggctggacggtggcggtgatcgccgatgccgaggacgtgcagcgcgcagccgatgcccagatggcgcagatgatccgggatctgaccaacagcgtccatgctctccgcctgggcgatcgcggccgggcgatgatcttcgacggccaggggcggctggtgatcccgccccagggcggcgataccgcctgtgcggcgatcagtaccgccgtcgacagctgcgccgacgccttcgccatgctgccgcaggacctgccccgccaggacacggtggccgtgccgccgccggccggggcggacgacgtcgtgctctacgcccatctgttcaagccgctggactggcgggtgacgatgctgctgtcgcgcgacgacattctgggcccggcgcacgaggtcacccgcaatcaggcgctgctgctgggttccgtgctggtgctgtcgttcctggcggcctatccgctctcgggctggctggtgcggccgctgcgccggctggaggtccgggtccgcgccctcgcctcgcaggatttcacccgggatgcgccacccgatccggggctccggcggatgatcgacgatcgtgccgacgagatcggccggctggcctctgccttcgccttcatggacgaaacgctccgcgccaagatccgcgagctgatccgggtgacggaagagcgtatgcggatcgaaggcgaactcgccgccgcgcgcgacattcaggaaggcctgctgcccaagaccttcccgcccttccccgaccggcccgaaatcaatctccatgcccgcctggtgccggcgaaggaggtcggcggcgacctgttcgacttctatttcgccgaaggtcgccatttctacttcgtggtcggcgacgtctcgggcaagggcgtgccggcggcgctgttcatggcgatcacccgcaccctgctcaagacctcggccgagaagggcctgaccccggccgagatgctggccgaggtgaacgacatgctggcgcgcgacaacccgaacaccatgttcgtcaccctgttctgcggccggatcgatctggcggccggacggctggaatactgcaatgccggccacaacccgccgctgctgctgcgccgcggcgccacggcgcccgaggccctgagcacggtctgcggcccggcgctgggggtgatggaagacatgccataccgggcgatgtcgctgaacctctgcgccggcgacgagctgctggtctataccgacggcgtgaccgaggcccacaaccccgacaaggcgctctacggcgacgaccggctgctccgggtgtcggccggcggcatggcggccgatccgaagcgcttcgtcgaccggctgttcgacgacatcgacgatttcgttgccggtgccgaccagtcggacgatatcaccgtcttcgccctgcactacgccggccccggggccgacgccaccaccgcagcccccgaggcactacggagcatcggatgaccctctggaagccctcgaccctgttcggacgtgtcctgctgtcgctgctgatcggcctggcgctcgccggactgctgatcggcctggtgcccgcctcggcccatgccgccccgccctcgcccgaaatccgcgccgcggcggaggcgatcccgccggtgccggggcccgagacccccgaaaagcgcttccgcatcggctattacgaaggcggccagtacggcgactacaagatcatcctggccgccatcgtccgcgggctgatgcagctgggctgggtgccccagatcgatctgccgccgatggaccaggtgccggattccgccaccctctggcggttcctggtcgccaatgccaatggcggccatgtcgaattcgtcggcgacgcccattacaccgccggcgatttcgaccccgagcgccgcaagcaggtccggcccgagatcatcgaacggctgaccggccggcaggatatcgacctgatgatcgccatgggcacctgggcgggccaggatctggccaatgacgccgtcaccacgcctatcgtcgtcgcctccacctcggatcccgtcgcctcgaagatcatcccgtcgccggatgattccggccgtcccaacctgcatgccaaggtcgaacccggccgctatggccgccaggtggagctgttcgacgatatcgtccgggcgaaacgcctgggcgtggtctacgagaacacgctggaaggccgcaccttcgccgcgatcgaggaagtcgaggcggtgtccgccgcccgcggcttcgatctcgtcacctgtttcgcacccttcaacggcgtgccggaagaggtcgcgaaggccgaggcggtgcgctgctacaaggaactggcgcccaaggtcgacgcgctttacatcaccgtccatcgcggcgtgaccagcagcagccttgccgccatcgtcgatgcggcgctggatgccggcgtgcccaccttttcgatggccggatcgggcgacgttcgccggggcgtgctgatgagcatcgcccagggcgatttctcgtatgtcgggctgttccatgccgaggtgatcggccggatcttcaacggtgcggaaccctgggcgctggatcagcgttgggtggcgccggccaagatcgcgctcaatctggagaccatggagatcatcggcttcaacccgccggtcgacattctgctggccgccgacgagatctaccgcaagatcgaacgctgaccgagcccggcggcggcggacgccttgggcgccgccccgcccagggcgacatgccgccgggcgaagaccagacgcgccagccgcgcggccatgtcgtcatggccggcttcgaccatcgcgatcgcccgatcggcgccgctctgccccgtcttaagcacgaaggccggataggcgaggaagcgcgcctcgcgcgcatcgagcccggcccccgccagatcgaccagctccgccgccagacgggccgcggtcaggccgtcgacctcggccgccagcccgtcgcgcatcgcgcgttcgcgcagcagcatcagccgcgcccagccatggcgggcaatgacggccaggccccggtccatcaccgcgagcagccccttctgcagggcgccggccgcactcaccacactggccgccacggcctcgccgcccagatcgatcagctcctgatcgggcagattggcgccgggggcgcggccttccagatagaccgcggaggtcgtctcggccatcagccgggccagggccgcgtcgctgtcgaccaccgcggcgagcgtcgccggctcgggcatgcggccgggggcgaaggcgaaacgcagccgggcatccaggaagttcgacgattgcagcgccgcgaaatgggtggcggaggggcggatctgcaccaccatgtcgtcgccgcgcagccggccgctccagctgcggccttggccgaggaactcccgcagggtcggctggccctcgacctctaccaggccgccgatcttcgaggtgggggccaggtctgcgggcccatgcggcagggccggcagtggtgcatccacgcccagcgcccagcgcatataggcggcaagcccgacaaagggctcggctggcggcacgaaacagctgcggtcgcgggcggcatgggcccccccgcacatccgcgaccagagggtcagccggttttccctgaagccggtcgcgcggccgttctcgtaggggctgttggcaaagagggcgatgaaggcggccgagaagcccagcaccagattgaccgcatcggcgccgcgatctacgggcacatcggtcgacgggctgttatgggccttggcgtcgatgccggccgaatgatcccaaccccgcacctcgttccagtagtcgtagaccggcttgggcgcccgggtcgcgtggtagaaggcctgtgacaccggctggaagggatgctcggccagattgaccagcatgccgcccgaggccgccacggcggcccccacccgatccagcgcctcgcgcgcctcgtcgtcgagttgctccagaccggtgaccggcccgagcgaggcttcgagattgttgaacccgttgtcgaccgagatcatgcccgcggcatcgcgcaggccgaccacccggccgccgaggctgagcggctgcggcgcccggccttcggcatcgccatcggcgaccaggcggtcgaacacatcggggaccgccaggctggtggcgtccgcggccgaggcgatcggcagttcgatctccaccccgaccttgaccgggcgcggcacctgcaggcgctcgacggtcatgagctggcctccgcctcccccgccgcaggcggggcggggcgacggtcgagcaccaggaagagcaggccggccgccagcatcagcccggccgtggccgccagccccgccgtggtgccgaccaccgcgaacaggccgcccacgatcagcggccccagcatctggccgaacttgtcggccgagcgcttcatgctgaccgcccggccgatgccggcacgcgcgacaccggccccctgcaggccatgggcgctctgcgcgccacccgcaatgctgcccgaaacgccgatcaggaacacggcggcgaccagcgccatcagattgccgccgatgctggcgacgaccagggcggcggcggccgccagcgcaccggccacgatgaagggccgcttgtcggtcaccttgtcggtcaaccggccgaaaagcgggccgagcaggatgacggccagaccgttgaccatcagcacgcggccgatatcggactgattgatgccctgttcggccagatagaccggcaccgcgaagttgagcaggccgacctgggcgatcgagaacgggatcacgctgcagaccagcaccagcatgaaggtgcgatcggtgagcaggccgcgccagccgccgccttcctcggccgtcacaggggctgcggcaacaggcttgctgtcggtctcgaccgccagctcgcggccgacgctgacggcgaccagcgccaccaccagcggcatgaccatgaacagggccgcgaccaggaagacattggcatagcccagctgctcggccagcatcgccccgatggcggtgccgcacatctggccgacgaagatgccggcgatcagcccggccgtggcactggcccggcgctcgggcagcgtggtcgcgtagagatggctctggatgcccatccaggcaaagccatagccgagcccgcccagggcgcgcgcggcgatgaaggccgcggggtgggtctgggtcgccatcaccaccagcgaaaccatgttggccagcatgcagaggccgaaaccggtcagcaccggcacctgccagccgcggcgatcggccatgggcccggcgatgagcgcggtgaccagggcacacatcatctcggccgataccggggcggccatcatgatgtcgctggttgcagcgccattacccgcggccagcaggcgcatggccagcggcacgaaggacagcggcagcgaccaggcgagcaggaacaggaaggccatcggccgggcaaagcgcgaatcggcgatgccgcccgtcccgacgcggccgcggaccgcggcaaagacgaagatcagcccctcgcccacgatcatggccgaaaccagcgccagggtgacggcgtcgagcacgcgggactggacgctgtcggcgatggcggcgccggacagcgtgatctcgatgcggccggcggggcggccgccgctgccggcgaccgtggtcagatcccggatcaccaccggcccggcatccgggccggtcacgccggcggcggcgatgcgcgtgccgtcggggccgaccagggcagcaccgccgatcagcggcacctgatcgatcaaccgggcgaaattgtcctcgatccgccccatgaagcggaggccgatgcccttgttgatcagctgatcgagatcattggccaccgaggcggccaggcgctcgccctgacgcgcggccgcggtttcgacggcgctgcggaactcgccgatcgcataggcggcaaaccccgcctgggccagcaccacgaccgcgatgccggccacccgcatccgcttcagccgcaccgcatcagccgcccggccgcgggccgaggcgaagcccagccccagcgtgaccagtacacccagaatggtggccgcggccgccgcagccaccatcgcctgaacggtgcggccgatttcggcggtatgggcctcttcgggcagcgccacgcccagatgagcgaccaccgcgccaccggcatcgcggatcgggaacagcacccagcggcggccggccgccacgcgctcgaccacctcaccccccttgtccgcgccgaccaccggcaccgccgcctcttcgccgcggctgcccagcacatggcccttcagatcgatcaccgccgcctgaccggccagcgggatgtcctggcggacatcgtcgagcaggtcgtcgaggcccgagaatttctcgatcggcttgccgtagcgcacggcgacctgcaaccggtcggcccatttgccgccgatcgcggtcacctcgctgacggtcgcctcggcatcgacacgcttcagcgcggtgaggttcaggaaaccggcaatgcccatgcacaccggcagcagcagcgccagggcaagggtgagacggaagatcggcccgcgggcccgggtggcgaggctcatggaaagtgattttccgctatgcaggaccatccccaccaagggggccggattccccgcatcctacccggatgtatcgattttggcccgcgcttcctgtgcccaggtcaacccggattgacgcccatatgccgcatcgcgggatttgccgaccgaaacgcgaaccgccccggtagcgatgctaccggggcggtcgggacaggtctgcgggcggtcactcggccgcggcgcgggcctctgccggcggggtccagcgcagcaccggcttgcgggcggcgagcgtctcgtcgagacgccggcgcggcgcatagcgcggggcggcatggaaggcttccgcctcgcccgccttggcgcggcgggcgagcgagagcagcgcgtcgaccagctggtccagcgcctgcttcgattcggtctcggtcggctcgatcagcatcgcgccatgcaccaccagcgggaagtacatggtcatcgggtggaagccctcgtcgatcatcgccttggcgaagtcgagcgtgctgaccccggtgccttcgaggaagccgtcatcgaacaggcattcatgcatggcggggccggggaaggccggggtcatctcttccgagagccgggccatcaggtagttggccgccagcaccgcatcgcccgaagccgcatgcaggccgtcgcggcccaggctcttcatataggcgagcgcccgggtgaacatgcccgcctggccgaagaaggccttgagccggccgaccgccgggccgcccggcacggcttcgaccgtgtagctgccatcgtcctgccggcggatccgcggacccggtgccacatgggccaggctttcggcgaagaccaccgggcccgagcccgggccgccgccgccatgcggggtggagaaggtcttgtgcaggttgatgtgcatgcagtcgaagccgagttcggccggcttcacccgcccgacgatggcgttgaaattggcgccgtcgccgtagaaataggcgcccacctcgtgcaccgcatcggcgatcaccttcacgtcccgttcgaacaggccgcaggtgttggggttggtcagcatcaccgccgcgacatcggggccaagcgccgccttcagcgccgccacatcgacccggccgtcatcggtgcccggaatgctctgcacggtatagccgcagagcacggccgaggcggggttggtgccatgggcactgtcgggcacgatcacgcgcctgcgggcatcgccgcgggcgacatgggcggcacggatcgccatcagcccggccagctcgccatgggcgccggcggcaggggccagcgtcacctcggtcatgccggtcagctcggtcagccaggtgcccagctcgtgcatcatgccgagcgcgccctggatggtggaaaccggctgcagcgggtgcagatcggcgaagcccggcatccgcgccaccttttcgttcaggcgcggattgtacttcatcgtgcacgagccgagcgggaagagccccgaatcgatcgagtagttcttctgcgacaggcgcacgaaatggcgcaccacctgcggctcggccaggtcgggcaggccgaccggggccttgcgcaccacaccgcccagccgactcttcgtctcgggcaccggcgccagatcgacgccgatccggccgggggtgccctgttcgaagatcagcggctcttcaagctgcaggccgcgattgccggtcgcggtttccgggatcatcgagatctccggcgtctcgtcacgcgagacccggccctgggaacggtccatcgcggtcatgccgaaagctcctcggtcagcgccgaggccagcgcctcgacatcctcgtcggtgacgagttcggtcaccgccaccaccagcaggttctgcagtgccgccgcatcggcctcgacgccgtcgagcaccgccggcgcgatgcccgccagaatgccgcgcgccgccagccgctccaccaccggtgccgccggccgccccagatcgagggtgaattcgttgaagaaggtgtcgttgaccaggctgagacccggcaccgccgccaggcgatcggcggcacgacccgccagcgcatggttcagcgccgccagatgcgtcagcccccgctcaccaagcatcgccagatgaatggtgaaggccgaggcgcagagaccggccgaggtgcagatgttgctggtcgccttgtcgcggcggatgtgctgctcgcgggtcgacagcgtcagcacgaaaccgcggcggccatcggcatccacggtctcgccgcagagccggcccggcatctggcggaggaatttggaccgggtggcgaagagcccgacggtcggcccgccgaaggtgagcgcattgccgaagctctggccctcgccgaccacgatatcggcgcccatggcgccggggctttcgaccgcgcccagcgacaccgcctcggtcaccgccacgatcagcagcgcgcccttggcatgcaccgcctgggccagcgccgtcaggtcgcggacctggccgaagaagccggggttctgcacgatcaccgccgcggtgccggcatcgacccgggccgcgacatcatcttccgccatggggtcggccggggcgaggtcgacctcgatgccggcaaagcccagctggttctgcaccacggcgcggtaatggggatggacggagcccgccaccaccaccttgttccgccgggtgatccgcaccgccatcatgccggcctcggccgccgcggtagagccgtcatagagcgaggcattggccacgtccatgccggtcagcagggccacctgggtctggaactcgaacagggtctgcagggtgccctgggcgatttccggctggtagggggtgtaggcggtcaggaattcggaccgctggatcagatggtcgacggcggccggcacatggtggcggtagagcccgccgcccacgaagaacggtccgtcaccggcggcccggctcgcccgggcataagcggccatctcgcgctcgacctgaagctcgctcttgcccggcgccacggcctggaaggcctcggggccgtgcagcagaccggccggcacgtcggaatacagggcatcgatcgacggggccccgatcacgcggagcatctccgcgcggtcctcacccgtcaggggcagataacgcatgatgagatcactccagctccgcgatgtaggacgcataggcgtcctcgtccatcagctcgtcgagctgaccggcatcggtgacgcggaccttgaagaaccagccctcgcccgcagggtcgctgttgaccaggctcgggtcgtcgaccaccgcctgattggcttcgaccacctcgccgtcgatcggcgcatagacgtcgctcgcggccttgaccgattcgaccaccgcggcatcgtcgccggcggccagagaccgcccgacctcgggcagttcgacgaacaccacatcgcccagctgtccctgggcgtaatcggtgatgccgacggttgcaacctcgccgtcgaggtcgatccattcatggtctttggtgaaacgcagagtgctcatgaggaagctcgctgttccctgatggggcgggagtgttgcaggtcagcgccggtagcgatgcggcgcgaaaggcatgggggcgacggtcgccgggcgggatttcccgcggacgtcgagggcaagggcggtgccgggggcggccagatcggcgcggacataagccatggccaccggcccgtcgacgctggggccgaagccgccgctggtgacacggccgacggtctcgccggttgcagggtcgatcacgtcggtgccttcgcgcgcgatcaccttgccctcggggatgaggccgacgcgcttgcgcgccgggccctcggcaaaggcggcggcgatcaccgccgccccgggatagccggcatcggcggtgcggcgacgcttcgcgatcgaccagccgagcccggcttcgaccggattggtcgagaggtcgatatcgtggccgtagaggcagagcccggcttcgaggcgcaggctgtcgcgggcgccgagaccgatcggcgccacccgctggtcggccagcagcttgccggccaggctttccgcccgatcggccggaaccgaaatctcgtagccgtcctcgccggtatagccggaccggctgaccaggcagggaatgccggcgatgtcgagcggctgcatcgacatgaaggccatgtcggccgccgcgggcgccagcgccgccagcacggctgccgcctcggggccctgcagggcgagcagggcgcgatcatccaggatgtcgaggctgtggccggccggcagatgcgccgcgatatgggcgaaatcatcggccttgcaggccgcgttcaccaccaggaagacatgggtgtcgaaccgcgtcgccatcaggtcgtcgcggatgccgccgtcatcggtggtcagctgggtatagcgcatccggccgaggccgaggccggtgatgtcgcccggcaccaggttttcgagcgccgccgccgcatccggcccggtgatccgtgcctggcccatatgcgagacgtcgaacagccccgcatgggtgcgggtgtgcagatgctcgcccttgatgcccatgggatactggaccggcatcagatagcccgcaaagggcaccatcttgccgccctgcgccagatgcagatcgtaaagcggggtcttgagaagatcggcgggggtaccgccctgggtcggctggtccggaccggacatcgggtcgctccgagaaaacaggattgcggccgcgcatctcccaggtccggcgccgccggtcgatccgacgttccgtccccggagatggccccgctctgtcttcggacctgaaagattgtgcgccgccatgcccccgcggatgcggtgggccgtcgtcgcacttaccccttcggtgagacgccgcgatcttccgcgccgcctgctttccagagtgacattcccctgcggtccctggtgcctgagagtttaccggggccggttgctccttcggcggcactgcctcgacattctcccgaccatcgaccggtcgggcgtcgcgcagcgcgctctcccacagggttcgtctgtcacgtagcctccgagcgtggccaggatacacgagagggccgcagggcacaatccggcccgcagccctctcgcgtcaacggatcgcgatccggaccgggatggttccggcccgggctgcgcgtcccccccgggtcctgctgccctcttaccggctgtggccgcgctggaactccagctgctcgcggtcgagctgaaagccgatcagcagggcatagtcggcaccggtgctggtgccgggcagcggcacgcggatgctgagctcttccttcgacccggccttcagccggttggccgggaagggcagatccgaccggaagacctgcttgttcaggatggtctgttcccggtcggccaccgccacgtaataatcgaaggcggttgcggtggcatcgggggcggccgggccgcgttcggcatcgatcaccacggtcagcgccacatccagatagcgcttgccgtcgtcggtgtcggcatcgcaggtccattgggcatcggcgatccggcccaggaaacgcacgccggtcacgtccttggcacccggttcgatctgcaccgcctgggcggtgtcgcgcagcaccaccacgcggggacagaccggcggctcggcgcgcgagaaggcgccgcagccggagacgaccagcgccacacccgacgcggccagggccagggccgcccgacggcgcagggccgcccgcgtcgtcgtcctgttcattgccgtttcgggaccggacgcggaatgggactgtgccacgacgaagcgctccgtgatcgtttatcgccggatcgcccggggaccgggcggccggctgagacaagcgccactttatagcgatggcgcgcgggcgcgcaatgccgccgcccgcgcgtgtccgcgtcacctcatagccgcgtcatcaaggtcacaatctttcgtgactgccatcacacatgggtccgtcggcggtctgcttgcagccgcagaaccagaccgtgccgtcctcttcggccttccaggccttggggccgagcccggtgcccttgtgggtgccgtcgcagaaaggctgtttcgtgctcagcccgcaggaacaccaccaataggtccgccccgccttcaccgccacctcaaagggctccgcctgcgccaccaccggtgccgcggccggcggcgtggcgtcgttctccatggtcatgtctcacccttcccgtctcttgccggccggatcggccgatgggtcgtcatctcgtgcctcggtgccgccccgtcggcgtgatgcgcgctttgattgctttatttccgggacaagcatctatgagtgtagtggcggagaatcgccgcgggcaagggccgggattggtctttccaggcaacgggatgcgtgcgcatggtgttgaactcgggcgccgcccgtgccataccgcaccctatgcgagcccccctccccggatccgcccgtcggatccttcagcccggagagccgacgcgatgacccaggcggccccgacctccccagaagcagccactcctgccacggtgaccatcgtgctggccgaaccccgcggtttctgcgccggggtcgaccgggcgatccagatcgtcgagagggcgatcgaacgcttcggcgcgccggtttatgtccgccacgagatcgtccacaacaagaccgtggtgcaggatctggcagccaagggcgcggtgttcgtggaggagctggacgaggtgccggacggggtgccggtgatcttttcggcccatggcgtgcccaaatcggtgccggccgaggccgcacggcgggagctgcacgcgatcgacgccacctgcccgctggtctccaaggttcatcgcgaagccgagcgccatcacggcgaggggcgccatgtgctgctgatcggccatgccggccaccccgaggtgattggcaccatgggccagctgcccgagggcgccgtcgacctgatcgagagcatcgccgatgccgaggcctatcagccgccgcggctcgggctggagcttgccttcgcgacccagaccaccctgtcggtggccgacacctcgggcatcatcgaagtgctgcgccgccgctttcccgagattgccggcccccggcgcgaggatatctgctatgccaccaccaaccgccaggaggccgtcgcccgcatcgcggccgaggttcaggcggtgctggtgatcggggcgccgaattcctcgaactcccgccggctggtcgaaacggcggcggtgtcgggctgcgccaatgcccggctgatccagaccgcggccgagatcgactggtcgcttctggacgggatcacccggatcggcatcaccgccggcgcctctgcccccgaagtgctggtggacgaggtcatcgcggccttccgcgcccgcggcccggtctcgatcgaacgggtgaccacggccgaggaacgggtggtgttcaagctgccgcccgaactcaatcactgagcggttccccccggaccaccccccgcaaccagaggagacgcgccacgggatccgcccgggcgcaacaggaggcatcgaccggaatggcggtctatacggcggtcgacgacgacgacatgcgcgcactgctcagcggctatgatatcggccctttcgagcggttgcagggcatccagcagggggtggagaactccaactggtttctcgacgccggcggccggcgctacgtgctgacggtctatgagaagcgggtcgaccccgcggatctgccctatttcctgaacctgatggagcacctcacccggcgcggcatccgctgcccggaaccggtgcacgaccggtcgggccgggcgctggtggaactggccggcaagccggcggcgatcttcaccttcctgcccggccgcggccccggccggatcctgcccgcccattgccgggcgctgggcacggcgctggccgaactgcatctcgcgaccgcggatttcaccggccggcgccccaatgcgctggccctgcccggctggcaggggctcgccgcccgcatcggcggtcgcgccgacgagatcgtgccgggcctggccgccgagatcgccgacacgcttgaccggctggccacggcctggccggccgatctgcccgcgggcacgatccatgccgacctcttccccgacaatgtgttctacgagcggtcggaccgggtgtcggggctgatcgatttctacttcgcctgctccgacgccttcgcctacgaaatcgcgatctgcatcaatgcctggtgcttcgagccggacgggcagttcaacgtgaccaaggcccggctgatgctgggcgcctatcgcaaggtccggccgttctcggacgccgagctggcggccctgccgctgctctgcgaaggggcggcgctgcgcttcctcctcacccgcgcctatgactggctgaatcaggtcgagggggcgctggtgaagcccaaggatccgctcgaatacctccacaagctgcgcttccaccgcagcgttacgggaccgggcgcctatggcctcgactgacgcaccgaagaagatcgtcgaagccttcaccgacggcgcctgttcgggcaatcccggccccggcggctggggcgtgctgctgcgctggggagagctggaacgcgagatgagcggcggcgagccgctcaccaccaacaaccgcatggagctgaccgcggcgatcgaggcgctgcgcgcgctgaaacgcccgaccacgatccggatctgcaccgacagcacctatgtgcgcgacggcatcaccaaatggatccatggctggaagcgcaacggctggaagaccgcatccaaggatccggtcaagaacgccgatctctggcaggaactggacgggctggtccgcggccatacggtggaatgggaatgggtccgcggccatgccggccaccccgaaaacgaacgcgccgacgcgctggcgcgcgccgggattccgaagcggggttgacctcgcccgagggatctgacgggtttatcgcgtcccgaacagccggtcgccggcatcgcccaggcccgggcggatataggcgttttcgtccaggcagcggtcgacggcggcgacatagaccttcacctgcggatgggcgcgggtgaagacctccaggccttcgggggccgcaatcagggccatgaagcggatctggtcgtcggcgacgccataacggttcagcacctcgaccgcatgcaccgccgaattgccggtggcgagcatcgggtcgaccaggatgaaagtccgaccctcggccttgggcagcttcaccagatattcgaccggttctttggtctcttcgtcgcggtagaggccgacatggccgatgcgggccgagggcatcagctcggtcaggccgtcggccatgccgaggccggcgcgcaggatcggcaccaccgcgaccttcttgccctcgatcaccggcacggccacgcgttcgagcggcgtctccagctcttcatgagtgatcggcaggctgcgggtgatctcgtagcccatcagcagggcgatctcgcgcagcaactggcggaaggtcttggtcgaggtcgcctggttccgcatatggctgagtttgtgcaggatcagcggatggtcgagcacatgcaggttggggaaacgcgcggccaggtcgcggtggtcggtggtggtcttggtcatatgggctccgcgatggctgggcgggcgttgaaaagatgccggtacggcgatacggccggcacccgggacgggatgccggccgcgccgccgatgcggcaggcggagcccgaaggctccgcggcaggatcagagctggccgagcagggtgccggcgtcgctcacctcgaaagcgccgggcttttcgacgttcagctgcgtgacgacgccgtccttgaccagcatcgaataacgctgcgagcgcaggcccatgccgaagcccgtgccgtcgagcgtcaggcccagcgccttggtcaggtcgccattgccgtcggccagcaggcggaccttgccgtcgacgccctgggccttgccccaggcgcccatcacgaaggcgtcgttgaccgagatgcagacgatctcgtcgacgcccttggcgacgatctgatcggcctgctccacgaagcccggcagatgacgcgccgagcaggtgggggtgaaggcgccgggcacggcgaagaccgccacggtgcggccggcgaacagctcgtcggtggacaccttgttcgggccgtccgcggtcatctcgaccagggtggctgccggaatcttgtcgccgatggaaatggtcatgatctcgctctcctggctcggaactcgcgtctcgtctgcgggggcggccctgtcggtgtggccggccctccggatcgccgccatttaaggccggttccggtgacgggcgcaagtccgcgggcgcgggtttcgcgctcaaccggcccctgcgccgcgcgcctgatccagcgcccgggtcacggcatcggcggtcagcagttcgggcagcaccagcccctgcggcgccgcaggcccgtagaccacgttgaagggaatgccatagcggccgaagcccgccagatagtcggcaatcaccggatcgggccgggtccagtcggccttcatcgccaccacatcgggcgtggccaggcggccggccaccggatccaccgccagcacccgttcctcgttgacgatgcaggtgacgcaccagctggcggtgacgtcgacgaacaccacccggcccttcgccacctcggcggtgatcgccccggcctcgaacgccgtccagggcccctcggccgcaatcgactgcaggccgcggccggacgggggcgaggccagaaccgcggttgcgaccgccgccaccgccagaccgccgacaccggcccagcgcagcagccgggccttggtgatgaccagcggcagcagggcggcgagcgccgccagcaccgccaccgccgcagcagcacccggctgaaccaggcggctgagcaccagagtgagccagagggcggtccccgccagcgccacgcccatcgcaaccttcacccagaccatccagcgccccggccggggcagcaggcggatggccgagggcaccgccgcgatcgccagatagggcagcgccatgcccagccccatggcggcaaagaccgccaggatgtcggccgtaccgccggcgagcgcgaagcccagcgccgtgccgacgaagggcgcagaacagggggtggcgagcagggtcgccaccacgccgctcatcatcgcccggccgagcttcggccgccccccggcctcgggcaccacatcgcgggcgagcccgcccgacagcacgggggcccggatggtgaagacccccagctgcgaggccgcgaacagcgccatgatcacgatcatcacgccgatgaaggccggctgctggaactgaatgccccagccgaccgcgaccccggccagcttcagcccggccgccgccagcgccagcgcgaggaaggacaacaggatgccggcagccgtcgccagcaggctggccctgacatcgccgcggccgaggccgcgggtcgcgaccagccccatcagcttgatcgacagcaccggcagcacgcagggcatgacgttcaggataagcccgccgagcaggccgatcagcagggcggcggccagcccgccttcggggccgagcagggtggcgggcgccggcaccacctgggcggtggtctcgaccgcccggcggtcgtctccggtgccgtcgaccaaagtgagccggaccgtctcgcccagaagccgggcatcggcggcaggcggggcgacgtcgctcacgaagcggatccgccggccgtcatccagccgtcgcgcctcgggcggcaggaaagcgaagccgtccggcccctcgatgaagacatccgccgtggggccgaagggcgtatcgctcttcgcctccaccaccagccgcgcgggtgcatcgccctcgcccgcgatccagccggccgagaccgctgcgaagggagcggcagccgggtcggaggcgacggccggcaccgctgcccgggccgcagcgatcgcggcttcggcctcggccgcggtgcggtcgagcggatcggccggccccgccggcacgtcgagcacaaggtcggcggtcaccggaatgcacagcgcctcgcagacctgatagtcgacccgcaaccgcagtggcgctgccggtgcggccgccgccagtccggctgtcaccggcagcaggacgcgtttctcataggcataggtgtggatggtctcgaaggcggtgaaacgctcgggcagcggccagtggatctgcgtggcggcgatctgtccgtcggcgatcgaggggctggccccatcgattgcgggcggcaggcccgcatcgccgggcgagcgccagtagagcttccaccccggctccatccggaaatccagaccgagcgacagctccccccgcgccgcctcatccggggtctgcggcgccgccaccagccgcaccgccgagcgctgcccctccgcccaggggccgatccagccgtgcggcgcctctgccgccagggcgggcgccattatcgtcagacaggcgaaggccagcatgatgcccgaaccgaaggcggttatggccttctgccggaggggctggcggtctgtgcggcggatatgcatgcggcggtcccatgggttcctgagccgggccggcagcagccggccattcgcggggcgaacagatgtgcccttgcgcatgctccggcgccagcctacctaatccagacgtaactataggcggcatggcgccggaaggacatgcgacagggcgtcatgtggcggcgaccacgtgattgtgatgatccttcgtgcgcttccccacagcgggcgaccgcaacaacacgggcgagaaggtagtcgggcaatggcagggatgcgggcagaccgccccatggcggcagcaaccaccacgcctttcgagatgtcgggccccgagggcctgaccggcaaggtgctgatcgcgatgccgcggctggaggacccgtggttcaccaagacggtgatctatctctgtgcccattccgacgacggcgccatggggctggtggtcaaccgggtgctcgacacggtcgacttccccgagcttctttcacagctgggcctggattgcagcccggaagccgcaacggtgaaggtgcatttcggcggaccggtggagaccggccgcggtttcgtgctccattctaccgactatgtgctggcgaccagcctgcggatcgatgacgaggtggcgctgaccgcgaccctcgacgtgctgaaggcgatgaccgagggccacggccccgatcgcacgctcgtcgccctcggatatgccggctggggccccggtcagctggagaccgaaattcagagcaacagctggctggtggtcgatgccgatgccgagctgctgttcgaaggcgatgtcgaggggaagtggcgcgaggcgatcggccggctgggcgtcgacctcggccatctctccggcgaaggcggccatgcctgactgcgacgcgtgggcatgcagcatcccacggccccccggtcccggccccgcgggtgctgcgccacaaccccttgatttcgtgtgagatgagaccacgcctggaaaaaacttcgcagcgtctgtcgattcactattgcgaatcattctcagtctcatattatcaacggcgtgcaaacgtttcattcccgtttcgcacgactcgtcctcacacacgcgactttgccggccaggtactccctggccggccttttttttgcgcgcccgactcagagcccgtcataaccgttcggcgccggccagggccaggcggcgagtggggcgggatcgggccggaagatctcgaccttgagcgggtagcagcgcgccgcatcgcttgaatgactggcgctgcaatcgccgccgggacaggcggagagcgccgccagcaggtcgatctcggcgaagagttccagatagtctcccggacggaccgggctcgccttcatgaagtactggtgcgtgtcgcgggtgaagccggtgcacatgaagacgttgagcacgtcgtggacatggggctccgccgcccgcgggctgagcccggtcgcctccgccagtgcccggcagagattggaatggcagcagtgatgataatcggtgccggtcagcagccggttggtataggggtcgcagcgcgtgccgatcacgtcgtgcaccccgccgccatcggcatcccagccataccagccgagggtgtcgtggctgatcgtcgccatcggccgcagggcaggcagcgtgctccacagccggtggccggtggtgacatgggttgcatgcagcgcccgcgtcttgccgctgaagaaccgctccgacagatcatgcgcattccagagattgagatcgccgacctgcggcccctcgatcgagaggatgcggaagaaatgcccccggggcacgcggaaggcccgcccgtcgcggggcggcaccacaagctcgtcgatcttctccatccctgcccgcgccgcctccagcgccgccatgtcgggggcgggcaggctgccgttcggatagaccaccaccggtcgcggaccggccgtttcctgcgtctcgatcgtcatcatgccctccccttctgcgaagcgcggttcgcccaagggtaacagaaggtgggcaatgggttcagccggcgtcgatcaccgccggcggcagcggccggcggcggcgccagtcggtcgcgatcaggccgaacaggcgatgatcggtccagcggccgtcgatcagcagatattcccgcgcatagccttcggattcgaagccgagcttttccagcaggccgatgctgcgatggttctcgggcaggcaggccgcttccagccggtgcagccccagcgtgtcgaagacgaaatcggccgcacccgccagggcctcggtcatatagcccttgcgggcaacatgcgcgccgatccagtagccgacattgcacgactggaccacgccatagcggatgttgttcagggtgagcccgccagccaggctcaacgcctcgcgcccttcgctgcagccgtcgcccgcgtcacggacgaagacgtggaaggcgagccccatgccccggcgggcgatcatgcgatagtggccgacccggcggcgataggccccgcggctcaagggatcattgccccaggacggctcccagcgctccagaaactcccgcgaggcctcgcgcacctctgcccattcgcgatagtcgaccagacgcgccggacgcatcaccacccgcggcgtgatgatccgcggccggtcgccgccatccatcgaggcaaagggccacattccgggtgcctccccgtccgccggccggtcagtcgcccgcgcccttgcggacgcggtagacgaaacggggaccgtcgcggcgctggtcgagcaggacatggccgccggtgtcgcagaaggccggaatgtcgatataggaggcgggatcggtggcgatcacctcgatcaccgcaccggcggccagggtgttcagcgccttgcgggccttcagcaccggccaggggcagaccagcccctcggcatcgaccaccagggcgaccggctcgtcgggattgcctggggcctgggaattgtctggggcctggggattgcctggggcctgcggctctcccgccccggtggtgcccgcctgcatgcttcgtcctgccgtcatgccgtctcctgcctgcggtcggatcctgagccctgccgtcaaccgaagcgacggcggagatcgtcgtaggattgcacccgggcgatcggccccagcgccgccagggtcggcgcgccgccgccgagcagccggcccgccagtcgcgacacctgatcgggcgtcaccgcctgcagctccgccacggtctcggccacggactgtacccggccatggatgatcagcgactgggcaaggcgttcggcgcgcgcggtggtgctttccagccccatcagcagcccggccttgagctgcgcgaacgagcggcgaagctcttcctcgcccacccggtcggcaacgcccagggtctcgtcgatgatcaccggcatcgcctcggcgatctcgtcctcggcggccgcgacatagatgccgaacaggccatgatcctcgaacgggctcgcgaaggaatagacgttgtagcagaggccgcgcttctcgcgcacctcctggaaaaggcgcgaggacatgccgccgcccagcagcgtggcgagcagctgcgaggcgtgatagtcctcgtgggcatagccgatgccggggaagcccagcgtcagatgcacctggcccagatgatccttgcgccggcgcagatcgccgccgacataggcggcagggtcgatgtcgcgcggctcggtcgcgggcagggcgtcgaagaagcgggtcgccagatcgaccagccggtcgtgatccaccttgcccgccgccgccagcaccatgcggctggcggtatactggcggcgcatatagccggcaatggcctggcgcggcatgccgcgcacgatctccaccggccccaggatcggccggcccagaccctgatcgggataggctgcgatctggaaatggtcgaagaccacatcttccggcatgtcgtcggccgacaggatctcctgcaccaccaccgagcgctcgcgctccagctcgtccgggtcgaagaccgaatgctgcaggatgtcggcgagcacgtcgacgcccagctccagatcctcggccatcagcttcaggtaatagacggtctgctcgcgcgaggtataggcgttcatgtagccgcccactgcctcgacctcttcggccagaccctgggcggtgcgccgctcggtgcccttgaaggccatatgctcgagcagatgcgagacgccgttgatctccgccggctcgtggcgtgtgcccgcatgcacccagaccccgacggtgacggtctcgacatgggccatgctgtcggtggccacacgcatgccgttgggcagggtggtgatgcggatgctggaaccgtcgagactcatgatggcgtcttctgcccttctgtcggagatgtaaccggcggatcgtacccgaccggagcggtcaggcgttgcggcggtgcgacaggatatgggaggtcaggatcgaaacgtcagcctccagcgtgtcatatcgctccggccgctccatcaggtctgccatgcgtgcaggcagggccggacgacggccgatcgccttttccaccgcatccgggaacttggccggatgggcggtcgccagcaccaccaccggcgtgccggccggcacgccctcgcggcggtcgcgggccaccgccacgcccacggcggtgtgcggatccaggatctcgccggtctcggcgaagacacgggcgatggtgtcgatggtgcgggcgtcgtcggccgcaccggcatcgaagagcagtcgggccttggcgatctcggcatcgctgaccggcagatggccggtttcgcggaaggtgcggatcgcagccgcggtcgcctcgccgtcgcggcccttcagatcgaagagcagccgctcgaaattgctggcgacctgaatgtccatcgacgggctccaggtcggccgcacgccggccgaggaatagtcgccattgcggaagaaccgcgccaggatgtcgttctcgttggtggccacgatcagcttcgccaccggcaggcccatcgaggccgcgatatagccggcatagacgtcgccgaaattgccggtcggcacggcgaaggcgacctcgcgatcgggcgcccccagggccagagcggcgtggaagtaatagaccacctgggcggcgatgcgggcccagttgatcgagttgatcgcggtcagcccgacctggtcgcggaaggcctcgtcaccgaaagccgccttcaccatgtcctgggcatcgtcgaaggtgccgcggatggcgatgttgtggacattgggcgagagcacggtggtcatctgccggcgctgcacctcggaggtgcggcccaagggatgcaggatgaacacgtccagccgcgcgcggtcgcggcaggcctcgatcgccgccgagccggtatcgcccgaggtggcgcccaggatcacgccgcgccggtcggaccgatccagcgcatgatcgaacagccggcccagcagctgcagggcgaaatccttgaaggcgagggtcgggccgtggaacagctccatcacccattcattggcgcccagctgcttcagcggcgccaccgccttgtggccgaagccggcataggtgtcgtcgatcatccggtcgagatcggccggcgcaatggtcgtgccgacgaagagccgcatcacctgcttcgcaaggcccgcataatccagcccccgccaggcccgcatggtggccggctcgacccggggccagctctcgggcagatagaggccgccgtcgcgggcgagaccgtcgaggagaacctgaccgaaatcgagccgcggcgcgcggccgcgggtgctgatgtactgcacggaggtcaaccttcgtcgtaggaggcagaagaggggggaggcagaagaggggcgcgcgaccggccggaaaagcctggacgcgccgagactaccgggaccggcgcgcccgatcaatcgaccagcggcgccggtcagccatgtggacctgtccgccccggcgccgggaccctggtcaggccgggccttcgcccagatagcggcggcgcagatggctgaggaaggcatcggccgagagtggcgcgccggtcgcccgttcgatcagctcgtcggccgaccagcggcagccctggccgtggacgtgggcgcgcagccagccgagcaggcccgagaagtcgccgcgggccagatcgtcgtcgagcgccggcagggcccggcgggcggcctggaacagctgtgccgccgccatcgcccccagcgaataggtcggaaaatagccgaaggcgccgctcggccagtggatgtcctgcaggcagccgtcgcgatcggtgtcgggcaccacgccgaccagccgggccatgccctcgcgccaggcgccgggcaggtcgtccacggcgaggtctccggcgatcatcgcccgctccagcccgtagcgcagcatgacatggccgggataggtcacctcgtcggcattgacccggatgaagcccggccgcacccgcaccatcagcgcatggagattgtcggcatcataggccggatcgtcggcatccgcaccgaaggcctcgcgcgccgcggcggcgaaggcggtcatgaagggccggctccggctggcctgcatctcggtcagcagcgactggctttcgtggatggtcatgccgcgggcaagccccaccggctggtcgcgccagtcgcgcggcaggccgtgctcatagagcgcatggccggtttcgtgcagaaccgccatggcgctttcggcgaaatcggcctcgtcatagcgggtggtgatgcgcagatcgtcgggcacgccgcccgaaaacgggtggtggctgacatccagccggccatgatcgaagggaaagcccgccatggtcatcagccggatgccgagcgcgcgctgcgccgccaccgggaacggcccctgcggccggaccggctggcgacgcgcggcctgggcggcaagtgccgcgtcgcggatcaccggcagctccgtctccagccgcgcgaagatccggtcgatatcggccgtgcgccggcccggatcataggcgtcgagcagggcctcgtaaggcggcaggccgagggcggcgcccttggcggcggcggcctcgcgctccagcttcagcacctcggcgagcgccggcgcgaagcgggcgaaatcatccgccgcccgggcctcgcgccagatcatctcggaggtcgaggccgcttccgcccgtcgccggaccagatcggccggcaaggcagtcgcatgggcgtggcgccggcgcatttcggccagattggcctgctgccagcccaaccggtcggctgccgcctggtccgccggggcggtcgccgccagctccgctgccgcatcgtcgaacagcgccggtaggtcggccgcggtcaggatgtcatggccgatctcggccagcgtcgccatctgggccgaacggaccgtggcgccgcccttgggcatgttcaccgcccagtcccagctgagcacgccctcggcgccctcgatatgcgacaggcggcggaagcgcgcctcgagttcggtcatggccggcatgggcggaagcgtccttgtgagcggatcagaaatagtcaggcgccgcgcgcgggcatcgcctggccggcggcaggctccggccggccgcggggtaccgcggtgccggggccgaaggccagatgcagcagggtcacgaccagcgaggccagcaccagcacgcccatgccctgatgggtggcggccgtccagaccggcacctgcaggaagatgaccgccgcgccgacaccgacctgaagcgcgaccaggccgatggtgcggtgcatgtcgcgcgcaaagcccggcgcccggcgccgggtgcggcgcgcccagaggaacaaccccagaatggcgagcgccgtgacgccggccagcacccggtgggtgaagtgcagcgcgatcagcggatcgtcgagcggcggcaccaccgcgccatcgcagagcggccaggtcgagcaggcgagcgaggcgccgttcttggccatcatcgccccggcggcgatggtcgagagcgcaagcagggccaccgcgaagacggcgagccgggcaccgcgggcgacaggctcggtccagaccagcgcgctctgtgccgggcggccggccgagacatacatgccgatcagcatcgccagcaccagctgggcgttggagaggtgaaccgcgacgctccagggagagttccggtccagcaccgtcaatccgccgagcaggccctgcaccagcagcagcgccagggccgcgatgccgaacagggccgggcgcaggttttcacgccgcatcaccagcgcccagatcgccagaatcagggtcagtggcccgacgatgatgccggcgatgaagcggtgcacccattcatacatcacctgggtgaaggtgtagtcgatcccgggcacggtcgcgagtttcgccggggtcggcacccagaagccgtagcaatgcggccagtcggggcaggacagcccggaattggtcgcgcggatgacggcacccagaacgatcagcacgaaggtggcgacgatggcgatgccggtgacggcacggaagcgacggatagagggtttcatcggacggccgtaacggttcgggtcagagagcgatcaggcggcaggcaggcggtcggcgatcggccgcaggcgggcggatcaatgccgccgcctgtagacgacatagatcacgatcagcgagatcgccagcgcataccaggtgatcgcgtactgaagatggtcgttgggcagctccgaccgggtctggccgcccttgggcaggtcgcccgggatcggggtcgcatcggcctcgacatagaccggtgccagggtctcgccgacgaaatcccccatcaccttcgggtcgatggtgaaccagaaattctcggacggccggttgtcgggcaccacccaggctgtggttctgggcacacgggcgacgccggtgacggtcacctcgcccgggatctggccggcggcacgggtggccggatccttgtggtcgagcggcacccagccgcggctgaccagcacggtctgcgccgcgccctcgggcaggtcggtgcgctcgaacggcgtcaggatgtggtagccggaattgccgttgagcgatttggccgcctgatagagttccttgtcgtggcggaaatggccggtcatccgcacccggcggaaggaccattcggccagctcttcgggtgtggtggccgggccgaagaccgggagcgcgaccggatcggcggcgaggcttgccgcacgctgctcgatcagatcggtcttccaggccaggcgctgaacctgccaggtgccgaggccgagcatggccgccacggccagcaccacgaggacgagcagaagtcccgcccgttcaggctttctggcagcggggcggccggcgcgaccggcatgggggggaccggacggcgacggatcagcggcgggcatgatggggggtcagtctccggtggtgccgtccgcatcccggccgaggccgaggacgcggtggcggtattgctgggcgaccatccatgccttcatcggccggagcaggccgatcgacaggaccaccgccagcggcagccagatcacgagatgcaaccagatcggcggcgcccaggtgagttccacccagagcaccagcgccatcaggatgaagccggcgatcaggatcacgaaagcggccggaccgtcctcgctcgccacgtcccgcaggtccaggccgcagcggtcgcaggaatcacgaacggcgagaagcccccggaacaggcgcccctcgccgcagcgtggacagcggcagcgaaggccggcgaccagcgggttaaccgccggccagtccccgcctccgccctgccgatcggtcatcagcggccccagacgtagattgcgacgaacaggaacagccagaccacgtcgacgaaatgccagtaccaggccgccgcctcgaagccgatgtgcttctgggggctgaactggcgggcgatcgcccggcgcaggcagacggccaggaagatggtgccgaccagcacatggaagccgtggaacccggtcgccatgtagaaggtggaggcatagacgccatcggtgaaggcgaaggtggcgtggctgtattcataggcctggacgcaggagaaaaacacgccgaggccgacggtgatcgccagcatctgcacggtggtgcggttgtcgccctcgcgcagcgcatgatgcgcccaggtcaccgtggtgcccgagagcagcaggatggtggtgttcatcagcggcaggtgccagggatcgaaggtctcgatgccctcgggcggccagaccccgccgaccgcttcggtcgggaacagcgaggcgttgaaataggcccagaagaaggcgacgaagaacatcacctccgaagcgatgaacagcaccatgcccatgcgcaggccgatctggacaacgccggtatgggccttgtgctgcaccgattccttgatgacgtcccgccaccagccggccatcacgccgagcacgcagaggaagcccaccagcaggaccagccagcccaccgggttgtcgtgcatgaacatgaccccgccgaccgccatgagcaggccggacatggcacccaggaagggccacgggctcggatcgacgagatgataatcgtgcactttggtgtgcgcggcgtgtgcttcgctcattctacactcctcctcaaggccgatgccgcatgacccctggcagtcgccctcgtccggcgtcggccgtcggcccggggaacggggcgcacccccgcccccggcagctccctgcaccggaccgcagggttggtccgggcgtttccttcccgttgtcgttcttcgaccggccgccctatccgcccgcgggacggggcaggctgccggtccgggcgccgtcggccaggctggtgcccggtgccgccgtcgcgaaatcctcaagcttccggccggtccgctccagatagctctgcagcccttcctcccccagatcgaagaaggtgtaggacagcgtcacggtgcggacctcgtcgacattctcgtcttccgccatcttcgggtcgatgtagaagctgaccggcatgtccatcgactggccgggcatcagcagctgctcggtgaagcagaagcagtcgatcttgtcgaaatagagccccatcttctggggcgtcacattgtaggcagcctggcccagaaccggtcggttgctgttgttgaccgccttgtagaaggcgagatggcgctcgcccaccttcaccaccatttcgcgctgctcggggaagaagccccagggcatgccgcgggcggtatcggcgttgaagcggaccttcatctcgcggtcgagcaccggcacctcggccgcatccgccacctgggtggtgccgccataaccggtgacctggcagaacaggttgtagatcgtggtcgaatacgaggtcagcacggtcatgccgcccagcagcacgccgacgccgatcagcgtgccgagcttgccgcgccgctgccgccgcgcccgctcggtcgccatctcatctcgtccgtccgcctcgctcacaacccgttacctctccgtcagctcatcttcgcgatggtgatggcgaagaacagagccaccatcgcccagagcagggcaaagagcgcccagttgcgctgccgcatgcgccgcatccggtccttcgcctcggccgaggcggggtcgatccgctcttccacctcggcacgctgcggatcgtattccgccgcgtcatggtgatcgacgggaccgttgcgggtgtcggcaggcgtcatgaccagccccccagccctgccgccttgtccaccaccagcagggcaaacagggcgaagagatagaggatggaaaacccgaacatcgccttgggggcccgatcgccctcgctcttggccacgcggatcgcatggccgaggaagatcaggctgagcccgccggccgccaggccgtaccagatgctggccagacccatcgcccagggcgccaccgacagcgggatgagcgccacggtgtagatcaggatctgcttcttggtctcgcgccggccggccaccaccggcagcatcggcacacccgcacgcgcataatcgccggcgcggtagagcgccagtgcccagaaatgcggcggggtccacatgaagatcagcgcgaacagcaccagaccgcccagcgacacgtcgccactgaccgccgcccagccgaccatgggcgggaaggcgccggcggcaccgccgatgacgatgttctgcggcgtgctgcgcttcagccacatggtgtagatgaagacgtagaagccgatggtcagcgccagcagcgccgccgccaccggattgaccgcaaggcccatcaccaccacggacgccacagccagcgccacgccgaaggcgagcgcggtttcaggctccatgcgcccggccggaatcggccggtcgacggtgcgggccatgaccgcgtcgatgtcgcggtcgtaccacatgttgatcgcccccgacgccccggcaccgaccgcgatgcagagcagcgccacgaaggcgagcaccggatgcagatgaccgggcgccagatagatgccgacggcgcccgtgaacaccaccagcgacatgacgcgcggcttgagaagggcgatgaaatcccgcaccgacggatcggccgcgggggacgcggcatctgcggcaacggcggtggaggtgtagacggagtcggtcacgggcgtgggccttggtcttctggacgcggtgcgggggaaggcaccgacctggatgagctgcgtatcggacggatgttccgtcgcatcccgatccacccgttccggcacctgcccggccgaccggcccgaccgggcgggtcggaacggggtcgggcggtttcggggccgtggccggcggtgtggatgccgccggccacggccccgaaggaccggtctcggtcaggctgccgtcacttcacgcgcggcaggccgtcctcgaaggtgtggaagggcggcggcgaggtcaccgtccattcgagggtggttgcaccctcgccccacggattgtcggcgcacttctgaccggcggtcaacgtgcggaacaccacgaagatgaagaacagcgcggcgaagcccgagatataggcacccatcgacgcgacatggttccagcccgcatacacatccggatagtcggggatacggcgcggcatgccggccagccccaggaagtgcatcgggaagaaggtcaggttcacgccgatgaaggtgagccagaagtggatcttgcccagcgtctcgggatactgccggcccgacatcttgccgatccagtagtagaacccggcgaagatggcgaacagcgcgcccagcgacagcacgtagtggaagtgcgccacaacgtaataagtgtcgtgaagcaccgtgtccacccccgcattcgacaacacgacaccggtcacgccgccgacggtgaacaggaagatgaagccgatcgcgaacagcatcggggtcttgaactcgatggagccgccccacgcggtggcgatccacgagaagatcttgatgccggtcggcaccgcaatgaccatggtcgccgcggtgaaataggcgcgggtgtcgacgtcgaggccgaccgtgaacatgtggtgcgcccagaccacgaagcccacaacaccgatcgcgaccatggcataggccatgcccagatagccgaagatcggcttgcgggagaaggtcgagatcacatggctgatgatgccgaagcccggcaggatcatgatgtagacttcggggtgcccgaagaaccagaacagatgctggaacaggatcgggtcaccgcccttggccgggtcgaagaacgccgtgccgaaattgcggtcggtgagcagcatggtgatggcgccggccagcaccggcagcgacagcaccagcaggaaggccgtcaccagcatcgaccaggcaaacagcggcatcttgtgcagcgtcatgcccggggcgcgcatgttcaggatggtgacgatgaagttgatggcgcccaggatcgacgccgcacccgagagatgcagcgagaagatcgccatgtccaccgccgcgccgccatgggacacattgcccgacaatggcggatagatcgtccagcccgtgcccgcaccgccatcgacgaaggcggagcccagcagcagcgcgaaggacggcggcagcagccagaaggagatgttgttcatccgcgggaacgccatgtcgggcgccccgatcatcagcggcacgaagaagttaccgaacccgccgatgagcgccggcatgaccacgaagaagatcatgatcaggccatgcgcagtgatgaccacgttgtagaactgatagtcgccgccgaaaatctggtcgcccggagacgccagctcggcccggatcagcatcgaaaagaacccgccgatcagacccgcgaccaccgcgaacacaaggtacatcacgccgatgtccttgtggttcgtggagaagacccaccgcttccagcccgtcggatggtgtgcgccgtgagcgtcatgtgcgcccgcgtgtgccataaccaatccctctcgttgtcggatgtgcccgcggaagctcaccggcccgccagcgcgacccggacctcgtcggtcccgtcgacgcgggcgaacctgccctgtgcttcggtcacccagttttcgaaatcgccctcggcccgcgcctcgatcacgatcggcatgaagccgtgccgcacgccgcagatttcagagcactggccgtaatacacacccggcttttcgacccggaaccaggtctcgttcagccggcccggcacggcgtccatcttcacgccgaaggacggcatcgcgaagctgtgcagcacgtcctcgctggtgatcagcaggcggacggtctttccggccggcacgaccacccggttgtcgacctccagcaggcgatgaccgccggccgggagcgcgtcaccttccagcaggttgctgatgaaggtaaaattgccgttgtccgggtattcgtaggaccagtaccactggtgcccgatcgccttgatggtcagatcggcctcttccaccttgttctcgaaatagatcaggcggaaagaggggatcgcgatcacgaccagaatcaggatcggggcaacggtccagccgatctcgagcagggtgtggtgcgagcgcttcgacggagtcgggttggacttccgattgaagcgaaggacgacgacgaccagcagggcgagcacgaaaatcgacacgccgaagcagatgtagagcaggatgtcatgcagatcgacgacccgctccatgacaggcgtcgccggcgcctggagattgagctgccagtcatgggcaactccttccgcgaacgccgccccggtcgtcccgaacaggacggcgcagaccgcgatcagcgaagagactagatccttggacctcattcttgggccttccccctgcggatggctccgcccgtcttctgccggacggcgttagaccacgtcctcagttcgccttcgtgtggcaattggccgcattggctgcgaccaaggctacacgacgcccgtaagtctaacaagccgcacggatatggtatccatgcagctcaaccacggttggagtctccgcggtttttctgtgcttcttaggctgaagcggagtccgctcgggaaaaatgcgacaacttgtcgcacagaacctggaggtgaatccgccatgcggtccggtccattcggcgggtccttccgtccggcatgctcccatggcggtccggagggaaagacgatgccggtgagggctgaaacgggcggaagcagagcgtcgcgcgcacgatcccttatatcccccggccgaccgctccatataccatgcatgaacggcaggccgacgtccaaccctctggctggcaccggccgcctgccgcacatcggggcaaccttccgccccgtcacgagttccgcccgtccgaccaggtaaggcccgagatcaatgcccgataccgccaagctcaccgccaccgatcccttcttcgcctcgggggcactcgatcgctcgcgcctggaacgccaggtcgccgaggcgctcgcgggggcggatgacggcgaactcttcctcgaataccgtcagtccgaagtgctgggcttcgacgacggccatctgcgctccgccaccttcgacaccgtccagggtttcggcatgcgggccgtggccggcgacacagtcgcctacgcccatgccagccagatcgacgacgacgcgctggcgcgtgccgccgacacggtcggcgccgtgctgcgcggccatggcggcacgctggatctggcgcccgcaaagcccggccctgcgctctaccagcccggcaacccgctggatgcgatgccctttgccgacaaggtgaagctgctggccgagatcgatgcctgggcgcgggcccgcgacaaccgggtccgccaggtcagcgccacgctgtcggccaactggcaggtggtcgagatcctgcgccccgacggcagctccgcccgcgacgtgcggccgctggtccgcatcggtgtttcgctgctggttggcgaaggcgaccgccaggaaagcggctatgccggtgccggcggccgcgccggctataccgcctgggtggcgccggaacgctggcaggcgctggtcgaagaggcgctgtctcaggcgctgatcaatctggaagccgcccccgcccccgccggcgaaatgaccgtggtgctgggctccggctggcccggcatcctgctgcatgaagccgtgggccacgggctggagggcgatttcaaccgccgtaagctctcggccttctcagggcttatcggcgagcgtgtggccgccccgggcgtcaccgtggtcgatgacggcaccctccccgaccggcgcggctcgctcaccatcgacgacgagggcacgccatcctcgcgcaccgtgctgatcgaggacggcatcctgaagggctatatgcaggaccggatgaatgcccggttgatgggcgtgccggtcaccggcaacggccgccgcgaaagctatgcccaccagccgctgccgcggatgaccaacacctacatgctgggtggcgacaaggacccggccgagatcatcgcctcggtcaaacgcggcctgtatgccaaggaattcggcggcggccaggtcgacatcacctcgggcaagttcactttctcggcctcgctcgcctatctgatcgaggacgggaagatcacccggccggtgaagggcgccacgctgatcggcaacggccccgacgttctgaagcgggtgtcgatgatcggcaacgacatggcgctcgacggcggcatcggctcctgcggcaaggacggccagtgggtgccggtgggcgtgggccagccgaccctgcgcatcgacggtctgacggtcggcggcaccgagatcgccgcctgatcgtctcaccacccgacatgaaaaacccccgccgggcaaaccgtccggcgggggttttctcatgcgcggtctttcggctcagccggccgtggcgggccgccggcccggccccgcggtgcgccgctgccagagatagatcgcagccagcagcgccagcgccagcgcctgcacctctatccggcccatcagcgggatgtagggcgccaggaagccgggcctgaacatcgcgaaggccacggcgaacagcgccagccgctcccagcccttgcaggcccgggcgaaccagccctgcaggccggcggcgaaggcgaacatcgccgccaccgcacagatcgagatccaggccagatggatcggatcgtcgatccacaccgcccgcccggcatcgtccacccccgaaatcatcagaagatcggtgttgaacaggaagatgaagggcaggatcgccgtccgcatgtcgtaggtgaagccctggacgccggttttgatcgggtcggcgcgggcgatggcagcggcggcataggcggcgagcccgaccggcggcgtgtcgtcggccaggatgccgaaatagaacacgaagagatgcgccgcgatcagcgggaagatcagcccggcatcgccgcccagctgcacgatcaccggcgcggtcagcgtcgccatgatgatgtagttggctgtggtcggcaggcccatgccgaggatgatcgaggtgatcgcggtcagcaccagcatcagatagatgttgccgaagctgatcacgtcgatgagggtgacgaaccgcccgaccaggccggtgatggtgacggcccccacgatgatgccggcagccgcggtggcgatgcccaccgccaccatgttgcgggcgccgttgatcagcccttcgaagatgtcctgcagcccctgggcgacgccgtcgcgcaggacctgcccgacaggggtgcccggctcgcgggtcagccaggccaggatcggccgctgcacgatcatgatcacggccatggcctcgatcgccagcagcaccgacagcgtggccgagcgctgcaacaccaccaggtaccagaccagcaccacaaccgggatcaggaagtgcagcccggcgaagaaggtctggcggaagcgcggcagttccgaccgcggcaccggtttcaggtccagcttgcaggcttccagatggacgacatagagcagcgccagatacgagatcaccgccgggatcagggcggcgcgcaccacgtccagataggggatgcccaggatttccgccatgatgaaggcggcagcccccatcaccggcggcatcagctggccgttggtagaggccgcaacctcgaccgcgccggccttgtgggcgggcaggccgaccttcttcatcagcgggatggtgaaggtgccggtggtgacggtgttcgcgatcgacgagcctgacaccagcccggtcagacccgaggcgaccacggccgccttggccggtccgccccgcagatgaccgagcagcgagaaggccacatcgatgaagtagcgcccggcccccgcccgatcgagcagcgcgccgaacagcacgaacaggaagacgaagctgaccgacacaccgatcggcacaccgaaaatgccggtgtcgctgaggtacatgtcgctcatcaggaagtcgagcggcacaccctgatgacggatgatcccgggcagccacggccccacgatgcaatagccgaggaacacgatcgccaggatcgcgagtgccggcccgagcgtgcgccgggcggcttcgagcaacagaatgatggtggcgaggccgaaccagatgtcacgctccagcggcagacccgcgcgcatgacgatctcttcgtaatcccaccagagatagagcaccgcgacggcgccgacgaccgccagcatgagatcgtaaaccggtacctttgccagcgccgaacgcggcccgccggacaggcggtcgagcagcttcgccaggcggccatcgggctcgcgataggcgggatagcacaggaaggcgagcagcatggcgaaggtcagatggaagacccgcgccaggaactggtcgaaaggcacgtaggcgatatagagctgaaaggccgaccagccgaggcagagggcgacgatcagccaacgcatcaccgagcttgtcggcgcgcgtgcacccgcttcgacctgtgcgaccagggcctctgccgccgcgatgtcgccctcgccctcacccgtcggcggcgcgccgcggccccccgtttgcgatgcagccatcaggcccctcctccccggcattcgccgcaggcgcggctcggaatgcgcatgaaacctcgtgaaccagatttgaaaagacgatgccgccgcccggttccccaaccgggcggcggcatcacggccggattacatccagcccttttccttgtagtacttctcggcgcccggatgcagcggggcggtcaggccctccagcatctgcttgggctccaggtcgcggaaggcggcgttcgacgccttgaaggcatcgaagttctcgaagaaggtcttcacgaaggtgtagaccgtgtcttccgagacgtcggagctggtgatcatcgtcgccttgaccgcataggtctcggtcggatgatcgacgccgcgataggtgttggccgggatgctggtcatcacgtaatacggccgctcgccgacgaacttcttgatcgcgtcggagttgacgttgatcaggtcgatctcggtcgagttcgccggatcctcgatcgccgccgacgggttgccgacggtgtagaagaaggcgtcgatcttgctgtcgaccagggcgcgcgaggcctcaccctgctgcaggccctgggcgttcagatccgaatccggattgatgccgtaaaggtccagcacgtccatggcattgccgcgctggcccgagcccggattgccgatattgacggtcttgcccttcagatcctcgaccgacttgatgccggtctccttgcgggtgaccagcagcacggtctcagggtggaccgagaacacgctgcgcaggttctcgaccttcttgccgtcccagtcggccgcaccgctccaggcattgtagttggcgtcggactgcgcgacgccgaagtcgagcagaccacggctgacggcattgacgttgaacaccgaacccagcgccggacggccgacgcagttcagcttgtcggccgcctgcttgttgatgatggcacaggcctgcagcgccacctgataatagacgccggtgaccgcaccgccgccgatcagaatgtcggtggctgccgcggccggaaccgtggcgcccgccataccggcggcaaggacggtggccgcaagggccgttttgcgaacgaacatcgctctccctttcccctcgttactcgatcgttggaagtcttcgggctccggcttacccaagcccgaacagggcacgcgccgtcgccgcatcggcgacgggccgccccagcgccgccgccaccccggccgcctggccgatcagtgcggcgttgtccggggcgggggccccgtcgcgcaaggtcatgttgttctcgaagccgagccgcgcatggccgcccagcgaaatcgccgccccggtcgcggccagttccgcgggcccgaaggcgcagaccatccagggatcctcgaaccccgtctcggcacgggcggccaggaagccgaccagatcccccggccggccaccgcccggcgcatagcgccccagcacatagagcaccggtgccgcactgccctccagcccgtcggccaccggcaggatgccccggtcgcgcaggcgggcaagccgctccacctcctgcgcatcatagaggatccactgccagcggccacccgccgcggccagatcattcaacaaacgggcaagatcggcctctgccgcacgcccgactccttccggcaggaattccctgagccccagcgagcagaagcggggcttcagcgtccgcatcgccgcgatctgggccggcgcgtcatagatgccggccgcctcgctggtcacctggatgaccagccggtcgcccagcgcatcttccaccgccgccacggccgcacggtaaagctcgggatccaggctgtgccggccatcggtgtcgcgaacatgcagatggatcattgacgcccctgccgccacggcatcggcggcggcctgcgccagctcggccggcgtcagcggcaaggcggcatgatcggccttgccgcggcgcgcaccattgggtgccaccgccagaaccactggcgtgtcataagccgtcgtcatcaacgctgcctcttgctgggggcggacaagatgctccaccgatcatccatcatcgatcccgccttgtctgcccgtgatcgcaccgggcttcgaagttgagcgatcttttcgcgatccgcggggtgcgatggaacgtcgttgcgccggaccgtcgagcaatgtgcgaaatccgtcgagatgggcttcggcccgggccacacggtcgtcggcaggggcgccgatgcccaccgccaccaggccgaccagggcctgggcgagcgccagcccactggtcagggagcggaagatcccgggcccgtcatgggccatcaccaggacatgatcggcataggctgcgatcgcaccatcgcggtcgtccgtcagcaccaccaccgttgccccggccccggccgcaaagaccaccgcatcacgggtcgcgcgggcataacgggtgatggtgacggcaatcagcacgtcacccgcccccagatcccggagccggtcgggcagaagccctgccgcgtcccccgcaagctccaccgcgggccggaccagatcgagcgcataggccagaaagaagccgagggtatggcatttgcgctggccgaccaccaccacccggcgggcggccacgatcgccccggcggctgccgccagcgccggggctgcgtcgccccccaggctgcgatccagattggcccggtcggccgccagaaagtcggcgaccagcccggcagggccgtcaccggcccccagacgctgcagccggcgtgaccgcgcggcatagcggccgtcgccgccaccggccagccggtcgcggaacagcgcccccaattcggtgaagccggcatagcccagcttttcggccagacgcacgaaggtggcgggcgtcacccccgcttcgtcggcaagacggcgcatcgacaccaggggcacgcggtcgggatggtcgagcagatggcgcgccgcccggcgcagctgcgggctgagaccgtccatgccggcctcgatccgctgcagcacctcgtccgcgcccgccgctccgctcatctgcccctctggttcaggcggccgcaaggcccgtggcggccagggcggcatcgatcgccgcccccagccggtcgatggcgagcgccagctcctcttccgtcgcgatgaagggcggcgccagcagcacatgatcgcccgagagcccgtcgacggtgccaccgcccggatagcagatcagcccgcgggcgaaggcctcttccttgatctttttccacagccccgcgccggccgggaacggcgccttgctctcgcgatcggcgaccagttcgatgccgcggaagaagccgcggccgcggatgtcgccgacataggggcggtcgcccagcccctcgcgcagcagccgctcgaaaaccgggcccatctcgcgcacccgtgccaccagcccgtcatcgcggatcgcctcctgcaccgccagcgccgcggcgcaggcgaccggatggcccatataggtatggccggtggtcagacccagccggccggtttcgatcacccgggcgatctcgtccgacaccagcaccgcgccgatcggttggtagccggctcccagccccttggccatgacgatgatgtcgggggcgatgccgtcggcctcgcaggcgaaggtatggccggtacgccccatgccgcacatcacctcgtcgaggatcagcagcacgccatggcgggtgcagatctcgcggatcgccttgaaataaccctcgacggccgggacggcaccaagcgtcgcaccgaccaccggctcggccaggaaggcgagcacggtctcgggcccctggatcagcagctcgcgctcgaactccgccgccagccgggcgccgtatccggtgtcgctctctccgggcaggcgatagcgataggcatggcaaggggcgacatggaccacatcgcccatcacccagggcagaaagggccggcgccggccgacattgccagtggcggagagggctcccagcgtattgccgtgatagctctgccggcgggcgatcacccgggtgcgggccagatcgccgcgctccaccgcatgctgccgggcgatcttgagcgcgctctcgatcgcctcggacccgcccgagacgaaacagaccttgccgaagccttcgggtgccgcctcggacagcagatcggccaggcgctccatgggctcgttggtgaagaagccggtatgggcgaaggcgacccgatccaactgggccaggatcgcggcccggacccgcgggtcgccatggcccaggcacgagacggcggccccgcccgaggcatccagatagcggcggccgtcctggtcgatcagccagcagccctcgccgcccacggcgacggcaggctcggcggcggaagcccggtgaagcacgcgggactgggcgcggttgcggcgcagcgggatctcggacatggcgtctcatccggatgatgcggggggtccggatgatgctaggccgctgaaatcgcggatgcaacgtccgttttactgaaacatgaatgttgcatatgtttcatcggcggccgaaacgaatcacggaggcccgacggcccccgtgttcctccgaccgccatgtcaggacgggtcagatgacctgctcgcgcgccgcggccagggccgccaggctgcccagcaccccgaagacccggaagggacagggggcgtcgccgccattgcccgcgggctcgatccgcggttcgacctcgtcgcacatctgggtgaaataggcgcccatggcgttcaggctgtcatactcgccccggcccttgttgacccggtagaacccgccgaccgcccggccgtcgaccagatagatcaccggctcggcgctttcgccctcgatcaggtcgaccgtcggcacgccctcctggacgatgacctcggtgttgagggcaccttccttgatgacgttcatcttgtgccgggtcttcttgttcatctccaggatgtcctcgcccgaccgcgcggtcatgacacccatgccataggtgccgctgtcggccttcacgaagacatacgggtcgctttcgatgccgtattgccggtacttttcgcgggtcaggtgcagcaccttgtcgacgccgcgggcgacgcagccgagcccggccttttcgcggaaattgatctggccgcactggtgccagagtgcctgaatcagccagggatcgacgtcgaactcttcggcgaaggcatcggcgacctgggcataggccgagaaatggccgctcttgcgccggcgataccagccgagcgacagcggcgggatcaccggctgttccagatcgaccaggatcgagggcgcgcccgcggtcatgtcgttgttcatcagcaccacatcgggcacgaaaccgtcggcggtgccgatccggccgtcctcacggcgcagcggctcgacccggatatcggcaccggccgccgtctccagcaccatcgcctcgtccaggtcgtacatcaggctgccgagacggacctcccagccggcctcttcgatgatcccggccagcacccgcacgttttcaaggtagtgcagattgcgggtgtggttctcgggcacgatcagcagccgccggccatcgggcgccacccgcgccagatgggtcttgaaccgttcggcggcccggccgcgggcggcgcgggaaatattgttgaacccggccgagaacaggttggtgtcgaccggggcgatcttgacgcccgaatggcgcagatcgaccgaagcatagggaagtgccggggtctcggcgaaacgggcgtcgaaccaggcggtgaccttgtcggcctgggacgcgaggatgtcgtcgagaagcggcagaatgagcgtctgcatgggacgggcggcctccgggtgtcggatccggcagacggacgtctgtcggcgggaagagcgcccgccaccctgatcgtgatgaccggccggcggggcatgcggcccggcagggccggaccgggcggcgcgcccccttctggcggcaacgccgggggcaccgcatgcagggcgcccctgaaacggatctcccgtccgggcctcagcccgtggcggtaggtcgatggcgggcaccgccgccatctggcgccagggcctgcaggatggcaagccccgcgatgaccgcggtttccgccctgagcacgcgcgggcccaggccgatcgcggtcagatggggccgggcacgaagccggtcaagctcggccggatcgaagccgccttcggggcctgtcaacaggccggccgggccatcccccagcatggccgcgacggccgcagccggacgcccggccccggtctcgtcgccgaagacgaccggcaggtcatccaggcggtccagcacggtatccagcggttcgggcgcatgaatggcgggcaccgtcagccgttcgcactgctcggccgcctcccgcgcgatggcggcaagccggtccatgcgcagccggtcgaccacggtgcggcgggtgaccgcaaagcggatcgccgtgacgccgagttccgtcgccttttcgaccgcaaactccaccggaccgcgcttgaccggggccatcaccagttccagccgccgttcggatcccggcaggcggtgctgcgccaccagacgcgcggccgcaccgcgcttgcccaccgccaccagttcggcagcccattcgccgtcccggccgttgaacagggcgagcgccgccccggtctcgcgccgcatcaccgcccgaagataatgggcctgatcctcgtcgagcagcagttcggcccccggggtcatgggcccggtcagacggtcgggatcgaggtagaggcggggcgcatcggcagccatgggatctccgtatcggctcttctccccaagagctatagcgcccctgaccacgggtttgaagcccaagccggtgcattgccgcgcttggcaaccctgcgcccagcggataaaccggcatgaggagccagagcccgaggagccagcgccatggccgaaccggccgcgaagtccaggaccggtcataccgacatccacaccgacaaggggctgatgcgcctgctgcccgaggggctgaagccctatgcgctgctggcgcgctgggaccggccgatcggctggtggctgctgttgctgcccggctggtgggcgatcgcgctggcggcgcctcagggcggcctgcccgacctgctgctgatggcggcctttctggtcggtgccgtggccatgcgcggcttcggctgcacgatcaacgatctggccgaccggcactatgacgcgaaggtggaacgcacccgcagccgccccatcccgagcggccgggtgacgccgttccaggcgctgctcttcctggtaccgcaggggctggtgggcctggcggtgctggtgatgctgccggtgccggcgatcgtcatcggcctcgcctcgctggcgctgatcgtgccctacccgttcatgaaacggatcacctactggccgcaggcgtggctgggcctcaccttcaactgggcggccctggtcggctgggcggcggccagcggggccggggatctggcagccatgacgccggggctgctgctctatgcgggcggcatcttctggacgctcggctacgacacgatctatgcccatcaggaccgcgaggacgacctgctggtgggcgtgaaatccaccgccctcgccctgggccggcgcacgaagccggcggtggcggtgttctatctgatcttctggggcttcacggtcgcggcgggactggaggccggtttcggcgccggctgggtgctggccatggccttcaccggctctcacctcttctggcagatccgcaggctcgacatcgacgatccggcgctgtgcctgaaactgttcaagtccaaccgcgacatggggctgatcctgctcgccaccatcatcctggcccgccaggtccccctcggcggatgagccgggcgagcggccgggccagaagcagggcgagggccaggatccaggcaccggccggcatgtcgaccgcgggtggcaggaacgggcgcaggatcaggatgaccagaacggcgcccgccaccttgaccagctggcggtcgaccagatcgaaccgcgcccagatgccccgcagccgtcctttgacgccggccggggcgacgggacttgtctcgggatccttcgccgccatcatctgctccatgaccatctgaacatcgcctctgcacttgaccgcggcccccgggacgggtcaagtccgcacaccccccgaaagccgaagcgaggccgccaccgatgccctatgacagcctgcgcgacttcatggcccgcctcgaggccaccggccgtctggtccgggtccgcgagccggtctccaccgtgctcgagatgaccgagatccagacccggctgctggccgaaggcggcccggcggtgctgttcgaaaagccggtgatgccggatggcagcctgtcgaccatgccggtgctggtcaatctgtttggcacggtggaacgggtcgcctggggcatggaccgggaaccgccgcagctccgcggcgtgggcgagacgctggccttcctgcgccagcccgaaccgccgggcggctggcgcgaggcgctggacatgctgccgctgatgaagacggtgatggcgatgcggccgaagacggtctcgcgcgcgccggtgcaggaggtggtcctgcgcggcgacgagatcgacctcacccgcctgccggtccagacctgctggccgggagagccggcgccgctgatcacctggccgctggtggtcacccgcggccctggcggcgacaagaccgacggctacaatctcggcatctatcgcatgcaggtgctgggccgcgaccgcacgctgatgcgctggctgcgccatcgcggcggcgcccagcatcatcgccgctgggggctgaacaagcgcgagccgctgccggccgcagcggtgatcggcgccgatccgggcacgatcctggccgccgtgacgcccgtgcccgacacgctgtcggaataccagttcgccggcctgctgcgcggccgcaaggtggagctggtcgatgcggtcagccagccgctgaaggtgccggccacggccgaaatcgtgctggaaggcgaggtcagcctcgacgattacggcgacgaggggccctatggcgaccacaccggctattacaacaatgtcgagcccttcccggtcttccgggtgacggcggtgaccatgcgccgccagccgatctatctctccaccttcaccggccggccgccggacgagccctcggtgctgggcgaggcgttgaacgaggtgttcatcccgctgatccgccagcaattccccgaaatcgtcgacttctggctgccgcccgagggctgttcctaccgcatcgccgtggtgtcgatgcgcaaggcctatccgggccatgccaagcgggtgatgatgggggtgtggtcctatctccgccagttcatgtacaccaaatgggtgatcgtggtggatgacgacatcaatgcgcgcgactggaaggacgtgatgtgggcgatgtcgacccgcatggacccggcgcgcgacatcaccgtcatcgagaacacccccatcgactatctggacttcgcaagccccgaatccggcctcggctccaagatcggcctggatgccaccaacaaatggccgcccgagaccaagcgcgaatggggcagggaactgcgcatggaccaggcggtcatcgaccggatcgaccagatctggccgaagctgggactgccgggatcggggcaggcgatctggaagccggtgaaggactgaaacgcaaacgctccggttgatgatcccccggccccgtgtcatcgtaccctcctggaaaccggggtccagggagcctgcatgacgacgatcggggccgtgatcagaaacatgatgccctcgggaaccaatccgggcggcgacgatccggattggtcgacctgcccggaatggcctccggatctgtttggcgtcactgcgacactgatcgagcgtacgggcctctactcacatgcctggctttacgctcatcaatcgacgcatgcctcgatggcctcgtctgaaaaaagttccatccgagccgccggacgcggctggcgcgacaaaggcgtgccggactcgtacaccaagcgattgtggcacgaggtcacaggcggcgcagatcacgtcgatctccaggctctggcccacacggcaccttcccaccccctcgcccgcaagctgatcaccttgatgtgcatcgcagatgaagcggcagagggtatgggattcgttccgaagacccacgtgcctgccaacgggccgtccccggacagaatatccccgttcacgcgggcagtgctcggtgcaaccattgcggcggaacccgcctacacgacgcgagacgcgacggctacatcggcggttatgccgaaattgccgcatttcccgcggagcctgacgcttgccgtcacgccgctggaggccgtcgtcttcccgaaaagccggcttcccgatgtcggctgcacgttgcggtctatgtcgcacaatctggcgttgctgccgccccggagcatggtggaagccaactggcttatctcaggcctcgcgactgatccggaacatcaccggccgctcggcatcctgttgataccgtggcccacacgcgtgaatggcagcctgttcaaggccgagcgtagagacgcggaagaacccggatacttcaccgtcgatgtcgcaggctatgatgatgccctctccgggccaaccaacgtctcaagactggccggtatgatcgccggcctgatccaggcaggcgagaaggaactgggcgagattcatgccgtctttcttccggaatgcgccctgccgaccgagatcgcggaggacttggcgaaagaggtcgcacgacgccatccgcggctgcagctcttcatctccggcgccatcggcaagccggcccactccgaggcaatgccccgcaatctcgccttcaccgcgtcgacggcagacggcaccgtccaacgcagctggacgcagagcaagcaccatcgctggaagctcaacggtgatcagatccggcgctaccatatggggcacgttctcgaccccacgcgcgaatggtgggaatatatcgacgtgagcggccggacctgccatttcagcgtcattgacaatgatctgtccctggcggttctgatctgtgaagatctcgcccgcttcgacccggtcctgccggtgatcaacgccatcggccccagtctcgtggtggcgctgctgatggatggaccgcaactcgagaaacgttggccgggccgatatgccaccgtccttgccgaggatccgggctcatcggtcctgaccttcacgtccacggccctgatcgaccgacagcatcaggccggcgcgccgaacatccgcacgatcgcactctggaaacagccccgtggcctggcacaggaactgtcgatcggcccggatgatcaggctctcgccttgtgccttgtccgcgagcatcggcaacagatatccatcgatggtcgctccaggaacagcttctttctgtcgctggcaggcgtccgggccgtgaagcctcccgatccggcggtgttgccacgcaggaagtcattgaacaaaccgacgtagcatcctaacttgacgtctactcccggtgatcacccgccaaaatcaggcgctgacaaatgaacaagcgaatttatcagatcaacgatacccgggcagaaccctcccttgtcgctgatctgcgcaggatctttgaagccctgccgccaagtgagacggatgaagcggtctcacggcggttgcgcgccatgacgcaacgtgtcctggccgacgaagaagcgcggcgccagaggctggccggctgagccgatcggaagcgcacacccgcccttcgttcacgatactgcccgaccgtcgcgaagctgccacgcatccatgctaccgtcgtccgtcccgcccatggccacggatgacacccgcatgctgcgcatcctccagatcaccgacacccatatcagccccaccaagccgcatttcgcatcgaactgggcgccggtcgcggcgctggcgcgggcgattgcgccggatctggtggtccacaccggtgacgtgaccgtcgacggcgccgatatggtggaggatctggcccattgccgctggctgatggacgggctggagctgccctgggcggccgtgcccggcaatcacgatgtcggcagcgagaaccccgaacatttccaggcggtgaacgatctccgcatctcgcgctgggaagcccatttcggcccggaccgctggctgcgcgacgccgggccgtggcggctgatcgggctgaacgccatgctgatgggatcgggccatccgcgtgaggcggagcaggcggactgggccggcgaggtgctggccgaggcggacgccaccggccgtcccgtggcgcttttcctgcacaagccgctgttcctgaacgaccccgacgaagacgaccgcggctattggagcgtgcctggccgcgcacgcgggcgctatgtggaggcgatccgccggggcacggtgaaactggtcgcctcgggccatctccacaccgcccggatcttccgccgcgacggcacggtcttcgccttcggcgcctcctcgggcttcatcgtcgacaagctcgccccggccgatattccaggtgaaaagcggctgggggcgacgctgcacctgctggacgagaagggcacggtcgaatcgcgcctgctgagccccgaagggctcgacacctatgtgatcgacgacgtcgcgcacgaggtctatccgccgcgcagctgaccggccgaccattccatatgccgtggcgctggtgttccgcgccgcttcgtcccatatctaggcctcgggcctgcgcaccccgtcgggcgatgcaccccgaggcccgggacgatgccgcacgaggaccagatgaccgataccggacttggaaacgctctcgacctgctcgaagacctgatcgcgcgcgcgaagcgtgccggtgccgaccaggcggatgcgctgatggtcgaaagccgtgcgctgtcggtgcagcgccggctgggcaagatcgaggaactgacccggtcggatggcggcgatctggggctccgggtcctggtcgggcgccgtcaggcgatcgtctcgaccgccgatctcaggcccggcagcctggacgcgctggccgagcgcgcggtcgccatggccaatgtcgtgcccgaggaccgctttgcgggcctggccgagccgggcgagatcgcgcgcgagattccggcgctggagatctacgacccgaccgaattcagcgccgaggatctgctcgcctgggccgagacctgcgaagaggcggcccgcggggtcgagggcgtgaccaattccgagggcgccggtgcctctcaatcccacagcatgatcgcgctcgccgcctccaacggcttccgcggcgcctatcgcaccagccgcttcacggtcggtgccagcgtgatcgcgggcgaggggctgaacatggtccgcggccatgaatacacctcgaagcgtttcgtggccgacatggacgatctggccacgatcggccggatcgcgggcgagcggaccgtcgcgcggctgaacccgcgccggccgaagaccgcgcgggtgccggtggtgttcgaccggcgggtgtcgcgcatgctggtcgcggccatcgcgtcggccgtcaacggggcggcggtcacccgcggcaccagcttcctgaaggaccggatgggcgagcgcatcgcctgcgacgccttcaccatcatcgacgacccgttccgcgagcgggcacccgcctcacatcccttcgacggcgagggcattgccggtgcgccgctgaccgtggtcgaaggcggggtgctgaaatcctggctgctggactgccgctccgcccgtcagctggggctgaagagcaccggccatgccgcccgcggcgccggatcggcccccagcccggcctcgagcaatctttatctggcgccgggcacgctcagccgcgacgagctgattgcgaagatcggcaccggcctgctggtcgatgaaacaatgggctcgggtgtgaacgtcgtcaccggcgatttcagccagggtgtggcaggcttctggatcgagaacggcgaaattgcctatccggtgaacgagatcacggttgcagggcgcatccaggacatgctgatgtcggtggaacccgcctccgatctcgaattccgcagcggcaccgatgcgccgacgcttgccgtcggcggcctgaccgtcgccggcgcctgatctgcgagacgaccagacgaccccatatccacgaccgggagtgcccgccaccgatgaccccacccctgttcgccctgcccgacggcgccctgccggccgacctcgtcgacgaccgcctgctgctggagcgggcgttgcggacgggcgggcggatcgccatgaacgccttcggcaaggcaccggtgacctgggacaagggcggcgacaatccggtgaccgaggtcgacatcgccatcgacacggtgctgcgcgaccatctgctccatgcccggcccggctatggctggctgtcggaggaaagcgtcgcccatctctcggaacgcgcccggccgcggatctgggtggtggatccgatcgacggcacccgggccttcgtggacgggcggccggaattcaccatttcggtcgccctggtcgaggccggacgcccggtgatcgcccaggtcttcaacccggcgacgggcgagtttttcgaggcggtggccggccatggctgccggctgaacggcatcccctgccgggtgggcgagggggccgatccgctggccgcccggctgctggtctcgcgccgggaacttcatgaacgtcgctggggttcaggcctggacggcagcgcggtcatcgcgctcggctccatcgcctacaagctggcgctggtcgccgccggccgcttcgatgccgcggtgtcgctgcgccccaaggccgattgggatctcgccgccgccgatctgatcgtcgctgaggcgggcgggcggatgaccgatgccgagggccgcgacctgctctatgccaggcccgacaccaccgaacatccctcgctgatcgccgcaaatccggcgctgcatgccgccctgatcggccggcttgcggtcgatgcggctggaagcccggcgccggctggcgtacaaccgcagccatgacccgcgccggccggatgccgaccgcatccgccggccgccgcctcttcacgggatccatccccgccccatgtcgcgccgcaagccgaagtctccccgccccgcaggtgccgccggcacccgggccctgatcacccgcctcgcccgcgagcatctgcgcccctattggcggcggatcgcgcttgcgatcggggcgatgatcgtgaccgcggctgcaaccgccgccaatgcctggctgatgcagccggtgctggatgacgtgttcctgaagcgcgacgagaccatgctgctgctggtgcccgccgccgtgctcgccattgccgccgccaatggttttgcgacctatgccgaacgggtgctgatggaacggctgggcacccgcgtggtggccgatctgcagcaccggatgtatcagcggctgatggccgccgatctcgccttcttccaccgcaccggatcggggcggctgatcgcgcgcttcacctatgacgtgcagctggtccgcaaatccgccgccgccgcgatcaccagcctggccaaggaaagcctgaccgtcatcttcctggtcgggttgatgttctggcaggactggctgctggcgatcatcgccttcgtggtcttcccggtcgcgatcctgccgatcgcgaagctgggccggcggatgcgcaaggtgtcggaccgtgcccaggaccagatcggccggctgaccggcattctggaagagaccttcctgggcgcccgccacgtcaaggcctatggcatggagggctatgaaacccggcggatgggggtgacggtcgaggaaatctaccgcctgaccggcaaggccgaacgcatccgtgccgcctcttcgccgatcatggaggcgctgggcggcgtggcggtcggcctcgtcatcttctatggcggatcacaggtggtcgcgggcgagaccacgcccggggccttcttctcgttcgtgaccgccctgctgatggcctatcgcccggccaagaccctcgccaatctgaacgccaatctccaggaaggcctggccgccgcccatcgggtgttcgaactggtcgacctgccggcgacgatcaccgaccggccggacgcaaagcccctgccgcaggtgatcggcggaccggtgaagggcgagatccggttcgaggatgcgcgcttcggctatggtgccgacggggcgccggcgctcgacgggctggatctggtggtgccggcgggcaagcgggtggcgctggtcggcgcctcgggcgccggcaagtcgaccgtgatcaacctgatcccgcgcttctacgacctcgacggcggaaggctgacaatcgacggggccgatgtccgcgcggtgaccctggcatcgctgcgggcttcgatcgcgctggtctcgcaggaggtgacgctgttcaacgatagcgtcgcagccaacatcgcctatggccggcccgatgccacgcgcgaagacatcgaggccgccgcgcgcgatgcagcggcacatgatttcatcatggccctgcccaagggctatgacacgccggtgggcgagcacggctccagcctgtcggggggccagcgccagcggatctccatcgcccgcgccatgctcaagaacgcgccgatcctgctgctcgacgaggcgacatcggcactcgacaccgaaagcgagcgggcggtgcaggatgcgctcacccggctgatggccgggcgcacggtggtggtggtggcccaccggctgtcgaccgtggtcgatgccgacctgatctgcgtgatggatcgcggtcgggtgatcgaacagggcagccatgccgagctgatcgcccagggcggggcctatgcccggctgcatgcgctgcaattcgccgaccagtccgaggcgcctgtcggccatatcgatgtcgaggatgcggcggacgtggccgcaccggccgtgcggaagggctgaggccgatggcggggctggtcaagcgctggctgaagagcgatcgggcgcgccgcctcgcctgccggatcgccgccgcctacatccgcctggtccatgccaccggccgctggcaggtgagcggcgacgccgctccccgcgcccattgggacgagggccggcccttcatcctggccttctggcacgggcggctgctgatgatgccccatgtctggcggacgggcatgccgatgaacatgctgatcagccagcaccgcgacggccggctgatcgccgataccatcgcccatttcggcctgggctcggtcgccggttcgtcgtcgaaaggcggggcggcggcggtgcgccagatcgtgaaggcgatccgcgccggcgaatatgccggcgtcaccccggacggaccccgcgggccgcgccagcgggcgagcggcggcatcgcggcgattgcccggctttcaggggtgccggtcatcccggccaccttcggcatgcgccggcggcggctgctgggcagctgggaccggttcctggtgccgatgccgttcagccgcggggtgttcatctggggcgagccgatccatgtcccccgcgatgccgatgccgcgacgctggaccgctaccggatccggatcgaggacgagttgaaccgcatcaccgcagaggcggaccgcgccaccggccatgcgccgctggagctgccgccgccgctggatgccgaacaggcggcggcggatcgatgagcggggcgggatcgatcagtacggcaggtctggctctcggcctctatcgcggcctcgcccggctgggcacgccgctggtgaagcgccatctggagcgccgccgggtggcggggcgcgagcacgatacccggtggccggaacggctggggcgccccggcctgccgcgtccggccgggcggctggtctggctgcacggcgcgagtgtcggtgaaagcctgtcgctgctgccgctgatcgcgcggctgaaggcgatggcgcccgcgaccacggtgctggtcaccaccggcaccgtcacctcggcccggttgatggaaagccggctgacggaaaccggggggggcgtcggtgccctgcatcagttcgccccggtcgacctgcccgtggcggtcgacggcttcctggatcactggcggccggatgccgcggtcttcgtcgaaagcgagatctggcccaatctgatcgacgggctggaccggcggcgcattccgcgcgccctggtcaatgcccggatgtcggcgacctctgcccggcgctgggcgaagctgcccggcctcgccgcccggctgatcggcggcttccggccgctgctcgcccaggatgccgacagcgccgcccggttttcggccgtgctcggccggccggtgccggccccgggcaaccttaaggatgcggccgagccgctgccggcggatccggcggcggtcgcagcgttcaaggccgcgatcggcgcgcggccggtctggctcgccgccagcacccatcccggcgaagagacgcagatcctggccgccgaccgggcgatgcgcgcgacccgccccgatctgctgaccgtgatcgtcccccgccaccccgaacgcggcccggccatcgccgacgagatccgtgcggcggggcttcgggtggcgcggcgggccgtcggcgaaccgctgaccaggcagacgcaggtctaccttgccgacacgctcggcgaactgggtcttttttttcgcgcaatccccctcacctttatcggaggctcgcttgtcccggtcggcgggcataatctgctcgaacccgcgcgcctcggcgccgccgtgacgaccgggccgcatctcggcaatttcgagagcctggccgcccgcttccgggcagccggggccgcggagatcgtcgaggatgccgccgcactcgcccggacggccgggcagctgctcgacgatccggcggcgtgcgagagactggcccgggccggcgcccgggtggccgaagagggacgtgccgcggtggaggccatcgcggctgcactggaaccgcttctcgaaccggccgaggcatcgggagatccgtcgtgaaggcaccggaattctggggacgtcaggcgaaaccggtggagcgcccgctgctctgggcgctggcgccgctgtcgctcgtcttccgggcggcgggcgcactgcgccgactgctggcccggccggcccgtgccggcgtgccggtgctctgtgtcggtaatctgaccgccggcggcgccggcaagaccccgaccgcacttgccatcgccgcccggctgcgtgaacgcggccgcagaccccatgtggtgctgcgcggctatggcggcagtgtgaagggccccgtgctggtcgaccccatcgcccatcgtgccgagcaggtgggcgacgaggccttgctgatcgcccgccgcctgccgacctgggtcgcccgcgaccgggtggcgggtgcacgtgctgctgcggcggcgggggccgatgtcgtgatcctggatgacggcttccagaacccgtcgatcgaaaaggacctgtcgctgatcgtggtcgatggcggctatggcttcggcaatggccgggtgatcccggccggcccgatgcgcgaaccgctggcccggggcctggcccgcgccgatggcgtggtggtggtgggcgaggacacgatcgacgtcgccgcagccctgcccttcgaacgcccggtgctgcgcgccgtgaccgtgcccggccccgagacccggcggctgcgcaaccgcaaggtcgtggccttcgccggcatcggccggcccgagaaattcttcgacacgctgcgcacgatcggctgccgcatcgccggcagctggtccttccccgaccatcacccctatgatccggacgagatcgcccggctggtggaggtcgcccatcgcatggatgccgtgttggtgacgaccgagaaggatctggtccgcctgccgcccgaggcgcgcgacctggtcgaccacctgaccatcagcctggaatggctggatgccgacccgctggaccggctgctggaccgcatcgacccgcgccggccggaacccgccacgccggccgggctgtcgcggctgatcgacggccgggccgggcatgaggacggcaccggacacgaggacggtaccggacgccgcagatgacttccaacacccccacccccgacaccccgccgatgaccttccgccggcggctggagagcctgtccggccgcctggccttcggcttcgcccgcctgctcggcctggaacgcgcctcggccttcggtggctggctggcgcgcaatatcggcccgcggatcaaggtcagccggatcgcccgccgcaacctggcccgtgcctttcccgagctcggccccgacgagatcgagcgcatcctccgcgccatgtgggacaatctcggccgcaccgccttcgagatcgcccatctcgaccgcttcgactgcacgggccgcgaccccgcccgggtggaggtgatcggccacgaacacgcgctggccgcccgcgacgacggccggccgggcatcttcgtctcgggccattacggcaattgggaactggcctcgcttgtcgccacccagtcgggcatcaccctcacccaggtctatcgccaggccaacgacaccgaaatcgagaagctgatccagcagtcccgccgccgcgccggcggtgcgaccgatttcctgcccaagggcgcaaaagccgcccgcgagatcatgaaacgcctgaaggccggcggtcatctggcgatgatgatcgaccagaaactcaacaccggcaccgccctgcccttcttcggccgcgacgccatgaccaccacggcccacggcgaattcgcggtgcgcttcaacgcccccctggtcaccgcccatgtcgaacgcctgggcggcccccgcttccgcatcaccatcgacccgccgatcgacccgaccccggagcccggcgaaaccctggaacaggccgcggaacgcctgacacggctggtcaatgcccgcctggaaggctggatccgcgaacggccggatctgtggttctgggtgcataagcggtggccggattgaggggggggcagtcctcagatccgccggaactcagatccgccggatgctgacatgcatgcccccgtcacaggcgttgcgtgccgcaccatgatcgagcccccgatatacttcaacccaggcgcggttcggacggcggcttctgcttgagcccaccagggagtccgcgcgactgcgtgccagttcgtgaaacgccgcgtaacaggcagcgctgacggcccgtcgcagatctgcctgcctgggccttcgtctgacaccgtcgggacaaagagctttcgccgacgcaatcaacccgcgcgccagcgtcgcgtcaggcatgcgcacccaccggccggatgatcgggaacacgtcgcgcatctcgtctcccaagacatcgcgcacccgcccggtcagcccgaagaaccggccggcaaagtcccgtgacgtggtgtcgggcgacatgacgacacggatgaacaacacctcgtcccccacttcgtcctcggccgtatcgatctcgacggcttccaccttgtcggcaaatcgctcacggataacgcgatcgatcgcctgctatatttcgtccgtaagctgcaacatcaaactaattccctcgtatttatctatttatttcagggacttatcaggatcacaccatgtcttcccgctcatgcaacgcatccgacgcggcacctttacccgcctcgccttctacatgaggcctatagtccgtggttaaacgggacggactgccccaggctccggaggaaccttcagacaacgccggagccaccgatgaccgaccagcctcccaccgcgccctgccccgtcgccaccctcgccaccgattgggcaatcctggacgaccagatcgccggcggctgggtcgatgtgaccgcggagccagggttggcgctggcgctggatgcgctgcgcaatgccgtgatggcgcgggcagtgggggtgacggcggggtcggtgtcaggggccgcgtttcaggcctggctggtggggctgcatgtctcgatcgccgacgatccggagctggatgaagacgcccggacccggcatctgcggctcgcggccgagggcgcgcggcatctgctgcggtatctgaccacgcttcggctccgggaagcgtagcgccagccctgccatagccccctgaaaccccgaggtccggaggcccccgcctccgggcgggtccagggcggcagccctggccctgcggagcaggaggcaccggcctgtccgtcagccgagcgccgtctccaccagcccggcgacgtccaggatgtagcggtcgtcgtgccagcggccgatgatctggagcgcgaggggcaggccgtcatcggaggtggtgccgcagggcatggagagggccgggtggccggtgaggttgagggggaaggtataggggtaccaggcgccgcggatggtgccggcgggctcgccggcgatggtgacgatgccgttggggtcctggtcgaccggcagcggcggcgcggtcagggtgggagagacgatgacgtcggcgcgggcgagttcggcctggaggcggccgaagagcgcggtgcgggcggcggcggcggcggagaggtcgacggccgagtgggtgaggcccttctcgatggtcgtcaccagcgaggggtcgagctggtcgcggaagcgggcgagctgggggccgacgcgggcggcgaggccggattgcaggatgaccaggaagtggcgctcttccgacgcgaaatcgatctcgatctcgtggacgcgggcgccggcctcgatcatgcgggcgacggcggcgtcggtggcggtgagcacgcgcgggtcgacccgggtaccgcagctgcgcagataggcgacccgcaggccatcgagcgtggtggcgcggcgttcggccggcagggtgccctggccccaggggtcgcgggcgtcgaagccctggatggcgtcgaacagcaaagcggtgtcggccacgtcgcgggccatggggccaacgaaggaattggcggcgatcagatcgggcagttgcagatgcgggatgcgaccgagggtggccttcaggccgacgatgccgcagcaggcggccgggatgcggatcgagccgccgccatcggtgccgagcgcgatcggccccatgccggccgcgaccgcgaccgcagcacccgcgctggaggcgccgcaggtgaccttcgggtcgatcgggttcagggtgcggccgaagatcggcgcgtcggcggcctgtttgtggccgaattcgggggtggtggtcttgccgaccagcaccgcgccggcggcgcgggcgcgggcgacggcgacggcatcttcggcgggcacgaagtcgcggaagatggccgagcccatggtggtgcgcaccccccgggtcagcgtcagatccttgaccgaatagggcacgccgagcagcggcggcagggcgtcgggatcctcggccgcccgcacgcgatcatcggcggcgcgggcctcggcgcgggcctcgtcggcacagacggtgatgaaggcgttgaggtccgcacggtcctcgatccgggcgagcaccgcctcggtcgcctccgccgccgagacctcgcggcggcggatcagacgggcaagatcacgtgcggagaggccggtgatgtcggtggtcatgggggcggtcctcgtgttcggaagcaacggcagccggcatacctcgccgggtcagatcatccagcggccgccatcgatcagcagggtctggccggtgacgtagcgggcatcgtcgctggcgaggaaggcgaccacgccggcgacgtcttcgggctcgcccacgaagcctgccggggtctgggccttgatccggtccaccacctcgggcgtcagccggtcgtgagcgcgggtggcgatggcgccgggggcaacggcattgacggtgatgccgaggccggcattctcgcgcgccagggcgcgggtgaagccgatcacgcccatcttggcggcggcatagtcgacgatgccggcatcgccggcgaaggcgccgtcgctcgacatgttgatgatccggccggtgccgcggctgcgcatctccggcaacaccagccgggtcatgcggagcgtggtcatcaggctcacctccatcacgaagcgccaggtgccctcttccgaggcatggaaggggccggcgcgctcgcgggcgctctggccgacattgttgaacagcacgtcgatcgggccgaagcggtcgaccgcctgcatataggcgcggccgagcacggcaggatcggtacagtcgcccgcaaccgccatcccgtcagtgccggcgccatcgaagaccgcggccagcccgacatcatccagatcgaccccgaccacgcgcgcaccctcacccaggaagcgccggaccgttgcggccccgatgccgttcgcggcaccggtgacgatcaccactctgcccgaaaaccgtgccatggccggcctctctctgattgcccgcggatcttgtcagtggaaactgcgcccgccatcgacggcgagtgcgacgccggtgacgtagccggcctcggggccgagcagccagagcacggccgcggcgatttcgtcgggcgtgccgatccgttccaacgcatagcggcggcggatcgcggccagcgtcgcttccgggtctggcgtcggctcccacgaggtgcggaaaagcggcgtgtcgatggcgccggggcagatcgcgttcacccgcacgccctgatccgccagctccatggccagcgatttggcgagcatcacgacaccggccttggcggcgcaatagctggcccggcccttgagcggcacgaggccggcggccgaggagatgaacaccgccgaggccgcacccgccccctccatcgctcccgccccggccagatgcggcagggccgcgcgcatcaccagcatgggcgatgtcaggttgacgccgatgctgcgcgcccaggcggcatcggtgatccgggccagcggttcctgatggtcgatgccggcggcacagaccacgccgtcgatgccgcccatctctgccgccgccgcggccacggccgcctcgacatcgggggtttcggccacatcggccaggtggccggtgacgccggtgatgtcgagccggtcgagcgccgcccggtcgcgatcgagcacggcggcccggccgccgcgatccgcgatcatccgggcggtggcgaggccgatgccgctggccccgccggtgatcaggatccgccggccttcgaaatcccggttgcggttcatgacgccgccgcttcgaggcagggacgcatggcgtcgaccagttcgtcacagcggccgatcaccacgcgcggatgcttcagcgcatgttcgatgatgccttcgagcagcttgagccgcgagggctggccgatcagctgggggtgcatgcccagcatcatcatccggtcctcggcatagagcgtgtcgaattcgagcgtccaggcctcgagcgccgccgagggcgcctggagggtgcggccgggcaggatgatcgagtactggaagaagggtgcatcatccagcacccagcggaagggcagctcgaccagcttcgtcttctgccccttgtggctgtggatataggggctgtcgtcgtcgaagaagttcgaggaatagtcgaagccgttctcgaccagcagatccatggtgatcgggctgaactcggcggcgggcgagcgccagccgcgcggcgcccggccggtcatccgcctgatgatctcgatccccttctccatctcctcgcgctcctgctcgggcgtgaggttgacgatccaggcatggctccagctgtgatgggcgatttcgtggccgcgggtcagcagggcctcgaccacctgggggcgctgctccatcaccagcccgggcacgaagaaggtcgacttgatgccatagcggtcgagcaggtcgagaatgcgccagatgccgaccttccagccataggcgccctgcgacatcaggatcggccggttggcattgttgggatcccgcgccgtccacatggtctcggcatcgaggtcgaaggtcaggaagagggggaagccgtcgggatggaaggacatgggatgcagcgttccgactttaggatttcggccaacatggcggcgagcaggggcacggatgcacccgccgggtggggactgaccagctcccagccgccattgaggcggcggccaagggtgcgggagcacccgcccggcgagggactaaaagactcccgccattgaggcggcagcgcccgcccggtgtgggttgaccaggctcccagccgccattgcggcggcggccaagggcgcggcagcgcccgcccggcgaggggctaaaaaagactccctcccgctcacacgaatttgtggaaaccggtgcggcgttcggcgacgaacaggatcagcccggtcagcacgatcatgagggtggagaccgcggcgacgctggggtcgacgccgtgttcgacggaagagaagatcagcaccggcagggtctgctggccagggccgagcaggaagatcgtgaccggcacgttgtcgagcgaggtgacgagcgcgaagagcgcgccggcgatcagcccggggcggatcagcggcagggtgaccaggcggaaggcttcgaagccggtagcgcccagcacccgcgccgcctcgtcgagcgagcggtcgataccgcccaagctggaaagcgccgcgcgaacgatatagggcacggtgatcaccacatgggcggcgatcagcacgccggtgccgccatagagccggagcaggctgacatattgcagcagggcgacgccgatcacgaccgaggggaagaccagcggcgccatcaggaaggaggcgatggcctccgatcccggcagggccttcgcgtgcaacgcccaggcggcggcaacccccagcaccagcgaaatcgtggtcgagaccacggccagcagcaggctcagccagatggcgctcagatagtccgggtcgctcaacaccttggcgaaccagccgagtgtgagcccctggggcgggatggtgagataggaggtgctgctgaaggcggccagcaccgtcaccaccaccggcaattgcaggaagatcaccaccagcacggcggtgaccgccacggcgcgtccgggtgcgagcgtcatgcgagacctccccagcgcttcgcgagccggcccgagatccacaccaccaccagtgccgtgacggtgagcgcgaaggcgagtgccgacccgcccggccagttcagaagctgcatgtattcgtcgtagatgaccgtggccagcacccggtaggtggcaccgccgagcatgcgcggcgtgaccagggcgctgatggtgagcacgaagaccaggatcgagcccgccaggatacccgaggcggtcagcggcagggtgaccatgaagaaggtccggatccgcccggcgccgagggtggcggccgccgcctcgacatcgcgcggcacggcctggatggcggccaccagcatcagcaccatgaagggcaggtagatatggaccaggccgatgaccacgccggtcatgttgaacatcagcttgaacggcgtgtcgatcaggccgagatcgatcagcaggttgttgagcaggccgcggttggcgagcagcgcgatccagccgaaggagcgcaccaccaggttcagcatcatcgggaagatcaccgccagcgtcagcggcacccgccagcgcgccgggccgcgggcgatcatcagcgccagcggatagccgataaccaacgcgatggcggtgaccagcaagcccaggccgaaggtccgccagaccacctcgcggtaatagtcgtcggtgacgatctgggcatagttgtcgagggtccagctgccgggggtgatgcccatgcccggcaggtattcgcggaaactggtcggcagcatcaggatgaccggtgccaggaagcacgcgatcagcaccagcatcagcggcgagaccagccccagcccggtgcggcggcgcatgatcatgcggcacctcccgccggcatcgcaaacacctggccgggatcgatggcgagccggacggcggcgcccggggccagatcggcgccgggaccggcggaagacgtctcggcgatcatctccaccccgcccgccagcttcaccacatactgcacccgggcgccggtgaaggagcggaaggcgatttcgcccgccaccgcatgcggggcatcggcctcgggcgccagaagccggatcgcttcctgccggatgatgatctcggccgcaccgcctgccgcgacctggggatcggcggcggcgagggtgagatcggggccgatccgcacccggcccgccggccccgccgtctccacccggccctgaagccggttgggccggccgatgaagctggcgacgaagccgttgaccggccgggcatagatcgcctcgggcgcatcgaactgctggatcacgccatgggccagcacgcagacccggtccgacagcgacagggcctcggactggtcatgggtcacgaacaggctggtgatgccgagccggccctgcaggcgcttcagctcgatctgcatctcgtcgcgcagctgggcatccaggttggagagcggttcgtcgaacagcatcatccgcggccgcggcgccaccgcccgcgcgatcgccacccgctgctgctgcccgcccgacatctggcggggatagcggtcggccagatggtcgagccggaccagggcgagcgcctctttgacccgcgaggacagctcggccccgcgcacgccctgacgcttcaggccgaaggccacgttctcggccaccgtcagatgcgggaacagggcataggactggaagaccagcccgatccggcgccggtgcggcggcaggcgggtgatgtcttcctcgccggccaggatccgcccggcgctgggctcgatcaacccggcgaccatgcgcaggatcgtggtcttgccgcagcccgacggcccgagcagcgagacgaattccccgtcggcgacggtgatggaaacgtcgcgcaccacctcggtgtcgccatagcgcttgtgcagtcggtcgatcgtcagcttggccatcggcggtggtccatccagggcagtcgggttgcgcctcgatgccagagctttcccgttccggccggtcggcgcaggcgcgcaccggccggcggggcagccggcgaagagaacggtctgaagcgaaaaacctgaaaacaggaaagaaacggcggcagggggcgcccgcaaggggggagacaggcgtccggggggccagggaggggagagccccgtccctgccgccgttcaggaccgccgcgccgccccagggaggggggaggtgtcggcgcagcggtgcatggggtggatcagcgggtgacttcgcgctgccagcgccggatccagtcgggcatgttgctcgcgaccgtctgcggatcggggaaccagagattgtcgcgcgcctcgcccgtcggcacgatcttcgcgaccttgtcgctgaggtcgaccttggtgttcaccggcccggcatatttccgctcggcgaagcaggcctggccttcgggcgagagcaccacatcgatgaacttatgcgcaagatcggcatggggggcgccttcggggatgctgagcgtcgggcggatgccgacggccccttccttcggataggcgaccgccaccttcacgcccttgtcggccgcagagccgacccggtcggggtaccagggcgccatcgcgatctcgccacgctcgaacagcgacacgatctggtcggcctgggtgtagaaggtgacggcagagggcgccagctccttcagcgccgcgatccccggatcgatattgtcgatcgtgccgccatgcatccggttcatcgccagcaggaactgcatgcccgaggtgccggtcacgtcgcccagcgcgatcttgcccttccacttcggatcggcgagatcggtccacgaggtcggcggctcgggcatcatctcggggttgtaggcaagcgcagtggcgcccagcatgaacaccacgaagcgcttgttgtcggggatggcgcccgcgatcagatcggctgcgttgccgagctccgcggtgtcgatctcggagagcagcttttcattggcgagctgggtggccagcgagtcgtccatataggcgacgtcgaactggctgcgcccgcccatggcgcggatcgcggccgcatgctgcacggacgagccgaccttcatggcgacggtcgcgccggtcgccttctcgaaagccgcgatgtggcaggttttggtgtcctcggcgaaggagccgccgaaggtcgcgatcaccagctcttccgccgatgccacggccggtgccgcaaccgcaaccgctgccgtgatgaccgccgcagcggtgcctgccgtcatccgccgccgcgcgcggtcggtgcgttcgatcgccatatcccgtgttctcccagcctgtgacccggccatcgggccggtgcccgcccatgggggcgcttttgttcgtggtgccggttcgtggtgccggcggggcgtcttcgcagcctctccccgccgcgatgcgttccctggattgcaagcctaggtctcttccgattatctttcaagaaagaaacttgtgagatatcgccgtccgggccacgatgtggcaacgccactgtcaggagcagcacccgccgatgcagaccgatccggccccagcccccaccaccgacgagactgccactgaccagcccgccaccgatgcggggccgggcgatccggccgatttcgacaccgtcggccgcggcatggcccgctggcgacgcgagcggccggatatcgacagctcgggcaaggccgtggtcgggcggatcctccggctggaaggggtgatcctgaaggcggtgaatgccacgctggcggcccatgggctgaaatacccggcctatgccatcctggcgacgcttcgggtggaaggcgcgccctaccggctgtcgccgtcgcagctgcaacagaccatgctgttctcatcgggcggcatctccaacctgctgctgcggctggaaaaggacgggctgatccgccgcacctcggaccgcaacgaccggcgcagcgtgatcgtggaattgacggagaagggcgtggcgctggccgatgcggccatggcggaccatgccgcgaccgagcgccacctgatccgcatgttcacccaggacgaacgcggccagctggccagcatgcttgcgcgtatgctggcggtgaatgcggatgcgccgggctatgtctgagagcccggccatacctgcggtcggttgccttgatcatttcattgaatgaaattcattttataaattgacatgccttccgtttaacggaatcctgccggcagatgtgaagctggcgggtgccccatgcccgggtaccgacaggccggccgacgggaggacgaccgaagatgcggacattgtggaagcgggcggcgcttggcgccgccgcaacggccctgctcaccctcagcctgccggcggggggttcggccgaagaggcacgcaatggcggcgtgctgcgcctgatcgcgcaccccgagccaccgaccctgatgctgggcctgaaccagcagggccccacccagttcgtggccggcaagatctatgaaggcctgctgacctatggccccgatctgcagccgcggccgcatctggccgaaagctgggagatttccgaagacgggctggtctacaccttccatctgcgcaaggacgtgcgctggcatgacggccagcccttcaccgcgaaggatgtggtgttctcggcgaccgacttcctggccaaggtccacccgcgtgcccgcggccatttcggccgggcggagaagatcgaggcgctggacgatcacaccgtccgcatgaccctgaaggcgcccttcgcgcccttcatcatgggcttcgagacctcgtcggcgccgatgatcccggcacatatctatgaaggcaccgactaccagaccaatccggccaaccagaccccgatcggcaccggcccgttcaagctggccgaatggaagcgcggcgccttcatccggctggaacgcaatgcggattactggcaggccggcaagcccgatctcgacgggctgaacttcgtgatcgtgcccgatgcggccagccgcgcgctcgccttcgaaaccggcgaggtcgatgtgctgcgcggcggcgatgtcgagtatttcgacgtccagcggcttgcggcgtccgacggcgtcaccgagacccgcgccggctatgagatgctgtcgccgacgatgtgggtgcagttcaacctgcgcagcgcgccgatggacgacgcccgcttccgccgcgcggtgatgcatgcgatcgaccgccagttcatcgtcgacaatctctggttcggcttcgcgaagccctcggccggcccgatcgcctcgaccacgccgttctacgatgaaaaggcgctggtcacctatgattacgacctgaagaaggccgaagccctgctcgacgagatggggctgaagaaggacgcgaacggcgtgcggaccaccgtccgcttcctgccgctgccctatggcgagacctatatccgcctcggcgaatacatccgccagcagctggagcagatcggcatcaggacccagacggtcgcgaccgatcatgccggctgggccaagcggctcggcgactgggattacgatctcagcctcaacctgctctaccagtatggcgacccgtcgctaggcgtggagcgggcctatgtctcgaccaatctggtcaagggctcgccctcggccaatgtgtcggggctgaacgatcccgaggtcgaccggctgttccgcgaggcggcggtcgcgaccgatcgcgagacccgcgcggcgctcttctcggatcttcagcagcggatctcggaccaggcctatttcggctatctgatcgaggtgcagttcccgacgctctatcgctcgggcatcgagaacctggtgaccggggccaccgggctgaatggcgagatggaagacgtgcgcctgccgaagcgctgagcccccgtccatcttcccgtcttttcacctccctcccctccccggcgtccccccgccgggccgggcggtggcgccctccctcttcaggccgccatctgtctccccttgtggcgatcactgccaccgcccggatctctgtcttcgctccccccttctctccgccccaccacaggaaacctgccaccgatggtcaagctcgaccgcgcggcatcgcgcctcgtgaaggcggtcgccgtcatcctcgccatcgcctgcatgaatttcgtgctgatccgcatggccccgggcgatccggtcgcggtcatggccggcgaggccgcgatgaccgaccaggcctatctcgacgagttgcgcgagcgattcggtctcgaccggccggtgcacgaacagctgatggtctatctgggcaatgtcgccaccctcgatttcggcacctcctaccgccagggccggccggttgccgacatcatcctggaacggctgccggcaaccctggtgctgaccatcaccgccttcgtgatctcgctggcgctgggcatcaccgccggggtgatcgccgcacgccgccccggcggctgggtcgacacgaccgtctccaccctggcgctcgccttctatgcgacaccgctgttctgggtggggctgatggcgatcctgctgttctcactggaactgggctggctgccggccttcggcatgcatggcgcaaccccgcccgaaggcggcttcgcctatctggccgaggtcgcgaaacatctggtgctgccggccatgacgctgggcctgttctacaccggcgtttatgcccgcctgacccgggcccagatgctggaggtgcagtcgcaggatttcgtgcgcaccgcccgcgccaaggggctgacggagccccgggtggaacgcgcccatgtgctgcgcaacgccctgctgccggtggtcaccatggccggcgtccaggccgggcatctggtcggcggcaccattctggtcgagacggtcttcgcctggcccggcatcggccggctggccttcaacgccctgctccagcgcgactattcggtgctgctgggcgtgttcctggtcacctccaccatggtcgtggtcatcaatcttctgaccgatctggtctacggcctgatcgatccccgcatccgtttcgagcgttgagtcgatgatcgccttctggacccgtttcgcccgccacaagggggccgtgatcggcctagtggtgctggtggccctggtggcgctggccctgctggcaccgctgctcttccccggcagcccctggaccatggccgggcgccccttcgccccgccgatgaccggcggcttcctgctcggctccgatacgctcggccgcgaccttgccgcgggcatcgcccatggcgcccgcatctcgatgctgatcggcctggtctccaccctggtgacggtgggggtcggggtcgtgatcggcgccaccgccggctatttcggcggccgggtcgacgacgcgctgatgcggctgaccgagctgttccagaccgtccccagcctgatcttcgcggtggtgctggtcgccatcctcaccccctccatcgcctcgaccgtggcggcgatcgcggccgtcagctggccgccggtggcccgcctggtccgggccgaattcctcagcctgcgcggccgagaattcgtgctcgcctcacgcatgggcgggcagagcgatctggtgatcatctgccgccagatcctgcccaacgccatggcgccgatcatcgtttcggcctcgctgatgatcgcgaccgcgatcctgatggaaagcgcaatcagcttcctgggcctcggcgatcccgacctcatgagctggggctatcaggtcggcgccgcccgcaccgtaatccgccaggcctggtggatgagcttcttccccggagtcgccatcgtgctgaccgtgcttgcgctcaacctcgtcggcgaaggcctgaacgacgccctcaacccgcgcctggcgcgccgggggcgggtatgagcggcgcgctgctctcgatcgagggcctgaccatcccgctgcccgaaggggctgaccgcccgcatgcgatcgaggacgtgtccttcgacatcggccgcggcgagatcgtctgcatcgtgggcgaaagcggttccggcaagtcgatgtcggccagcgccgtgatgggtctgctgcccgaaggtctgacgccctcggccggccgggtggtcttcggcgggcgcgatctgctgggccttcccgccgccgaacgccggcggctgcgcggtggcaaggccgcgatgatcttccaggagccgatgaccgcgctcaacccggtgatgacggtcggcgaccagatcgccgaggcgctggtcgcccacggcatgcgcgaccgcgccgcgatccgccgccgggtgatcgagttgctgacccgggtcgatctgccggaccctgagaagatcgtgaagagccaccccttccggctctcgggcgggcagcgccagcgggtgatgatcgcgatcgcacttgccaacgaacccgacctgctgatcgccgacgaaccgaccacggcgctcgacgtcaccacccaggcccagatcctggagctgatccgcgagatccaggcccgcaccggcatgggggtcatgttcatcacccatgatttcggcgtggtggccgaaatcgcccatcgggtggtggtgatgtgtgcgggccgcgtggtcgaacagggcacggccgacgaggtgctgaaccggccgcgccatccttataccatcaaactgatcggcgccgtgccgcggctggaagcggcggccccgccgatccccgccgatgcgccggtggtgctggatgtggcggggcttgagaaggtctatcgcggcgagcgcagcctgttctcgcgcggatccggccgcgaggtccatgcggcggacgatgtgacgctgaccctcaggcgcggcgaggtgctgggcatcgtcggcgaaagcggctcgggcaaatcgaccgtcggccgatgcctggtccggctgatcgagccggatggcggccgggtaatgctggatggcacggatatgatggcgcagggcgcgcgcgggctgaaacaggcgcgcggccggatgcaggtggtcttccaggaccccttcgcctcgctgaacccgcggcgcaaggtcggcgacatcatctgcgaggcgccgcttgcccatggccggccggcggccgaggtgcgtcggcggatgttcgaactgctgaaactggtcggcctgcccgaggccgcggccgatcgctggccgcatgaattctcgggcggccagcgccagagaatcggcatcgcccgggccctggcgctggatcccaaggtgctgatcgccgacgaggcggtctcggcgctggatgtctcggtccaggcccaggtcctggcgctgctcgacgatctgcgcacgcgcctcgatctcgcgatcctgttcatcacccatgatctgcgcgtggcggcccgcatctgccaccgggtggcggtgatgcgccgcggccgcatcgtcgaagaagggccgaccgcccgggtcttcgagaccccgtcccacgactatacccgcgcgctgctggccgcgatccccggacggcactggacggcacccgccgccccgggccagggcgatatcgccggcgccgcgctcgcgcaaggaggctgaccccatgggcttcaccatggcagagaagatcctcgcccgcgcttcaggccgcgagacggtccgggcgggggaagaggtgcaggcccggccggatttcgtcctcgcctacgagttcccgggctacaccgaccagttcttcaagatgatggccgaggatttcggccgcgacgcgctcgatgcgcccgaacgtttcgcgattttcatcgaccatatggtcccctcctcgaccccggccgaggaacaggtccatcaggcgacccgcgactggtgcgcgaaaaccggcgccacgctttatgaacgccgcggcatcggccatcaggtctgcgtcgaggaaggctatgccgccccgggcgccttcgtggtgcattacgacggccatgtctcgcagatcggcgcctatggtgcgctgggcgtcaacctgccccggcgcacgctgatcgaagccttcgtgcgctcgggcgtcgacatcaaggtgccggagacggtgcgggtcgatatgaccgggcagttgaagccgggcgtgatgggccgcgacgtcatccaccatctgatccgccgcctgggggtgaagacctgccggttcgcggtgctggaactgggcggccccgcggtggcgacgctctccgacgacgcgctgcagtcgatcgccggccaggtgatgttcctgggggcgctctcctgcctggtcgacctgcccgacgaccggctggccgcctcggccgcccgcggccggatccgtctgcccgatctgcgcagcgatgccgatgcggtctatcgcgaacgcatcgccctcgacctctcggaactgggaccgatcgtggtggcgccgcccagccccgccgatacccgggatctggcggaattcgagggccggccggtccaggtgggctatctcggctcctgtgcctcgggccggatcgaggatctcagggtggcggcgaagctgctcgaaggccggcagatcgcgccgggctttcagctcaacatcgtgccgaccagcaatgcggtgatggtccaggccgcacgcgaggggctgatcgccacactggtcgaggccggggccttcatcagcgccgccacctgcgacttctgctatggccgcatcggcaccatggcgccggggcagacggcggtttccaccggtacgctcaacgttcccggccggatgggcagcaccgaggccgacatcttcatctgcagcgccgccaccgtcgccgcctcggcgcttgccggccgcatcaccgatccacgccgccatccggagttcgctcatgccctctgatgcgcaggacctgaagctgccggccatccgcggccgggtcgcctgggtgttcgaccagcccgattacgatgtcgaccagatcgtgggtgtgaagaacatcaagatccaggatctggatcagctggcggcgatcgccatggccgatcaggacccggacttcgccgcccggaccgcgccgggcgacgtgctggtcgccgccgacaatttcggctacggccacccgcatgcgccgccgatgcgggccatgcgccatctgggcatcgccgcagtcatcgccgagggtttcgcccccacctattaccgcggcgagatgagcctgggcttcccgcagatcgcctgcccgggggttctggggctggcgcagcgcggcgacgagctggagatcgactgggaccgccatctggtcgtcaaccacagccgcggcctgagcctgcccttcgagccgccgagcccggccgagcgccgcctgctggccctcggcggccatctgccggcactcaaggccgccctaggcgtctgacccacataaaaagcctcaagaggaaacccgccccatgtccctgaccacccgcaaacgcctgcgcgaaatgctcgcctccggcaagaccgcctggtcggctggcgccttcgatgcggtcagcgcgaagctgatcgaggaagccggtttcgacgtcatgctctcgtcgggtttcgccatttcggcgagccatctgggcgagcccgatgtcgagctttacaccatgaccgagaacctggccgtggtgcgcaacatggtccgcgcgacctcgatcccgctgatcgccgatgtcgataccggctatggcaatgccatcaacgtgatgcgcaccgtccgcgagttcgagcaggcgggtgtcgccgccgtgatcatcgaggatcaggccgtgcccaagcgctgcccggcgatcgccgacgtgctggaactggtgacggtcgaggaaggcgaggccaagatccgcgccgccgtcgccgcgcgcaccgatccggatctggtgatcgtggcccgcaccgatgccggcaccgaagaggagaccatcgcccgggcaaagcgctatgccgctgccggcgccgacatgatccagccgatcagccgcggcttcaccgatctcgacagtctgaagcggctgagggatgccgccggcgtgccgctctcgttgcagatcatgcgctggttggagaccgacctcacccccgaccagatcgaggaagtggccggcatcgcgcattatccgctggtggcgctgctgaccgcgaccgatgcgatgcgccgcaatctggcggcggtcagggccgcgcgcagcacccgcatcaacctgccggtcggccagacgccgctcggcgacttcaagaccttcatcggcttcgaccgggtgatggacctgcaggcgcagttcctgaccggcaccgagccccgctgaccgggaaccctggttccgccgatcacctgaaacgcgcgccggccttgcggtcggcgcgcatcgcgtataagcccagagaggatatcgagaccacatgccgaggggaaagcccgccatggtccaggcgtccggcgccgaagccggcctccacgccgcggaacacgagaccgacggccgcgacgagccgtcgcgcggcggcgtgcgggccgtggaacgggcggtgcgcatcctgcgcgccttcacccccgaacgtccctggctgaccctggccgaaatcgccgaggcagccgtggtcgacaaggccaccgcccggcgcatgctgctgaccctgatcggtatggatctggtggagcaggaaccgatcggccagcgctatgcgctggggctgggcgtcgtggcactcggcgcctcggtgccggtgacggtggatctgcgcaatgtggccgccccgcatctggccgggctggcgcgtgaaacccgcgccatggccttcctgtcgatcctgcgcgaggacggcgcgatgtgcatcgagcgcagccacggcaacccgccggtcgatgtccggatctggaatgtgggcgaaagcctgccggtgaaccgaggtgcggcgccgcggctgctgctggcgcatcttggcgccgaagaacgcgcccgccgcctcgcccgcccgctcggcgccgcgaccgcccataccctgacggcgccggccgcgcttgaagcggatggcgccctgatccgcgagcgcggctgggcggtcgcggtcgacgacatcgtcgaaggcgtctccgccctggccgccccggtccgcgatgcccgcggccgcgtcgcagccgcggtcagcgtctcgggcctcaccccccaactgatcggccaggacggccagccgctcaccgacgccctcacccgggtccgcacggcagcggccgagatcagccgtcagttgcaggatatgcactgggcgcggtgaaaatcattatacccgcactgcgtccccgcgctcgggcgcgccatgatgttccagcagatatcgcaccgccagcccgatatgacgcggaaccggcttgttctttcggtaatcagcgaccagccgtcgcgacacctcgagggcagcggccatgccttccagcgtcattcccaggtgatccatcgcccgccggaaatcctcattgtcgaacaccaccggcggcaatctcgacagccacactgcagacagctcaagatctcctccccattcgatggcgttcccccattccgcaacccgcatcgagcgaaacagcgcgtcgtcctctcgcaggggaatatagatccggcgactcgccagcacgggtgccagatcaacaattgtcggctcacccgatacccaggtcagacgtaccttacgcccgtcgagcggttccgcggccgcaagacgcggaagtggggctcccgcaacgatcaggtcatctttgattgagccgctcccattcatgcgcaagaagctcccggttattcgccgcccatctggtggcgatttcatagcttcgcccgtcaatccgccccgctatcaccgaaaaatcggcaagcttgatcagtgcctcataatccggtgtcagaaggtgaaaatggggcggattgtgatcatcagcgaacatctggaccttgagattcccgaatcgcacgatagtaggcattcatggaatcttcagtcttgaaatagtgcaccctgtgcattatttcaatgcccagcggaccagtggcatatccggacgctacaggcccctcgcgtcgagccattcccataccgaatggtgagcgatcaacttttaattaagtatctcaaaaaatcacgcaatacataaatagaactcgaacacatacgcgcgaataatgatgccataagttttattttcccatgggcctacaacttaacttgcaagcccaaaagaggcgacttcagatccgcacaatcacctgagacgtctcgacgatacgctgcagggtgtcctgatccaggccgcggaacaggcgggcgtaattgctcaggatcgaagttaccatatcggcgcgctggtcggggctggccgcaatgccgcgattggccagcgtgcgttccaccgccaggatgaccatccgcacctcggccggcgataccaggtctgcggcccgtgcgtcgtcggccgtttccgatccggccagcagctgccaggcctcgcaccccaccgcggtcgcgatccgccggagcgtcgcctcggtcaggccggtgcggccggtctcaaggcgatgcacggcctgccgcgtctggccgatcgcattggccagggcctcctgcgtcagcccggcgcggtctctcatctcgcggatgcggttcggcggaatgctcgtcatagcaggactatgcgtgccgtccgcaacgaacgcgagtggctgtatagggctagcttccggaagaattcaggcttaaaaagttacatacacgtcgaggcgaaagcccgagtgcccgatggcaccgccggtggcatcatggcagaaaaccagcggccaccatgccggcatatccaacctttccgcgcgacaccgggcgcgcaggcgacaggggatgacgaagcgccatgcccgccagacatcgggaaaccgacacatctccagccgggaatgacgcctcaaaggcgtcatctagaaaggcctgtcccgtgacatcccttatctcggactgggcgcttctgtccggacacgccatccatgctgccacattggtggccccggaggatgctctgaccgcagcaatcgacgtactggacgcggccgtgacccgccgcgcactgcaacttacgccgcggtccgcgggcggtgccgccttgcaggcggagatgatcggccgctgcattcgggcagcggccgcaccggacggggcggcggaagaccgtcggcgcgcgctggagcaggcggcccagggactgcgacacctgacggactacctgaccggccggtgaaccgcccgcttcagctccggaccagattgacccgatccgcgcccttaaggccgagcatggcgcggacatccgccggcgtcgccacctccagcgacagggcttcgaggatggtgcggatgcggcggacctggacggcgttggacggagccagcccctgacggccatcgtagagattgtcttccagcccgacacggacatgaccgcccagcgccgcgccgatggtgatcagcggcatctggcgccggccggcccccagcaccgagaaaatatagtcggtgccgaacaggcggtcggcggtctgcttcatgtggaagagatgtgaggcatccccgccgatgccgccgagcacgcccagcacgaattggatgaaaggcggatgcgggatcaggccgcggtcgcggaaatgggcgagcgtgtagagatggccgacgtcgtagcactcgaattcgaagcgggtgccgcagtcctcgcccagacggcgcaggatggcctcgatatcggcgaaggtgttctggaagatcgaactgcgcgtcgcctccagcagctgcggttcccaggcgaactgccaatcctgatagcggtcggccagggggtgcaggccgaaattcatcgagcccatgttgagcgagcacatctcgggcgcgatccggagcgccgcttccaggcgctgctccagcgtcatcagcgaactgccgccggtcgagatgttgagcaccgcatcggttgcggccgcgatccggggcaggaattgcaggaagacctcgggatcggggctgggccggccgtccttcgggtcgcgggcgtgaagatggaggatggcggcccccgcctcggccgcctcgatcgcctgggcggcgatgtcttcgggccgccagggcagatgcgggctcatcgtcggcgtgtggatcgacccggtgaccgcgcaggtgatgacgaccttgggcgcggatctggtcccggcatccctgatctggacagacattgggggctcctcgatcgtcggataaacggggatatcaggcggaatggggcaggttcagctcgcgggcgagcgcgagcagggtgtcgtcgaggatcgccatgatctcgtcgatctcgccggccgtaacgatcatcggcgggcagaccaggaaatgatcgccgtcgatgccgccccgggtgcggcgggaatagatgatcagcccccgttcgaaggcgaggtcgacgacgcgggcatgggcgttcagctcgcgcggcagcgtcgccatggtctcggggtctgagacgaattcgaccgcgagcagcaggcccttgccgcgcacatcgccgatgaaagggaagcggggcttcagcgcttcgagccgcgccttgagcagggcgcccatccgcgccgcattgcccatcaggtcatgggcgtcgatctcgtccagcaccgcgaggcccgcggccgatgccagcggattgccggcataggtgaagccgtgctggaaaccgccggcatcgagcaccggcctgaccagtttttcagaggcgatcatggcgccgagcggcacataccccgcccccagccccttggagagcgccaccagatcaggcgtgatgccccaatggtcgccgcccagatagcggccggtacggccggcgcccgacattacctcgtcatggatcagcagcacgccatagcggtcgcagatctcgcggatgcgcggatagtaggtatcgggcgcgaccagcgccccggtggaggcgccgccgatcggctccatgatgaaggccagcacggtttcggggccctggcggcggatttcgtcttccagcatgtcggcgtagcgccggccacgagcggccatgtcgagcccgtcgcggtcgagataggcggtgggcgcggggatcttcggcatctcgtgcatcatcggcgcgaagggcgccgagaaggcggcatgtccggtcaccgacagggcgccgagggtgctgccgtgataggaggggaagcgcgagatcaccttgaagcggctgccctggccggtcgccaccgcatattgccgggcgagcttcaggcaggattccaccgcttccgagccgcccgagacgaagaacacccggtcgagcccggccgggcagcgatcggcgagcgccgcggccagacgttcggccggctcgttctcgaaatgcaggcgatagatgaaggtcgcggcctccatctgccgcttcatcgcctccagcacccgcggattgccatggccgatattgaccaccatggcgccgctggaaccgtcgatcacccggcgaccggtctcgtcccagatgtagatgccctcggcacggctggcgagcggccggcgcaggcgggcctgatagaacagatgcgaaggcggccggttgtcgccggcggcgggggctgcaggggtggccatgggggcaggctccgggaaaggacggattccggggggtgaaaaacgtcagcggggggtgagataacggtcgaggatgttggcggtgacccgctcgaccatcggatcctggcggagcaggcccgccacccattcgcagctgccggcatggaagacctcgccggccccgcgtcggaagttgacgatggcgcccgagccgcgcttgacccgctcgacggcggcagggtcgtcgccgcccgccaggatgccggccacgaaccgggcatcggcatcggacaggaactggtcgtcggcggggatgtcggccgattcctcgatcagtgacgacaggcccagcgccaggatctgcagcccatcgggcacttgtgcaccgggggccggttcgggcaggccgttctggatgacgtagtcgagcccgtcgacctcgtagccgaagacgtgggaatcggcccccagcaggtcgccgtaatagagccctgtgccggcaaaggcccagtgctccggccggtagaccggaaagccccgcacgccgcggggcgcgcagccaccccagccgacatagaggccgcgggtggcatccagtccgaaggtcatcgcaccggggcgaccgatctctgccgcttcccacgaggtggtgatccggggggtgccggcgagcggatcttcagcacgggcccggtatttgtagcagacctgggtgcggccttcgtcttccagccgggtctgccacatgaaattgccggcaaagcgcgcgacccggccgccggcctcgacataggcatcgacggcatcgcgcatctctgccgtccagtactcgtcatgaccgacgaagaccacgcagtcgtaacgcgacaggatttcgggccgatcatgcagatcgtgctggctggcgaggtctacggcatagccggcgcgctccgcccagcggaagaaatggccatcgtaagaggcccagccggccgaggcatacttcttcgaatggccggtcgcataggcccattccatatgcgggtagcgcggcggcatggccggcggcaccggcacctccagcggcacccgcggcgcctcgggcggcaggaccacgaagccgcggcagaagggccgctgcaggctgacccgcggggcatactgattgcgctcgggccccgtgatgccctgatagtggttggatccgccccaggtgttataggcggtccaggttccggtggcggcgatctgcagcacccggcccggcaggcgatgctggcctgcggcggtgacgatgaacagatggtggcaggtgatcggcgccccgtcggccccttcgcccgtggccgtcacccgataggcgccggatcgccagcccgccggtatgaccagccgatgggcgacgggccagccgcagccggtcaccgagcactgatcgggggcgtcgtgatggccggcggtcaggccctcttcgacatgcaccagttcgagtgccgcgccgtcgcgggcaatctccagccgccagttggccgaggtcgacgagacgtggaaagcgacggtgtcgccgggggcataggagagccggtcggtatagcaccagatctcccctcgggcgccatccatgccagggtattcataggtatgaccgagtacggcgatgcgccgctgggcggcggtcaggccgtaatccggccagccggcgacatcgggggcggcggcatcgggggcggcggcggtaccgaggggggcgttcatggccgtgatcccgtcatgcgaggtatttgcgcaggaagccgcgggtgcgctcctgccgggggttgcggaagatctcggccggcggtccctgctccaccaccacgccgccatccatgaacagcacctcgtcggcgacctcttcggcgaaacgcatttcgtgggtgacgatcagcatggtcatgtgctcggccgcgagctgcttcatcaccagattgacctcgtcgaccagttcgggatcgagcgccgaggtcgcctcgtcgaacagcatcactttgggccccatggcgagcgcgcgggcgatggcgacccgctgcttctgcccgcccgacagccgggctggatgggtgtccatgcggtcggcgaggcccaccttcgccagctggtcccgcgccacctcgcgcgcctcggcctcgctcatgcccttgagcagggtgagcgccagggtgacgttgcgcccgaccgtcagatgcgggaacagattgaagtgctggaacaccatgcccatctgctggcgcaccgcattgatgtgccgttcgaaggccgccccggtgagcggcgcgttcacctggacgccgtcgaggaagatctcgccctcgttcagcgtctccagatgattgatcgaccgcaacaaagtgctcttccccgagccgctcgggccgatgatcgcgatgatccggccacggtcgacggtcaggtcgatgcccttcagcacctcgagcgcgccatagcgcttgtgggcattgcggacctcgaccatgggccggggggcggaggagctggtcgtcgtcatcgcgtcgcctccacgcgcttctcgatcaggcgcaggcccgcttcgagcatcaggttcaggacgtaatagagcgcggccgcgacgatgtagaactcgaagggccggaaggtctcgctgatcgcaagctgggcggcatggaccaattcggcgacgccgatcaccgagaccagagccgattccttcagcagcgcgatcaggttgttgccgatcggtggcaccaccgagcgcaccgcctggggcacgatcacatggcggaagctctgatagcggctgagccccaggctgcgcgcgccctcgttctggccggggtcgacggcggtgatgccggcgcggatgacatcggcgttgtagaccgcgaaatgcaggccgaggccgatgatgccggcgaccagagccggcacgtcgatgccgatctgcaccaggccgaaatagatcagaaacagctgcaacagcagcggcgtgcccatgaacagccaggcgaaaccgcgcaccggcaggcggatgaaccagggcgcgtacatggtggcgacggcgaagccgatgccgcctgcaaaactgaccgcagccgccgcaaccgtcagcaccgccgtccagagggcgcctgtcaggatcaggtcggcatagggcggcacgaccgagaaatcgaggccctccatctcagcgccccccgtcgatggcgaagcgccggtcgagccagccgatggcctgaagcgccacccagatcatcaccatgtagaacagcgccgcgatcgcgaacatctcgaacggcttgtatgtggagccgatatagcgctgggcggtgtaggtcagttcgaccagagaaatggccgataccagcgccgagcccttgatcagggcgatggtgttgacgccgagcggccggatcatcagccgggcggcctggggcaggatcacccgggtcatggtctggccgcggccgatgcccaggctgcgcgcggcctcggtctggccgcgatcgacggcgaggatcgcgccccggatcgattcggtcatataggccccgatattgatgccgagcccgatgacaccggccgcgaacgggtccagctcgatcccgatctgcggcccgccgaaatagagcacgaacagctgaatgaggcagggcgtgccgcggaacaggctgacataggccccgccggcataccggatgacggcgacacgcgacagccgcgccgcagcaccgcatgcccccatggcgaggcccaggaccagcgccagaaccgaaatctgcaccgtgatccaggcggcttccgcaaagaaggggaagacccggatcatcaggtcgacatccatgggttccgtctcccgatggcataggctccgcccccggaaggggcgcgcaggatgcgcgggagggggcgcctcccgcgcgacggatcagcggatgtcggcgccgacccactccatcgagatcttctcgtaggtgccgtcggccatcatcccgtccagcgccgtctgcatggcggcgtggagatcggggttgttcttgcggatggcgatgccgatcgcgactgcaccgccctcgatgtccggcgtgtcgagctgacgcagcttctcgccgttttccttgatcgcgacccggacggggatgttgtcgttcacgatcgcctgcacccggccggccttcagctccagcagcagttcgggcaggcccttataggtgcgcaccgaccagccgttctgggtgcgggcccatttctcgtgggtttcgcccagggtgacgccgacggtcttgcccttgagatcggccagggtcttcacgtcggaggcctcggtcacgaagaccgcacggccggcgtgataataggggccgacgaaatccaccaccttctcgcgctcgggcgtgatggtcatgctgccgacgatggtgtcgtatttcttcgccagcagaccggccaggatgccgtcccaggcggtggtgacaatctcaccctcgacgccgatgcgcttcgcgatctcgcggccgatcgccgcatcgaagccgaccacctcgttgcggtcgttgacgaagttgaagggcgggtaggcgccgctcatggcgatcttcatcacgccgtcgtccttgatcttcgccagatcatcggccgcggcgacaccggcgcccatcaccagcgcgacgccggcggcaagcacgcccgtccagaaacgcttcattgtcgtggtctccctcgagatctgcggccgggtccctgttcccccgcgcgggccccggttccgcccaggtcctcgccgccgcgtcacctcatgctcgcggatgccgagaccattgatcaaatagataatgaaaatgtaaaacatagttctgaagaatgatctgcggggtccgatgaaaaagcacgaagcccagcgcctggcctgggacctggactggaacctgctgcgcaccttcatggtggtggtggaggaacgcggcatcacggcggcggccgagcggctggggctgaagcagcccacgatcagcaacgcgctggcgcggctggaacggcggctcgaccgccggctgatcgagcgcaagcccaatgtcttcgaggtcacccgcgccggccagctgctctacgccgattgcgttgagatcttcggtacggtctcacgcctgccgatccggttgcgcgatgtgaaggaagatgtgaccggccatgtcctgatcgcggtggcgagccacatcgcctcgccgctgttcgacgaggcgctgtcggatttccatgcccgccatcccagggcgaccttcggcatccaggtgatgaccagcctggacgtggcgacagcggtcgcccagaaacgcgccgccttcggcctgtgcctggtgcacacccaggaccccaggctggactaccgggtgttctatcgggaattcttcggcttcttctgcggcccgacccaccggctctatggccgcaccgggctggcgctggaagatctgcgcggcgagacctcggtgtcgttccagaccgatcatacctccgacgcgctgcgcccggtggcgctgctgcgcgcccgggccggcgtcgacgaagaagtggtcggcgtgtcgtcgagcctggaagaggtgcgccggatgatcaccgccgggctcggcatcggccccttgcccctgcatgtggtccgccgcgacgtccgcgacggcctgctctggcggctgccgccctatcaggacccgccggcgatcgacatccacctggtcttcaacccgcaggccagcctgaaccgcgccgaggccgggctgctggccctgctgtgcgaacgggtcgaggccctgccactgccggcacggacctatgggccggagtgaggggtgtcttgagactgaacaagatggggcgatggcccgaagcggctctctcaaggaacgcccggttggccgtattgcacgatcttctgtccgcatctcgcgcgcacgagccggacggccgtgaaagaatattcatcagatcttcacggcattcgagttcatcaccccatgtcaagctcggcaggaaccacatcaacggcgccggggcccgacacggctatgccgtcacagcctcgggcatggcctctcagactggcgccatggctggcctgtgcccttgccatcgccgcggtcgtttacgtgacctggaactggaatgcctggacaggcagccgtccgatccagtcgacgcaaaacgccttcgtgaagtcagatcccgtcatcctgagcgcgcgcgtgagcggctatgttcgacagctccccgtcacggactaccagaccgtcagagccggagacgtgatcgccgagatcgagagcgatgcctatgcgatcggcgtaagaagcgctggagcggcgctggcgaaggcgcgggcggtgctcgccaatctggacaatgaagaagcgcagcaacgtgctgtaatagcgcaggcgagggcgtcgcttcgtggtcgcgaggccaaccttgtcgaagcccggcgcgactatgtccggcagtcccggcttgtggaaaaaggggccgtctcccgtaaatcgttcggcgacgccgaagcggcgctggcgtccgcaacggcgtcccgcgacaccgaagcggcagccctcggccttgcgcaacgggggctggacacgctgtcgggacagcgcgctcagcttgtggcggatcgggatgcggcggccgcgtctctcgccctggcaaagctggatctgcaccacacccgaattgtggctccctttgatggcgtcctcgggcggcgtgacattcaggtcggcagcctggtgggatccggaacagagatcatcacgatcgtgccgcgcgtccctgcctatgtcatcgcgaactacaaggagacccagctcaggaacgttcagcccggacaacccgtcgaagtcatcgtcgatgcccttcctgatcatcgtttccgtgggcgcgtcgagcagagttctccgatgagcggcaacgagtcgtcgatcgttccgacggacaacgcaacgggcaacttcacaaaggtggtgcagcgtatcccggtgcgcatagagcttgcccccggacaatccggtcttgatcgtctgcgcgccggcatgtcggtcgagacgcggatcgatacccaggacgctcgggtggccgcctattcccgtcagcggcctgagggggcggatcgggcccatgccgatgcccggcaatagatcactctccgtcggccggtttttcctcccggctcgtctcccgaacccggctctgacggtaacggccgttttcctcggggcctttctcacgaccttccagggacgcctgttctccatgtcgctcgcggatttgagagggcagttcggccttgatgtcatcgagagtgcctggctgagcacgacggcgaatgcggcccagctgctgacgatgcccgtcaccgtctggctgtccctgatcttcggaccggcgcgggtcatcatcgtcccgagcctgtgtctcgccctggcgacgttggtgatacccttcgtgcagggctacgaattgctccttgtcctgcatctcgtcatgggcctgtgcctgggcgtgtatctgccgctgacgatttcgttggcactgcggagcctgaagccgcaattctggctgctggcgatggcggtctacagcctgcgggtttccttcgggaccgatatcggggtgaagatctccgggatctatgtcgatgtgatcgactggcggtgggtctactggaccgcatcgatcgtcggcccgctgatcgcgttcacagcctggaaggcgctgccgatcccccctgtggaccgcggaaaactgcgggaaaccgattggggaggcatggccatgttctgcctgagcctggcgatgttgtttgccggctgctcgctcggtgaaaccctgggatggttcagctcggggatcgtgacagcctgcctgggggcgggcgccatcctgctcgccatctccgtcgccaacatcctcctcaacagggaggctttcgtcgatgtcacgccgctcgccaatcacaatgttcgcacggcactgctgatcgcctgtctctatgcggtgctgatggcaccgacctctcttctcgttccgaatttccttgccgcaatcggcaagctgaaacctctccagaccgggaccgcctccctgatggtatttgcgacctatctggtcctgacaccgacggcagtctggcttgccaggcgtgtggatgcccgccttcttctgatcgccggcctgactatcatcaccttcacttcggcctgctgcggggcgcatatcagcaacgagtggcgaacggatcagtatctgccggctctgatcctgttcgccgccggtgaatgcctgacgctgatggggctcattccgatcatcgtcgtcaacatgaacccactgcacgcagtcgccatcggattttatgcccccctggcacggctttttgcaccgggcatcgcgagtggtctgatgtctgcggccttgcggatttccgcagatacccacggggccatgttgaaagcgggtgtggaaaccggagaccccgccgtgctccagcgcgcggccctggggagcatctccaacatcgccctgatcataaaccgggaagcgaccgtgctatcctatatcgatggcttttatctcgtcttctgggtcggaattcttgccttgctgttgtctgcgaccttgaagactgcaccggtcaacccactgacgccaccgagatccaattgaggtgtgtttatgagtatgccggcccctccctctcatgactatccggatacgattgcgcgccccgtcctcggcctgaaaatcgaactcgcctttgccggcgaaacggagccccacaagcaccgcaaggaccagttgctgtatgtcattgaaggcctcatcacggttgaggctgccgatggtgtgtggaccgtcccgccgcaatgcgccatctggattccaagcggcgtcccccatttcgcccgggcgaccggtcaggtatcgatcggcaatctgtatgtcgagcccgaccagagccgcagtcagcggtcggattgcgggatcctgttcgttcagcccctcctgcgcgaattgatcctgcgtttcgtcaatgaaccgtacagaggcccggagggagatatccgggagatgcggctggcatcggtccttatggatgaactcgaaagagcgccggtggagccgctgcgccttcccatacctacagaccggagattgaagcggctggtggagacgctgatcggcgatccgtcactcaggctcaatctggaagaatggggtgcgcgcgtcggcgcgagcaatcgcacgctgacgaggctgttccagcgtgagaccggcatgtcattcggccggtggcggcagcagctgcatgtcggtctggccctccagaggctggcggatggcgactcggtgacgacgatcgccatcgacctcggctatgagagtccaagcgcgttcatcgccatgttccgacggatgctcggcacgaccccggcccgctatctgacggtgacggcgacggacacgagcggcggtcgcaaagaggatgtcatccacatctgcggcgaccgatgccctcacaacaagaagcgacctgcgagcaatgtcgtgccgctttcacgcacccgaagcaccggttgaagctggtatgctgtcccgcccggtgccggtttccagagccttgccgccgccgcagcgggtctcaggccatcaggcgagcttggtcagatgcgcatccatcagcttccacagcgggtccgccgcctcgatcgggcccatatggccgcaggggtcgagcagttcgaagcgggcgccggggatggcggcggcgatggcgcggccggcttcggggggtgatccgacatcctgggcgcccgaggcgaccagcgtcggcaccttcacacccggcagtttcgcccccatcgccagccccttgatggcatgggcggccgcgataaaaccctcgggcggggtggtgcggatgatggcggccacctgatccagcgccgagggggcgagatcgcggaaagccggggtgaaccagcgctccagcgtggcatcgacctggccgtccatgccctggtcgcgcacggccgcgatgcgggcgtcccacatcgcctgtgcctcgtccggcacgtcggacacggtgcagaccagggtcaggctgcgcagccaggccgggttgcgcacacccagcacctgcccgatcatgccgccgatcgacaccccggcgaaatcggcccgggtgatgcccagcgccgcgaccacctgctcgacatcatcggccagccgatcgagggtctggggggtttcggtggtggatgcgcgcacgccgctcatgccatgaccggcgatgtcgatggcgacgatccgccggctggcgcgcatcggtgcggccaccagatcccagaccgtatggtcgactgccaatgcatggaccagcaccagggccgggccttcggggttccccgactgctcgacggcgatctccacgccatcatccatggcgatgttctgcatcatgggggccgttctccgacggttcagatcatctcatgattgcatgatccggcgccgggcgtcgagcccgccctgcatcaccgcatgcagcacgaagatcccctgccttgacgcccgtcaccggctgcgccacataagcggaattgccggatccgggcccctctggcgatcgaggcgtcggtcgtgatgtcggatccctcacccatttcgcgctaggacgcagcgcaaccgcgatcgaggggtgatcgcgtgttccccgaaacatcatcaatcctgccggcggagatcgtctccgcggcaagcctcagcatggcgggacatccgctgtggcagtggggcctgttcgtcgccctggtcgcaggtctgctcgccttcgacctgggcgtcctcaacaagcgcgaccgcgagatcggcgtgcgccagagcctggtgctctcaaccttctacatcgccgccggtctgggcttcggcggcttcgtctggtggtcgtcgggcggcacggccgccatggaatacgccacgggcttcatgctcgaaaagacgctcgcgatggacaatgtcttcgtcatcgcgaccatcttcgcggcgcttgccatcccccggcatctgcaacaccgggtgctgttctggggcatcctgggcgcgatcgtgctcagggccttcatgatcggcatcggcgcggcgctggtgcatgaattccactggatcctgctcttcttcggcgccttcctgatctggggcggcatcaagatgctcaaggatggcggcgacccgccggacttcacccagggcatcttcatgcggctgctgaaaaaggcgatgccggtgacgccccagctgcacggccacgacttcaccgcgcgactgcccgacgacaagggccgtctccggcgtcatgcgacgccgctgctggtggccctgctgctgatcgagacggcggatgtcgtcttcgcggtggacagcgtgccggcgatcttcgccgtcaccaccgatccgttcatcgtctataccagcaacatcttcgcgatcctgggcctgcgcgcgctctatttcgcgctcgccgccatgatccaccgcttccacgatctcaaatacgcgctgtcgatcatcctggtgttcatcggcgctaagatcttctggacccagttcatcggcaagccgccggcggagctgtcgctgatcgtcaccttcgccctgatcgtcggcggcatcgcggtctcgatggtccgcagtcgcggcgcagggcgggcacagaagcccagcccgcaacgctagccgtcttcaaccctgatccgtctgcggcctcgccgccgcagacggctggggcttcggctctggccgcggcttcatcggatcgatccggccctgcagggccggcaccagcggcgccggatcgaccgcgacctctttccagaacacgccccaatgcagatgcgggcccgtggcccggccggtcatcccgacccggccgatggcatcgcccgccttgaccagctggccgggcgcgatcagcgtctcggacagatgcgcgaagatcgaggtcacgccctggccgtgatcgatcatgatcgtgccgccggtgtaccagagatccggcatcaccagcaccaccctgccacccgccggcgccagcaccggcgtgccctcgggcgccgccaggtcgagcccgcgatgggggctgcgcggcgtgccgttcaacaccctctggctgccgaacacgcccgaaatccgcccctcgaccggcaggcggaagcccttggtcgcgatctcgaagccgatgatgccgtcatccgatgcggcacgggcattcaggatcagctcgcgctcgtgacgcaaccggtcctgaagctcgggatccggcgtcaccttgggcggcggcaggccgtcgatccgctcgatcgcccagtcccgcgcggccaccgtcacccgccgctccagcgtggcgccatggggcgcgcgggcgaccagatcggccgtggcggcatcccgcccgatgccgaagacgaagcggccggcatcgtcgacccgggccggcacgccgtcgaccgtcacctgccagcccttgggcacccgcccgagattgagactgccctggcttgccggcccctcgatccggatcgccggtgcttcggccgtggggggatcctggagcggtgccggcattgcgggcggctggccagcattggtctggccaggatccgaggcccgggtctgggccggtgcgatgccccccagcatcagcagtaccggcagcgcacaggccgtgccacgcagaagaagggagttcaggggcatgagggagaaccctttccgtcgacgatcctgcccaaaggcttgcgggctgcgggtgcgcattcagaagaggtcgggctgggctgccgggccgcggctgcggccgcgccggcgcggggctgcggggcccgcctcgggcggcggcggcacgccgccctctcccgatgcctgcacatccacccgtccgtcggcgaagaccagggccagggcctggccggggctgaccgccgccgcccgggtgaccggctgaccggtaccgccggtcgcgtccaccgtctcgaccagcgcgaaaccgcgcgcgagtgcccggcggtaggaatagctttccagcagcgcgccctgcgcctccagccgctctgccagccgctgcagcttcagccgggggccggtatccaggcgggcgcccagcccgtccagccgctcgcggccgagccggccgacccggatggccgccccgggcgaaagccccgccgccacccggtccagccgggcccgggcgcggtcctgaacccggcccatcacggcctccagccgctgccctgtcaggtccagccggccggccgcctcggcgaaacgctcgcccgggctcttcagccgggccgacaactcgcgcacgcgggccgcgcggcgctccagaacccggtcgatgccggcatccagccgctcggcccgatcatccaggcgctgggtggcggcatcgatcaggctctgcggcctgggcaggccgcgggcaaggccggcggtgcgttcgctgccgcgctcgatcagccggaaggcggcagcgggcaggcgggcacccagatcgcccagttccagcagcagttcgcccagcaccggcaccgccttctcggcggcggcggtcggcgtgggcgcgcgcagatcggctacgaaatcgatcagcgtggtgtcggtctcgtgccccaccgccgaaatcagcgggatcgtgcaatcggctgcggcacggaccacgctctcctcgttgaaggccatcagatcctcaatgctgccgccaccgcgggcgacgatcagcagatcggggcgcggcacccggtcgcccgggcccagggcatcgaaaccgcggatggccgcggccacctgctcggcggcgcccagcccctgaaccatcaccggccagaggatcacccgacgcgggaagcgatcggccaggcggtgaagaatgtcgcggatcacggcaccggtcggcgaggtgatcacgccgatcacctcgggcaggaagggcagcggctgtttgcggccggcatcgaacaggccttcggcggcaagccggcggcggcgctcttcgatcagcgccatcagcgcgccggcgccggcgggctccatctgctccaccaccagctggtatttggaccggcccggataggtggtcagccgcccggtcgccaccacctccagcccgtcttcgggcttgaagcccagccgcatggcggccccccgccagaccaccgcgtcgatcagcgcgtcctcgtccttcagggccagatagcaatggccggacgcggcccgcttgaaaccgctgatctcgcccctgacccggacggcggcgaagcggctttcgaccgtgcgcttcagttcgcccgaaatctcgctcacggtatagaccggcaggttgtggccgcccgtggccgtctctgcgcccggatcacgctggcggaaggggcggtcggtatcgaagggcaggcggctcaaggcatcggctccggatcggactgcgggacggggcatggcaggcgcggtcgcgggtggggtttctcccggacgggtgccatgatagaagcatggtgcccgaagacgggcaacccggggcggttgtgcaccgtcggcggtatgaccgcgccgggggaccagaatcgattgaatcaggccgacgggagcgtgcgatgaaggttctgctgatcggatcgggcggtcgggagcatgcactggcgcgtgcgctcgaagccagtgcctccgtgtcttatctgtgtgccgcccccggtaatgccggtattgccgagcatgccgagcttctggacctcgatcccgccgacatggacggcattgccgccttcgcgaaggcagaaggcatcggcctggtggtgatcggtcccgaggccccgctggtcgcgggcctggccgatgtgctggaagcggccggcgtgccggccttcggcccctcggccgccgccgcgcgtctggaaggctccaagggcttcaccaaggacatctgcgcccgctacggcattcccaccgccgcctatgcccgtttcaccgatgccggggcggccaaggcctatatccgcgcacagggcgcgccgatcgtggtcaaggccgacggtctggcggccggcaagggcgtggtggtggcgatgaccgaggccgaggcactggaggccgtggacgagatgctgggcggccgcttcggcagcgccggcgcttcgctggtgatcgaagaattcatggagggcgaggaggcgagcctgttcgcactctcggacggcaccaccgccatcctgctcggcaccgcccaggaccacaagcgcgtgggcgacggcgataccggccccaataccggcggcatgggcgcctattccccggccccctgcatgacgcccgagatcaccggccgcgcgatgaccgagatcgttcagcgcaccgtcgacgccatggcggccgagggaacgcccttcgtcggcgtgctctatgccgggctgatgctgaccaaagacgggccgaagctggtcgaatacaatgtccgcttcggtgaccccgaaacccaggttctgctgccgcggctctggggggatcttgcccagatcctgctggccgcccgcgacggccggctcgacccgtcgatgatcgagcttgatccgcgcaccgccctgaccgtggtgctggccgcaaagggctatcccggcgactatgccaagggcgatgagattcgcggcctcgacgctgcccgtgcggccgccccggaggtgatcgtgttccacgccggcacgaagaccgacgatgcgggccgcctgctttccaatggcgggcgcgtgctcgcggtcacggccctgggcgacggcccggcggaggcacagagccgcgcctatactgcggtcgatgcgatcgactggccgggcgggttctgccgccgcgatatcggctggcgggcggtcggctgaaccgatccccgacgcgagacgacgacaaagaacaggacggctatgaagaaaccggcacggcccgccgcagcaccacggtgatccggttgttgcgcgggtctgcccgctgatcgggcaccagcatggtcgactgaccacgtcccgacacttcttcgacgcgcgccaccggcacacccgcatcggtcagcaccttctgggccgcgatcgcccgctcggcggtcaatgcccaggcatcgggccgggtgccgggctcgccacccagataggcgcgcacggcgatctggttgggtgaggcccggaccgtggtcgccgccagcgccagcaggcgccgcgccgccggatagggctcggcgccgccggaggggaagaccggctcgtcttcccgatccatgatgttgatctccagcccctcgtcggtcacgcgcagggtgaggttgcccgacagttcgcgggtggaggggtcggaggaaatcgccttgagcagccggtcggcggtatcctcgaacgaccggcgctcggccgcgccacgggcggcgatgtcgcgctccctggcccggtcgcgggcctcgaccatgcgctgggcggcatcctgcaccgcctgttcgaaggtctgcatggtcttgggcgcctcgagccgctcgcccgagagcacccggcgcatggcctcggccgggtcgttcaccggcagctcttcgggtggcgcctcgtcggccggattggcggccgggcgcttggccatatcgggctgcagatccatcggcgagggcggcggggtcaggtcggatcgttcgaaggacggcatgctgacaccgccctggccgacattgatgtcgggcgtgcccgactgcatgggcatggtgtgcgaggcgccggcatcgcggaacacggtccaggtcggcgtgaaatagtcggcgatgcccttgagcttcttttcgtccagcgcgttcagcagccagagcagcaggaagaaggccatcatcgcggtcacgaagtcggcataggccaccttccaggcaccgccgtgatggccgccgcccttgcccttcttgaccttcttgatgatcgtcgcgtggccgccgtcctccgccatcgatcagcttcccttggccttgttgatcgccgcctccgcctcggcgaaggtcggctgcatgctggagggaatgttggcgcggccgacctcgatcgccacctgcagcgcattcttcgacagcgtcgagacgaagacgtcgcggatcagcttgtagaaccgggcatcggcctcgttgatctgcttgatgcgcccggccagcgggccgaccatgccatagcccaggaagatgccgaggaaggtaccgaccagcgcgctcgcgatcagcccgcccagcaccgccggcggcttgtcgatcgaggacatggtcttcaccacgcccagcactgccgccacgataccataggccggcagaccgtcggccacaccctggagcgcatgggacggctccatgtgttcctcttcgaccttctcgagcagattttcgagataggcctccacctgatgcggatcttcatggcgcatgctcatgttgcggagcgtgtcgcagatcatgttgatcgcaagatggtcgttcaggattttcggatacttcttgaacagcgcgctgtttttcgggtcctcaaaatcgttgaacttggtcccttcgcgctgacgcttgtagagcgcgatgtacatcaggctgatcaggtcaatatagtcctgcttcttccacttggcgcccttgaacgccttaccgagcccgcccagcgtgtgcttgatcacctcgccactgttgccggtgacgaaggcaccgagcgcgatgccgccgatgatcatgccctcgatcggcagggcctccagaatcacctcgatatggccgccggcgatgatgaacccgccgaaaaccaggacgagggtgaggatgatgccgataatcggacccatggggcgaaggctcctgctgcaacgcggtaggctctggctggagagaggttatctcaggcttttgaagaaaaccttaagcaagtcggccgccgcggtttccccgatcccggcgaagatttcgggccggtgatggcaggtcggatgggcgaagacgcgggcgccgtggtccacgccgccgcccttgggatccgctgccccataatataggcggcggatccgggcgaaggagatcgcctgcgcacacatggcgcaaggctccagcgttacccagagatccagcccggtcaggcgcgggttgccgatcagggacgcggcctggcggatcgccagaatttcggcatgggcggtgggatcgtggtcggcttcggtgcggttgccggccgcggccaggatgacccgccggaccggatcgaccaccaccgcgcccaccggaacctccccccgtgccgccgcggcgcgtgcctgttcaagcgccgcctccatgggacgaagcggctgggacggatacggaacgggcatcgggacgtggttcggcatggcagccaagcgaagcctgcatggggtttcacgtcaagcggcccttgcatcctgacgcgggaagccccatgaattgcgcccatgggtacatccgcttccgcataccgcccgctcgtcggcgtcaccctcgacgtcgaacagcccggcggctattcgaggttcccgtggtacgcgcttcgtgtgaattacatggatgcgatcgtcaccgcgggcggcctgccggtggcgttgccccatgaaccggagctggcggccgaactggtcggccggctggacgcgctggtggtgaccggcggtgcgttcgacgtggacccggccctgttcggtgccgggatgcggcatgccacggtcacgaccaaggaccggcgcacggctttcgagctgggcgtggttcgtgccgcgctggaccgggatatgccggtgctgggcatctgcgggggcgagcaattgctcaacgtcgcgctcggcggtaccctggtgcagcacatccccgacgcctttcccgaggcgctggcccacgagcagccgaacccgcgcaacgagccggggcacgaggtcctgatcgaccccgataccctgctctcgcgtctggtcggcacggcccggatgactgtgaacagcgcccatcaccaggcggtggaccggatcgcgcccggcgcggtgcgcaatgccgcggcccccgacggggtgatcgaggggctggaacatcccggcttccgcttctgtctgggtgtgcagtggcaccccgaattcctgatcgatgccggcgatcgcctgatttttgacggccttgtcgccgccgccctggagaccagatgacccgcagccttccgaccgagccggaccgcgcgcgtgagcgcgtcgcccgggccatcgcccgtgcgggcctgtgttcccgccgcgacgccgagcgtctgatcctcgacggccgggtggcggtcaatggccgccgcatcgacagccccgcactggacgtgacgcccgccgaccgggtgaccgtcgacggccggcccctgccagcgcgcgagccggtgcggctgttcctctatcacaagccgcgcgggctgatcacgaccaaccatgatcccgaaggccgggaaaccgtcttcgaccgcctgccggcagatcttccccgcgtggtgagcgtggggcgcctcgactacaactctgaagggctcctgctcctcaccaacgacggcgaactcgcccgtcgtctcgagagccccgaaaccgcctggcgccgccgttatcgggtgcgtgtctacggcacgcccgacgccgatgcgatcggacggctggcccagggtatgaccgtcgaaggtgtccgttacggcccgatcgaagtggagatcgagcacgagggcacgaatgcgtggctttcggtggtgttgaccgaaggcaagaatcgcgaaatcagacgggtcctcgaaagcctcggacacccggtcagccggctgatccgtgttgcctatggaccgttccagatcggccgcatgcaccctggagaggtgcgcgaggtgaccgcccgcatgctgaaagaccaattgggctcactcgccgaaggccttcatctgcccgagaccgggcgtgacgccccgctccggcgccaggccgccaagaccggcgcgcctgcaccagaaatgatcgacaagatgaccgacgagaccaagaaggtcgagaagaccgggcctgccgcggacgagaccgccgccgccgcccctgccgccgcccaggccacgcgccccgcggccgacgagattccggacgcccgcttcatcgaggacgaggaccttgagggcgaggacgatttcgacggtgaggaagagttcgaggacgacgcgttcgaagaggaactcgacgagatcgaggtcgagacgcttgaggatctcgaagccctgatcgcccgggccgaagagctgaccgaaggcgacgacgaggccgaagatttcgacgacgacgaagacgaggatgaggacggcgacgacgaggatgacgacgagctgctgacgctcgcgcgccctgtcgatgccccccaggccccgtcgtcgcgtgccatccaggacaagcgccgtcagcgcgagttccacaacaccgatcgcccgacccgtggcctgcatgtcgccggcgaccggcgtgacgatcgtcgcgacgaccgccgtgacgatcgccgcgaaggctggagcccgctgaacgacgagcaggacgaagaggtcgatgccgccatcgccgagcagcgcgcccgcgaggccggccgtggcgaccgccgcggcttcggcggcggccggcgcgaattcggtgaccgcgacgaccgcggcggtgatcgcggcggcttccgtggccgcgacgaccgtggcggcgatcgtggcggcttcggtggcggcgagcggcgcttcggcggcaatcgcgacgatcgtggcggccgcggcggtgaccgcggcggcttcggcagtggcgagcggcgcttcggcggcaatcgtgacgaccgtggcggcgatcgtggcggtcgcagcttcggcggcgaccggcccttcggcgcgccccgcgggcgtcgtcccgagggcgagagcggcggcgaggactgatcggccatgccgcggatcgtcggcggccgccatcgcggccgcacgcttcaggctcccgaaggtcgggcggtcatccgcccgacctccgagcgtgcccgtgaagccctgttcgacatcctcggccatcgcgacctgagaggggatggcgaggcggcggtccgtgaccgccacgtcgccgatctctgctgcggcatcggcgcgctggggctggaagccctgtcgcgcggtgccgcctcggccgtgttcatcgaccgcgaccgcgcctccctcgccatcgcccgggccaatgccgcgaagctcggcgaggagcgcaactgtcgcttcgccgcggccgatctcggccgcccagagaccgtggcggcggcgctgcgcagcgaccggcccttcgatctgatcctgctcgacccgccctacgacgcccccgcagtggccgaggccatccttgccgggctcgtccgttcaggccgactcgccagcccggcactcgtcaccgtggagctggcccgcggcacggacatcgtgctgcccgaggcgcttcgtgttctcgaccggcgccgttacggcaaggccgaccttctgatccttggccacgcggtcgcggacgagggtgacgatgccgaccatatcggcaccgcagattgatcgccccagaaaagcccctcgcctgacgggactgcatcatgaagagtggacgggccggccctgaccggtgcccccgccccctctcttcccggatgccgccgatgatgcttcgtgcccttgccgttgcccttctgctagccctgccccttgccgcctgtaatgaagacggcagcagcaccggcagcgatgacagcgcccagaccggcatgggccgcatggtcgccacggcaccgatgtcgaccgagatccagtcggcaggcgccgcgccggagccgatggcggttggccagatggcggccccccccatggcggaggctcttcagccggacgccgccggcttcctggcctatacccatgaccgcaacctgataaccgaggccccggacagccgcgtcgccgcgctggaaaagctctgccgcgagatggcaggctgcagcgtgctgacggtgcgtgtcgacggcagcagatccggctatttcgaggcccgtctgcccaagccgggcgtcgcccggctggacgactatctctcgagcattgccgaaaacggcgagatcgaccgccagaccagcgccgaagacctgtcggatcagatggtcgacgtgaagcagcgcatcgccctgctgaccacccatcgcgaccggctgcaggcactctatcagcgcagtgatgcccggctggaagacctgatcaccatcagccgcgaactggccgacacccagaccaggctcgagcgcgccgagggggagttcggccgcctggagagccggatcgatcgcgacatctatcgcgcccaactgcgggcaccggtgacggaaccgggcctcctcgcccccttcggcaatctgggcgaagacctgctctactcgctgctctacacgcttcgcgatgcgctggatgtgctggtctggatcatcggcatgctgcctgccctgatcccgctggtcctgctgctgaccctggccgtgcgcgccatccgccgccgccggaagggttgacaccgcccgagggggtgacaccgccggaaggggccgggaccgggtcaggcgccggcccggcccgcccggcagatcgcagcgcaaagatcctcgaccagatcttcggcatcctccagccctgcataaagccggaggccggctccctcggccggtggccgcgataccgtccgcccctcgccggcggtgaagggcgagaccagcgagaccgcgccgccccagccgtaacccggccggaacagggtcagcccccggccgatggccgcggcgtcggccgggccgcccccgtcgaccaccagcgagaacagcgtcccggcaccggtgaagtcgcgggcccagacatcatggccgggatggtcgggcatggctggatgcagcaggcagagaccgcgcacgttcagcgccgccaccgccgccagcaggcggcgggtggtgcggtcctgggcagccaggcgcacggccagcgtctgcatggccaccgccgccttctgggtggcatcggctgagacggccatgccctgcagggctgtctcttccagcacgtcctcgtagagcgcccgatccccggtcgagatcgcgccgagcgacacgccggccaccccggcatgcagcttggccagagactgcagcaccagatcggcaccgtgatcggccggccggtaatgcagcccggcgctccaggtgtcgtcgaccagcaggcgggcgccggccgcatgggtggcctcggccacagccgccaggtcctcgacctcgaaggtgaaggcccccggcgtttcgacgcagaccagccgggtgtcggggcggagcacatcgcggataccggcgccgatccccggcgggaagtagtcgatgccgatgcccgccgcagccgcccgccggtccagatgccagcgcagcgaataggtgacggcatccgtgaccgccacccgctcccccggtttcaccgacgcccagagcgccgcgatgaaggccgaaagcccggccggcgcgatcaccgcatgggccagaccattggccgccgccaccatccgcgccagcgcccctgacgagggcgtgccgaccgcgccgtaatagaagccggcgaagggatcatggccctggcgcgccaggctctcccggtcgaccggcgccatggcatccaggtcgcggaacagcaccgtggtcgcctcggtcaccggcggcaccggcgtttccacgggtcccagcggaaagcgcgcgccctgcgccagcgtcgtcgccgggcgggtcggtcgctgcccgctcacgaggccagcctgccgccgaggggccggccgcgcacggcatcggcagcggcgacgacctccgccacctcggccagacgcggcgcccccacctgcggcagcggatagcgcagcgaggcctcgccgaaattgtggaacaggtccagataggggccttcaggcgtcccccagtcgacatagtcgtagccggccccgccatcctcgccacacagcggatgctggaccgcccagttcaggctgatcgggtcgggcgcgccatggctcaggcggaaacggtcgagggtgtcgagcagggccaggcggctttcatggcgctcgcccaggccgaacagcacggcacagccgcaatcgatgccggcctctcccagcacgtcgaaggcgcggtgcatgcgatcggtccacgaggcccgcttgcggccgacatccttgctcatgcccccgatctcctctggcgacagggtctcgaccccgatgaacacataggataggccggcacgggccaggcgcgccacctcggcgggccgggtcaggatctggtcgatggtcagttgcccgccgaagcggatgtcgagcggctggcggtccatcaggtcgcagaaccggtcgatcagccgggtggcaccgcccagcagcaccgaatcctcgcagaatgcgctggcccggcggcccggccagtcctcggcaatcgtccggcaggcagcggcgagctggccgtgcagccggtcggcgctgttggcaaggtcgcgcaccccgccggtcgccgacacccgctccgagcagaaattgcagtcgtagacgcagccgcggccgatatcgctgaagacatgtgcggtcatgcgcccgccgaacacgccgaaactggccgagaccccgaaggtccgggccgggctgggcagggccatctggttcatcgccaccccccgcgagaccagatagccggggcggccgcgatcatccaggccgaggatccagtcgcccggggttgccgggtcgatctcgtggaacagcgccgccggatgcaggctccggcggaccgccgcctccaccgcccgccccagagcggcgatcagatattcgccatcgcccatcgccacggcatcgaataccgccggcagccggccggcatggatcagctccagcggtgcgccggcatgccgcccgagcgtggccgcccgccggtcgctgcggtcgggcagccagaccgtctcgctggcatggcgcccgccgaggacgatcgccacccgatcccccagaatctcccgggcctcccgcgcgcaggccacggcgcccggcagacagagcgacatggcgccgatcagcagcaggttcgggcgctgccgctcgatcaatgcccggaaggcgggcatgtcgtccatggaatacatcagcagggtcgaggcccgggcggcagcacgggccgcgcggggatcggccgccgcccagttggaagcgccccaggcgccacggcccgccgctgcttcggccgcggcgacccggcaggcattgtagaggctcgccgcatcgcggctattgagcgcacgatcatccttcgcacccgccacccaatcgggagcggagacggcaacagccctcagcgtcatggtcgattcccggttcgatgaatgatggcgcaccccctgtaccggctccgggcgcggccacggatttttccgtatcccgcgacccgtacccgacagccccatggcaggggaaagccatgaagcccttcaggtagaaccagtcaagagacatgcaacccaaggagattatgcctgaaagacacacgctctggtcaaggtgtttgccattacaaaacgcgaaggttgcgatcttgtgcggacttttcttaatccaatatatcaaccaataattgatgatgtgccttaaggagctttcgcccggtgcgcttcgggatcaagaggcggcagggcgatccaggcgatgatggtggactgaaagatctggttgaaattgtcgtcgctgacgaggatcagcgtcttgcgtccgtcgcgcaggtcgggaccgaaggccatgccctcccagttatctgccggcaggccggccccgatcagatcggaaacaagccatttttgtgcggtcaccacatcggcatccagcggagcttcccgcgccaacaggtcttccgcctccgccggatctgcgagatacagacgcacgcgcaaccgatagccgaaccagaatccgcgttccagaaccagatatcgtccgtcgcccagcatcagaatggagacggcaccattgatctcggttccaccgctcattcccggctgctgcgggtccggctgcagctcaaggcgatagccatgttcagcaacctcgcgaccggtgcggcgatcatatgtggcgaccctcaggatcggccgatgaacggcacggcccggatactggtcctgtgcaagtgcaaactcactcagaaaggtgatctgccgcccgtcgggcgacaggtccagcccttcgatgcccttgttcggccggatgccacgccgctgaggcttgcccgcatccggcaaaaaatgtgccggcaagggcagctgtcggaccagttctccgtcgagcgtgctctcgtacagaccgggcggaacccgggattgcggccagccttccgaagaccagatcatgcgttccgtggacgggtcgtaacgcagggcctctccgtccacgacatcgggtttcgtgacctcatcggcggctgtcgccaccagccactgccagtcccgatcgaaaacccggaaccgattgctcttcagatcgaagcggatgtccaggcgcagcgcgcgcggcgggccccattcgcctcgatcgtcactgatggcaaggaagcggccgagaccggtatcgtcaaccggcgccatgacggcgatctccgacaggccacccaccggaatcccaagcggcccatcctctcgacggagcacgcgctgatcgagcagctccacgcccccggccgccgccgggtcggccgcagccgggatggcacaaccggcgaggaatggcagcgccatcaaagcgatcgacagacggaacaactgccgcagatgctccgccatcaccgccgcccgaacagccgctctatggcagttcggtcaagcgacacccaggtcggccggccatgattgcactggccggaatgtggcgtgatctccatctcgcgcagcagggcgttcatctcagggatggtcagccggcggccggcacgcacgctgccatggcaggccatggtcgcacagaccgcctccagccggtccgccagcgccagggcctcgtcatattcggcgatctcgtcgccgaggtcgcggacaagcccctgcgcatccacgcgccccagcagggccggcacgccacgaaccagcaccgccccgggcccgaaggcctcgatctcgagccccagccggccgagttcggccgcccgtcggagcaggccgtcggccaccgcttcgtccagctccaccacttcgggcagcagcagcccctgcgagggcacgccggcctcggccatatgccgcttcatccgctcatagaccagacgttcatgggcggcatgctggtcgaccacgaccaggccgtcgcgggtctcggccaggatataggtgtcgtgcagctgcgccagggccgcccccaaaggatgggcgcgggtcgcctcgtcggcgacatgatctgccggggccgccccgcgggcagcgggtggtgcgggaggggctacgccccgatcggcaagttcatgcggcagcgcgccttctccggccggcggtgcccaaaaggccgtcgcccgcgcggcggcctgggggtcgggacggtccggcaggacgccggccgccgcggcccgggccgccgaccagagcgagtcctgtcccgccccgacagcgcccggcatcggccggggtgccgcggccggcaggaccgcctgattgacggtgccgagcggccccaccccacccagggccccgaccccacccagagccgtcgccgcgcggtggccggcctcggccagggcgtggcgcagagcccctatgatcaggccacggacaagctgcgggtcgcggaaccgcacctcggccttggcgggatggacgttcacgtccaccagccgggccggcacggtcaggaacagggcgaccatcggatgccggtcgcgggccaggaaatcctgatacgcggcccgcaccaccccctgcatcagccggtcgcgcaccggccggccgttgacgaacagatactggtgctgcgccgtgccgcggttcagcgtcggcaggccggcatggccctccaggcgcagcaggtcgcgctcggcctcgatctccagcgcattggcggcaaaatcccgccccatgatccggccgagccgggcgaggcgcgcctcggcaccggttcccgtctcgggccggaaggcgaagatccggcgctcgccgtcggccagcgaaaagccgatctcgggataggccatggccaggcggcggagcgcatcggccacagcctgggtctcggtgcgttccgccttcaggaatttgagccgggccggcgtggcatagaacaggtcgcggacctcgacccgggtgcctggcgggccggatgccggcttcaccggtgcccttatgccgccctcgaccacaatttcaagcgccgtatccgccccgcgccgacggctggtgatgcgcagccgcgccaccgcgccgatcgagggcaaggcctcgccacggaaacccagcgtgtcgatctcgaccagatcgtcatcggcgagcttcgaggttgcatggcgctcgatggcgagttccagatcatcggcatccatgccgatgccgtcatcggtgacggcgatcaggctgcgcccgccggcccccagcaccacatcgacctgccgggcaccggcatcgatcgcattctcgaccagttccttcaccgccgccgccggccgctccaccacctcgccggcggcgatgcggttgaccagggtttcgggcaggcggcggatccgggacatcgggcgacgatacctcagccggcggcggccaggtattcgcgggtcaggatcttgcccttctcaaccgcaggctgatcaaagggatccaccgccagcagatcggccagaaggatggtttcgatcatcgccgtcatcatcagcgcgccgatcgtccgtccgtcgaccgcatccagcttcatccggatggtcgggcggccttcggcgatcaggctctcggccgtggcccgggcctcggccgcgatcagatcgcccaggctgcggccggcgagatagggaacgccatagcgcgtcgccgcctcgggcgtgatccgccaggccggctgctgctccgccggcggctcgatcaccgtcaccagcttgtcgcgcggaccgtcgagatagagctgcagctggctgtgctggtcggtcgccccgcgcgcgaagaccggcgccagaccaatgccctgcttgccgaggctttcccccaccagctgccgccaccactcgccgaagcgggccagccggtcgacatagccgaactgcaccgcctgcgagacgcccttgtgctgcatcagcgccgccgtcgccgcagcccccatcgccgccgggatctccgccggatcactcccggcaaaggcctggtcgagaaccgccgcagcgccctcgcggatggccaccgcatccacgccgcccagcatggccggcagcaggccgaccagcgacagcaccgagaaccggccgccgacattcgggtcgtgatcgaaggtctcgacgccgtagtcgttggcgatccggcgcagcggcgagttgccgggctccgccaccaccaccagccgcgcggccgtcgcatcccggccgagcgaggcttccatgcggtccaggaccagaagcagctgcgccaccgtctcgaccgtcccgccggatttcgacacggccagcacccgcgtcccggcccaatccaggccgtccaccagccggcggaagctcaccggatcgacattgtcgggggtgtgaatgcgcggtccgcgatcctcgggatcgcgcagctccagcagcgcctgtgcgcccaggctggagccgccgatgcccagcaccagcacatccgacgcctcgtcgcgccagcgcagcaccagcggctccagagccgccagatcgtcgcgggcggccggcaggcgcagcaggggcagggttccgtcggcctgacagccacgcagacgcgccagtgccgaccgggtctggtcgagcagcgccccacattccgccccggtatcggcgaggcatccggagaaatcgatcgagaacggcagagtcttggccatgatgctgatgctttgtccttgttgggacgtcactgggtgctgtcgggcgcggtgcttcgggcaccattttccgaaatccgggcggcggcgggagcggcggatccggccccgtctgccggctgcccgaccatcaccaccgacagcttgtcggtatcgagcagccgcttcgccacccgtttgacgtcgtcggccgttaccgcctcaatcaggctgctccgatcgtcgagatagccgggcggcagattgtggatctgcatcgtgaccagcagcccggccacagcaccactgccgtcgagcgacagcgggaaggatccggtgaggtacttcttggcgccggcgagttctgcctcggtcggccccccttcggcgaaacgggcgatctgatcgcggatgacctgaaccgtctcccgcgcccggtcgttgcgggtggcggcatagccatagagcaggccggcccggtcgagcggatagagcgtggtgccgacactgtaggcaagcccgcgcgtctcgcggacttcccggaacagccgcgccgtgaaggtaccgccgcccagaatgtggttcatcacgaaggccgggaaccagtcgggatcgctgcgcagaatgcccggcagggcgaaggtgatgacggtctgcgggatcggccggtcgaccaccgtctcgccgaagaagctgggcgaaaccggatcggtcttcggccggctgtcgcccgcaggcaggcctgcgaaggccagatccaccacccgcccggccgcctcgggcgtgatgtcgcccaccacccccagagtcagccggttgcgggtgaactgacgggagacgtaggccaccagatcctcgtgggtgagggctgccacggtctcgcgggtgccgtcggtgtcacggccgtatgaatcggtcggaaacagcccggcgagcaggctgcgcgaggcgatcgcctgcgggttttcggccgagcgtgccagcgagaccagcagctgcctgcggtcgcgctcgatatcgtcggcatcgaaccgcggcgcggtgagggccagcccgaccagcttcgcggcctcctccgcttcggtcgcaaggctgcggaagctgcccgagaaggcatcacgatcgacaccggtcgagaattccaccgcacgtgcggccagcgcatcctggaaggccggaccatccatgtcgcccgccccttcgaccagaaggcccgacgcgagcgtcgcggcgccggccttggccgccggttcgatccgggtaccacccgcaaaggcgaaatcgacggtgaccaccggaagctccgacacctgtaccagccagaaggggataccctgcgggctggtgagcgtgcggatgtcgagcgcgcgtgccgccggcaccggcccgatcaccaccagcagcaccagcgcggtcaggatggtgccgatcatacgcaggccgaggcgccgcacctcgtgaccaatcggcgacatgtgacgacggaaagacgacagggtggtgatcaatggacggtcccctcgctggagggcggggtcacggccgtggccgcaacggcgggtgcgggatcgtcgacacccagcccttcaggcagcagcacgccggtcgccgtgccctgatcgggccccatcaccgcccgcagggcttccatgccctgatcgccggtgatcgccgccacacgctgcggccaggtctcgatccgttccagcgtctcgccggtggcaagggccgcccccaccatattggcggtggacgacacgctgtcgcgggcatagacggcatcggccagcatccgggtgcgggcacgttccagcacgtcgggggcgacgccctgtttcaggatgtcggccagcgcgcggccgaccgccgcttcaagtctggtgatcgacacacccggcgccggggctgcatagaccatcagctggccttcgtcgcgcgcgccggcgtaataggccccggcctggacggcgacgccttcatccaccaccagccggcggtagagcggcgaggtcgagctgccgcccatggcgaaggtcatgaggtccagcgcctcttcgcggtcgcggccgaagacatcggcacggggcaccagccaggagcggcgccacgagggcgaggccacgccggcggcgtcctgcaccagccggcggtcgcccaccagcggcgccggcgccggacgcacgcgcttcgcctcgtcgaagccggcggtatccgggatccggccataggtctcggcggccaggcggaagacgtcttctgcccggacgtcgcctgcgaccacgacgatggcggcggaagggtggtaatgcgccttgtagaaggccaccgcatcatcgcggtccagcgtcttcagctcgtccggccaaccgatcaccggccggccataggggtggccggcatagaccatggcccgataggcctcgccgaaccgggtctggggatcgttgtcggtgcggctgcgacgctcctcgatcaccacctgcagttcggttttggtgtcttcgggccgaagcctcagcccggtcatccggtcggcttcgagccgcatgaccagatcgagccggtcggccgcgatgttctggtaataggcggtgtagtcgtaagaggtgaaggcgttgtcgcggccgccattctcggcgatcagccgcgagaattcatcgcccgaggtctgctcggtgcccttgaacatcagatgttccaggaaatgggcgatacccgagcggcgggccggctcgtccgccgcacccacccggtaccagaccatgtgcgaaaccaccggcatccgatggtcttcgaccaccacgacggtgagcccgttctccagcacccggctcttcgcgccgagcagaggcgtcgccgcctcggcggcggcagtggcggtcgctgcggcgatcgacggcgaggttgcggcaagggctggcgccgctgccagcaggaccggggcggccatcagggccgacgtcaccagcagcgatgcgaccagccgcccgggacgcaatccacgccgggcgggtgatggggacgcagacaagcgtcgtctcctcttcggttgaccggccgcgcggggcacatgcggccgcatcacaggatgggcctcgacggcggccggtgcaaccccgcccggatgacgacagcggctcgtgtcgctcagaagatgccttcaagcaggccgcggcgcttgcgctcgatgatcggcgtctcgccggtgtcgatcggccggccgaccgcctgattggtctgcaggcggcgctgctcggcaccggcatcgatcacggtgcccggctgctcgcgctcctgccagaacagcagatcgtcgacgaagctctcgctcgcctcggccagctgggtgttctcctgcgcgatggtcgcgcggatcgacggatccgcccggtcaccaccggtccgggccagcaccgcctggtcgagcggatcgatgccgttggccaccggtgccgcagccggcgccgtgccggtcagcgcctggcgcgccgtctgggcgggcgtcgcctcctgcgggcgcggcgcaccgggctctggcgggcgcagatcgtaattcggcggcagaacgagcggtgcgcgcggcacgacggcaaattcgtcgggcgcccgcttgttgaggcccagggtctcgcgcgccgaatcacaggcggccaggccgacgctcagaatggcgatcaccgacaacgcggtcaggcggctcatgcggtctgctccctcatcccgtccaagggcccgaagcccggggacagcgtccatgataggcgacaggaggcggatcttcgcccccctggtcaggtcttttccgggccggccggatcgcggccgaacaggccgtccaccaacagcaggatcacgccgagcgtgatgccggcatcggcgatgttgaaggcgggccagtgccagccggcatagtggacatccaggaagtccaccaccgcaccgatccggacccggtcgagcgcattgccgatggcgccgccggccacgaaacccagccccagcgccgtcagcggccgctcgcccttccaggcccagcggccgaggagaacggccaccaccgtcgccatcaccgccagcccccagcgggcaagctcgccatgctgggccaacataccgaaactgaccccgcgattgaacacgagtgtcaggttgaagaagaaggtgacgacgacgccgtcacccggcatgtcgaaggcggcgagcgccagctgcttggtgatctggtcggccaggaacaccagcaggaagcccacgaccagcatgcgccggctgcgggccctcgccgcctggtgccaggccgcctcggccaccgatccccgttcagccatgggccacggcatccgcacagcggtcgcacagctccggatgatcggcatgggtgccgacctcgggcaggaccttccagcaccgggcgcatttctcgccatctgcccggccgaccaccacggccacgcccggcacgtcgtccagccggaaggcatcggccggggcatcgccgccggtgagcgtggcgtcagaggtgatcgacagctcggccggatccagcccgtcgaagacatgggcatgttccggcgccagccagacggtcggatgcgcctcgaggctcgcccggatacgcttctcgcggcgctccacctcgatcgcgccggtgatcacccggcggatctgacggacccgccgccagcgatcggccagcgcgtcgttgcgccaggcgtcgtcggtgtcggggaagatccggcgatgcacgctctcgccctcgggcacctggccctcggggaagcgggcgagccaggcttcctcggccgtgaacaccaggatcggcgccgaccagacggtcagacgatcgaacagcaggtccatcacggtgcgggtcgcccggcggcggatgctgtcgggcgcgtcgcaatagagcacgtccttgcggacgtcgaaatagaaggccgacaggtcgacggcgcagaaattgtgcagcagcgtcgccatggtgtggaagtcataggccgcgatcgccttgcggatctggccgtccagctcccacagccggtgcaggatgaagcgctccagctcgggcatctcggccaggggcaggcgctcggcctcggtgaagccgtcgagcgcgcccagcagatagcggaaggtgttgcgcagccggcgataggcatcggcctgcgaggacaggatctccttggagatgcgcacatcctgcgaatagtcggccgacaccacccagagcctgaggatgtcggcgccgtactgttcgatcacctgctggggggcgatgacgttgccgaccgatttcgacatcttgcggccttcgccgtcgagcacgaaaccatgggtcagcaccgcttcatagggcgccgtgccgcgggtgccgcaggattcgagcagcgacgactggaaccagccgcgatgctgatccgagccttcgagatagagcgaggccggccacttcaggtcgttgcggccttcaagcgtgaaggaatgggtcgagccactgtcgaaccagacatccaggatgtcggtgacctgctcgtaatcctcggggttgcggcccttgccgaggaattcggccggatcgcgggtataccaggcctctgcgccctcttcggccaccgcgatcgccacccggtcgatgacctcgggatcgcgcagcggttcaccggtcttccggtccacgaacacggtgatcggcacaccccaggcgcgctgacgcgagaccagccagtcgggacgggtttccaccatcgagcggatgcggttgcgcccggtctcgggcacccagcgcacctgatcgatcgcggccagcgccttctcgcgcagccgggcatgctccatcgagatgaaccactggcgagtggcgcggaagatgaccggcgccttggaccgccaggaatgcggatagctgtggcgcagcctgccacgggcaagcagcgcgcccgccccggtcagctcgtcgcacatccggtcgtcgaccttgaagacatggtcgccggcgaagatcggcacctgatcggtataggtgccgtcctcggccaccgtgtccggcacctccagcccgaaggcacggcccagcaggaagtcttcctcgccatggccgggggcggtgtggacaaggccggtgccctgctcggtggtgacatggtcgcccggcagcagcggcacttcgaaatcatagccgcggccatggaagggatgggcgcagacggcgccttcgaaggcgctgcccttgaaggtggcgaccacctcatggccggtgatgccggcctcggccagcacctgagcggccagcgcctcagccagcaccagcacctcgcccatgcgggcgagcgagccgtcggcgatgccggtcacgcggatcgcgacatagtcgagatccgggccataggcgactgcgcggttgccggggatggtccagggggtggtggtccagatcaggaccgcggccccgtccagcgccggatgggtggccttcaccaccgggaagcgcacggtgatcgtggtcgaggtcttgtcgtgatattcgatctcggcctcggccagcgcggtcttttcgaccggcgaccacatcacggcctgggggccgcgatagagctgaccggaggtgaggaacttgcccagctcccgcacgatctgcgcctcggcgctgaaggtcatcgtgagatagggccgttcccagtcgccgaggacgcccaggcgcttgaactcttcgcgctgcacatcgatccagtggctcgcgaattcacggcattcgcggcggaactcgaccagcggcacttcgtccttgttccggcccttctcgcgatagcgcttctcgatctcccactcgatcggcagaccgtggcaatcccagccggggacgtagggtgcatcgcggccctgcatctgctggcagcggctgatcacgtccttcaggatcttgttcagcgcatggccgatatggagatggccgttcgcatagggcggcccgtcatggagcacgaagcgctcgcggtcccggccgtcttcgcgcaggcgtgcataaaggtcctggccggaccagcggtcgagcagaccgggttcgttggccggcaggttgccgcgcatggggaaacgggtctggggcaggaaaaccgaggctttgtagtccacgctcatcgaggtccggcccttccgggcttcaggttggtgacggggagacaccggccggcggaatgcacggccgatggcataagggcaggcacgcccgaacccgggcgggccgcatcatgccatggggcgaggctcatggatagcgccggtcggctgccctggcgagaagcgatcgcgcctgttcggcatcggcggcgatctgggccttcagggcctcgatcccgtcgaagcggcgctcgggacgaatgcgctcgatgaaggcgatctccacccgccggccgtaaagatcgccggcaaaatcgaagagatgcgcctcgagcagcaggtcgcgcttgtcgaaggtggggcggcggccgaaattggcaacaccgccgaaatggccgccgggcagcacctcgccaccgggaccgcggccgggtgcgacattcacccggatcgcatagacaccggtcgccggctcgacatagcggccgatcgcgacattggcggtgggaaaaccgatggtccgcccgcgccggtcgccgccgcgcacccggcccgacaccgaccagggccggccgagcaggcgggcggcacgcaccatgtcgcccccggtgatcgcggcgcggatggcggtggacgaaaagatcgtgtcgccatcggcgcgcggctccaccaccgacaggctgaagccatgggcctgggcggcggcttccagcatcttggcatcgccgccccggcccttgccgaagacgaaatcatggccgatggagagatgggcgacgcgcagcccgcgccacagcacccgctccacgaagtcttcggccggcatggcggccagcaggcggtcgaagcgcagcatgaacaccgcggcgatgccggcatcgtccagcacacgcagtttgtcggccggggtctgcagccggccgggcgcccgatcgggctgcagcacgctgcgggggtggggctcgaaggtgagcaccgccggccgggtgttgaggcggcgtgcggccgattccgcggcgccgatcaccgcctgatggccgcgatgcacaccgtcgaaattcccgagcgccacggcaagaccgcgtgcctcggggcccaaaccttcgaaacgtctgtagagccgcattccccgtccatgtgtccggccccgggcaggcggggcgatgggtcgcgcggaccgccgccgccccgcccgggccggcggatcagccggcggcagcgagtgcggccgcgcgggccggcaccatgaccttggtgatgccgtcgacgacgaccgtgccgcccaccaggcattcggtggcgagcgtcacgcgccggcgcgccggatcgatctcgttcacccggaccagtgccgtcaccgtgtcgccgatgcgcacgggcgcgcggtaccggaagctctggtcgaccaggatggcgccgggcccgggcagtctggttccgagaaccgcggaaatcaagctcgtggtgaaggcgccgtgggcgatacggcccttgaacggcgtcgtctgtgcgaagtcctcgtccagatggaccgggttgtgatcgcccgaaatgtcggcaaaggcccgcacatcggcgtcggtcacggtatgggagatcgtcgactccatgccgacggtcatgtcttcgaggctcaggccgctgatcgcggtcatgggaaccagacctttcgatactgcgcccggtcgcgcgcggccggacccgtcatgctctccacgagcccgcgggcgggccgcgggcgactgcattctcgtccggtggcagggcgatgccggccccggtcccttgttttatgtgcagtgcactataaaccgggccggcaggtggagcaagtggcacatggcgggcagaaatgggcactcgatacggatacaaccgccgaatgcccattcagagtatcatgatgtccataaatcgtgcctgacggtaatatccgtacaaacctatccgcgcttgctgaggaaatcgcggatatgggcctccacctcgtccggcgcctcatgggcgatccagtgggtggcatgctgcacacgctcaattctgagatccggcacccaggcctccagcccctcgatcagcccgggcacgagcgccgtatcgcccagcccccagatcaccagggtcggcaccctgaccgaatagaccgcgggatcgagcagcggctgctcgggcggggtcgtgcccgccggcaccacgtcgatgggcgaggcccggtaccagttcagcccgccggtcagccggccgggccggccccaggcctccagataggcggcacggtcttcgtcggtcatcagccccttgtcgtagaccgggcgcatcgagaaccgccacagccagtcgaaatcattggccgacagcttctcttcggcttcgggcgtgcggaacaggcggaaatactggctggcccggatctgctcgggattgcgcatcagctcgcgctggaaggtcgcgggatggggcgagttcaggatgatcagccggtggatgcggcccggatgggccatggcgaaggaccaggccgccgccccgccccagtcatgggcgaccaggatcaccttttccacccccagcgcatcgatcagccccaggatgtcgcccaccacccgcttcgtccggtaggcttccacctcggccggggcgtcgctctcgccgaagccgcgcagatcgggggccacgcagcgatactcgcctgcgaagcgggacatcatgcccttccaggcgtaccagaattccggaaagccgtgcaggaacagcatgaccggggcgtcggcccggccggcttcggcgacatgcagcgtgacctcgccgaccggaacgcggcgatgggtgatttcgaccatgcgggtcatcctccctggcgcggccgggccttgccggtccgcattcatacgtttgtttttatgcatgctagcgacatccgcccggcaccgccaccactcaggcggtggacatgggatggacagccgccaccggtcgccgtaaagctctggctgatcgccgttccacccctgcgcacaaggcccccgccccatgctcgcccttgccctcgcctttctggccggcctcgtgctcggccgcctgctccgcggccatcggacacgcatcgcccggccggtggaccggctgacgaccgtgtcgatcgtcgtgctgctggtgctgatgggcatcggcaccggcgccatgcccgatcttggcgccaccctcgccgcctcggggctgaaggcggtcacgatctcggccgccgcagtggcggggtcgatcctggtggcgctgctgctgctggggctgatcggccgcacccggcggaggccgctgccgtgatcatgaccctgatcatcctcggcgcctatgtcgccggcatcgccctcggtgccctcgcaccagctcttgcagaccagacatccgcggcgacccagccggcccttatgctgctggtcttcctggtcgggatcggcacggcactggatccgtcggcctgggcccggctgcgcagcgccggcccgcgcgcgatcgccgtgcctgtcgcggtgatcctgggcacgctcggcggtgcggcgctggtggcgccgctgctgccggggatgagcctgccggacgtgctggccgtcgcctcgggcttcggctggtacagcctctccgccgtgatgatcgccgaggcgcgcggcgaggtgatgggcgcgctggcgctgatggccaacatctcgcgcgaggtcatcaccctggtcttcgccgggctgatggtgcgcgccttcggcccgatggcgccggtcgcctcggccggtgccaccgccatggatgtctcgctcggcatcatcaccatccatggcgggcgggaggccgggctggtggccctggccagcggtttcgccgtcagcctggccacgccggttttcgtgggcttcttcctgtcgctctgacgcttcagtccggccccaccacgcccggcaccaccacaatcttgccgcccttgctccgagacagggtcgccgtcaacgcctcgcgggcctgatccagcggcatggccacaacccggggcggctccatctcgcccgctgccacacggcccataagggcaagccgcaccgcgcgcgcctcgtcggcatgggccgtcagatagtggcggatctccaccccgatcagggccgcactcttgagcaggggcagattgaccggcagggccgggatcgcgccgccgacgaagcccaggatcagatgccgcccttccttgtcgagcgagcggaacaggggctcgaagccggggccggcgacagggtcgaacacgatatcgatcgcgccgcccggcagggtctcgcggatccgggcccggatgtcggggtcgagcgacgatatggccgcagccgcgcccagcgcgatcgcccgcgcccgtccctcttcggtgctggcgagcgccacgacatgggcgccggcccgcgccgccagttgcaccgccgcagacccgaccccgcccgacgccccggtcaccagcacccgctcccccggcatcaggcctccgcgcgggaacaggccgtaggccgccgtctgatagtcgaccagcatggccgccgcatggagccccgacagcccgtcgggcaccggatcggcctcgtcctccgccaccacgacatgggtggcgaggccgccgcccatctgccaggtcaccacccggtcgcccggcacataccgggtgacgccggggcccgtcgcatcgacgatgccggcgatttcgccgcccggcacatagggcaggtcggggcggatctgatagcggccatggacgatcagcccgtcgacatagccgagggcggcggcctctgtccgcagccgcatctgcccgggccccggctcgggcatcggtcgctcgaccagggtgaaatcctcgacgcggcccagggccgtaccttcccagcgcagcatgcgtgttccttcccggcatccggttcgcgggcccccggggggcgcagcgccgccgggtcagtcgggggcgtaggccttcaggaagcgcctgaccgcagcctccacccgccgttcggcctcggcgtcgtcgggcggcggcgcggcgtggaacagctggcggagctgcaatttaccgttcagcataccgaagaagtgttcggacgcgagatcgggatcatcgaccgacagccggccggcacgatcctgtgccgccagccagtcggccagcctgcggccgttgcgggccgggccgatctcgtagaaggcggcggcgagctccggcgccatgccgcccggccccgaaccggtcagcatgcgcatgaccgagaccatcttacccgtgatgaccacatccatgaaatgccaggcgatgcgggtcaggatctcgtggggtgaggcctcggggtccggggtttccagatgggcggtgatctggtcggcgacctcggcgatcgccgccaggaaaagctcgtccttgttgcggaaggcgttgtagatcgtctgcttcgagaccccggcctcggccgcgatctcgcccatgccggccacgaagccgtcgcgggtgaacagccggcgggctgcctccaggatcgcgcggcgcttttccgtgtcgggcggccggccgggcccctgccgggccggcgggcagccggtaccgcaggcttcggccgcagcttcccgggcggcggcgaccgcggcccgcacccggcggatgtcggtccggctcgcctcggtcaatgcccgcctcccccgccggctccggccatctgcggccggcgcacggtggtggtgatcaccgccgcggcgacgaagatccccgccagcaccagaaagacgtcgccgaaggtcatcacctgcgcctgagcctggatcatgttcatcagcgtcttgagcgccgcgagcgagctgtcgccggcaatcgccccgtcaaagcgctggccaagcgcatcgagtgccgcctggacctcgggccggttcggattggcagcgtcggcgatgcgttccagatgaagggcgttgcggtcgatcatcagggtgttgatgccggcaagccccaccgccccgcccagattgcgcatcagattatagagcccgctcgcattcttcagcatctccatcggcagcgtaccgagggcgatctggttgaccggcagcatgcacagcatcagcgacatgccgcgcatgatctgcggccacagcagctggtcgaactgccagtcggcggtgatgtgcgacatccaccaggtggacccggcgagcatggtgaagccgatcgccagcatcacccgcacgtccatcttgcgcgacagcatgccggcaatgggggccgaacagaactgggcaaggccggtgacgaacagcacctcgccgatctgcatggcgttgagatcgcggatccgcgccaggtagagcggcagcacatagaccagaccgtagaggccgacgccgatcacgaaactgaacacgcagccggtggcgaaattgcggtcgcggaacgccttgagatcgacgatcgggttgtggtggctcagcacccgccagaagaagccgatgccggctgcgaccatcacgacgaacaggaaggtgatcgtgcggtcgtcgaaccagtcgtcacgcggcccctcttcgaccacatattccatcgaacccaggaacagcgccatcagcaccagcccgagcagatccagccggcgcagcaggctgcgatcgccggtatcgaacgagggcgcgcgccagaccaccagcgtgaccagaatgccgggcacgacgttcaccaggaacagccagtgccacgagaagatctcggtcagccagccgccgagggtcgggccgatggtgggggcgagtgtcgcgaccagaccgatcaccaccgacacgccggcccgccggttgccggggaagagctggaaggccgccgcgaacacggtcgggatcatcgcgccgccgacgaagccctgcagcgcccgccagaggatcatctcgtcgagggtggtggcggtggcgcagagcgcgctcatcaccgtgaagcccgcggccgagatcaggaacagaccgcgggtcgacagcgcccgggagagatagcccgagagcgggatcatcaccacttcggcgatcagatagctggtctggatccacgagacctcgtcggggctggcggcaaggccggcctggagttccgacagcgaggacgacacgatctggatgtccaggatcgccatgaacatgccgaagatcatggcgataaagccggcgatctgccccaccgagggccccttgggcgccgcggcggcaggcgctgccggtgcgctgcccgctgtagacgtggcctcggtcatcggacccgcctccgctcagcgctgtgcgagacgcggggccgtgggctcggcacccaggccgtactggggctgaaccgcttcggccgcgggttcggccgcggtatcgaccgccaccacgaccgacaggcccggcaccagcagcttcgccacgggatcggcctcgtccaccgcaatgcggaccggcacacgctggacgatcttggtgaagttgccggtggcgttctcgggcggcagcaggctgaagcgcgcgccgctggccggcgacaggctttcgacccggccatgcagctcccgcccgccgagggcgtcgacagcgatggtcaccggctggccggggcgcatcgccgcaagctgggtctccttgaaattcgcaaccacataggtctcgggcagcggcacgatcgcaagcgcggtctggccggccttgacgtattcgccgggctcgaccgagcggttggccacgatccccgactggggcgcccgcaccacggtatgggcaagatccagccgggccgcctgaagcgtcgcctcggcagaggcgatctgggcttcggcctccacgcggttcgcctccagcaccggcacctggccccgggccgccgccacggcggccttggcctcggccagcgacgcctctgccttgcgggcatcggcgcgggcggtgtcgtagcgctgggcgctggcggcggcggtgcggttcagttcggcatagcgcttgaggtcgccggccgcgcgggcgcgttccgcctcggccgaggcgacgccggcctcggcgcgcgcgatctcggtcttctgcagctccagctggcggtcgatcacgtcgaccgacgcccgggcgcgggccagcgccgcctcggcttcggcgaccttggccttgtagtcggcatcgtcgatccggaacagcagggcgccggcatcaatcgcggtgttgtccttcaccgccacctcggtgacctggccggccacacgcggcgcgatgttggcgatgtcgccatggacataggcgtcgtcggtgctttcgacgaagcggccatggcgccaccattccgcaccgtaccagccaccgccgaccagtgccgcaacgaccaccgcgccaaggatgatctttttcataccgcctccgccgaatgaccggaccgcccgaattactggaccagggcgaccacgaattggtttccgcacaagatggccgatccggcgggggcttcaagacatttctggatgatcgggtccagaaattccggaggggtcaccttcgggcaacgcatggcggtgacgggggtcacaaaacggcgcaagcccgccagacggcgggcttgcggacagtgtgagagggtacccgaaagggaacgggtcggatgcgccttgcggcacacccgacccgtcctgtcggtccttgaggggaacccggccgtcggcgcacccttccgacggcctgcttcacggtcggaccgatcaggtggcgccgccggcggggttgcccgaaggcgtcccgctctgcggctcaagattgctgctgccagatccggagctgccggccgaaccggtatcgcccgcgccgggggtggtggcgccgctgctggcgtcacccggcgcatcgggggcgggctgtgccggcgtggtcgggctgggagaaaccggcgccggcgtgttcggagcggtcggggcaccgctctgatcagtcggcgccgaagggctggcaggcgcggatggggcgggggcaggtgcaggcgccgacggcgcgggggccggggccgactgttcggccggcggcgtgctcggggcgtcggcgtcgtcacaggccgcgaccgccagaaccgcggctgcggcgaaggcgagacgggttgcgacgcgggggaaagcgatgcccatgtgagatgttgctcctgatgatgtctcggctgcccccggggagaggggcaggtgggccgcggcgggcgccgcacggccggtccgatgcctcctacgggaaaggaggtgcccctcgggagagagaggggctcccatgagcggcgggacggggccgggacatgggcgacgggatcggtggaccggcgcggtcgggacgggcgggaggtgtgctggtgcccgtcgcggccacatcccgactgtcgcccggatcgccccgccatgcacgtgagcgataccgggcatccgagagccagagttgtgaccggaaaagggccggcctgccggggccgcggctttttggaaaccccccgcccgccaccgacgtgatagggttgcccgtcattcattgcgagggggcggggcgggtccatggaccacgggccggaaaccgaccgtctgcacgacctgctgacagccgtgggcaccggcgaccggcgtgctttcgacgcgttgtatctcaggctgtcgggccggctgcacgcggtcgccctgcgcatgctgagggatgccgatctggccgaggacgccgtccacgacgccttcgtgcagatctggcgcaatgccgggcgctacgaccgcgcccgcggcgaggtcaccgcctgggcgatcggcattctgcgctatcgggcgctcgatctgctgcgccggcgcggccgcgaaaccgccgccgacccggtcatcgtcgccgatctggccgatcaggcggccgccgcggatcccgacaatccccccgccttcacgccaccggaactgcccggccggctcaaccggctggaaacctgtctggccgagctgtccgatggagcgcgcggcagcatccgccttgcctatgtcgacgggttgagccatggcgagatcgccggccgcaccggccagccgctcggcaccgtcaagagctggatccgtcgcggcctggccgcgctgaaggagtgcctggagcaatgaccgccggcccgaccgatccgcgggaggttcccgatccgcgcgacgtcgacattgccgaatacgtgctggggacgctggacgagccggcgcggacggcgctgcgcgccgagatcgcccgggatccggcgctgcgcgcagcggtcgccgactgggaacgccggctggccccgatggtgctggcgctggatccggtcacgccgcccgcccgcctgaaggctggcatcgatgccagccttgcgggcgacaccagccggagcgaggcggcgcaggtgatcgacctccgccgcggtctgaccctctggcgctggaccgcgggggcggccgggcttgccgcggtggcggctgcggccatggccgccttcctgctgatccgccagcctctgcccgatcccgacgccacccggctggtggcggtgctgcgcccgctggaggccgccgaagccccgacctgggtggtatcggccgagccgggcgaaggcttcggccggaagcggctgctggtccgcacgctgggcgtgccggcggccgggaccgtggcagagaccgcgcccgggccccgggatttcgaactctgggccctgccgggcgagggcgcggcaccggtttcgctgggcctgatcgatccggcgcacgagacccgggtcgacctgcccgcgacgctcggcccccgcctgggtgacgggctgggcctggcggtttcgatcgaacccgccggcggctcgccatccggcgcccccaccggaccggtggtgctgatcggcgcgctgacccgcaccggcggctgagcaccgacgcctcgatcccgcgacggccgacatctgcctgcaacacggacgtggtatgcgggcagatcggttcgcccgtggagatcacgccccatgaagacgcccgccctgctgctggccgcggcccttgccgcagccaccctgatgcccgccgccgccgatgccgcccagggccgcctggtcgtctacacctcgacccccaacaaggcgatggccgatctgatcaccgccttcaacaaggcggaacccgaggtcacggtcgagttcttccggtcgggcaccaccgaggtgctggccaagctggatgccgaattcgccgccggcagcccagaacccgacctgctgctgatcgcggacagtgtggccatggccgggctgaaggcacgcgatcgcctggcggcctggcccgacgcgccggtcgaggggctgcccgtctcgtcgtatgaccaggatcgcacctggttcggcaccaagatcatcgccaccggcatcgcctggaacactgccgccggcctgcccgcaccgaccggctgggccgatctcgccgcccccgccgcaaaggaccgggtggtgatgccgagcccgctctattccggtgccgccaccatccatgtcggcaccgtcaccgccactcaagacctcggctggtcctacatggaggcgctgaagaccaatggcgcgaccgccctgcagggcaatggcgcggtactggatgcggtcgcgaccggccgcgccgcctatggtgtgctggtcgatttcatggccttcaatgccgccgccaagggctcgccggtcggtttcgtctaccccgcggaaggggcgaccgccgtcaccgagccggtcgcgattctgaagaccgcccgcaatgtcgacgccgcccgcgccttcgtggcctggctgctgtcggaagatggccagcgcttcacggtcgcccagggctatatgccgctgcggcccgaggccggcgcgccgcctggccggccggccagcgtcaagctgctcgaggttgcgcccgacaccctcgccgccatcggcgaggagacccgccgccacttcgcggcgctgttcggcgggtgatcccggcctttcgcctccgatttcaggcgcgtccccgcctctcactggcggaggccggcggcccgccgggcgatccccgcgccggccgcgcgggcctgccggcggtggcggcagcactgctgctggccggcctgccgctcggcttcatcgcggtggaagcggtggcgggcgggctcggcctcggcctgctcggcgacgggcgggtgctgcaggccgggctcaacacgctggtgacggccgtggcctccacggtcgcggctctggtgctgggcggtgggaccgccctgctggccgggctgaccgacctgccgggccggcgcggtttcgcggccctcgccctgttgccgatgctgatccccagccagattgcggcgctcgcctgggggcgggccttcgatcccgcaggcccgctggcccgggtgctggggctgggcgggttcggccccaacccgctggagagcgcctggggcgtgtggctggtgatgggggtggagcatatgccgatcgcctttctggcggtgatcggcgccgtcacccgcattccggccgaacccgccgaggcggcacgggttgcaggtgccggccccgccgcggccctggccgtcgcggcccggccgctggtcgccccggcgtttgccgcggccgcggcactgtcgctggtgtccgccgcgggcaatttcggcgtacccgccctgctcggcattcccggcgactatccggtgctgtcgacgctgatctatcagcgtctgtcgggcttcgggccggcggcgctcggcgaggcagctgccctggccggcctgctcggcctcggcacgctgggcctgctgcgcctgcaatccctgatggccgggcgtgccgcacgcgtcgccgatggcggccggctggtgccccgcctgccgctgggcaggcgccgccgtcagatcgcggggccggcctggatgctgatgatcgccctgtcgctgctgccgctggcggccctggtcgtggcctcgctggtgccggcacccggcgtgcccctgacagcggccaccgccagtctcgacggctatcgcgcggcactggacctccgccacggggcgggcagcgccgtgatcacctcggcctggctcgccctggtcaccgcgctcgtgtcggttgcggtggcgctgccgctgggcctgctggcggcgcgcggcgcacccgccgcccggctggccgccggcggcttcgatctggccctcgccctgccgggcacggtgttcgcgatcggggtgatcctggcctttctgccgccgctgccgggcatcgggctcaccctctacggcacacccgccattctgctcgccgcctatctcggccggtttccggggctggtgctggcgccggtgcgggccgccgcggaacggctggacccggccccggaacaggccgcgcgtctggccggcgccggcttcccggcccggatccgcgtcggcgcctggccggcactcgccggccccgcggccggcggcgcgctgctggtgctgctcaccgccttcaacgaactcaccctctcggccctgctctggtcgcggggggccgagaccgtgggtgttgcgatctatgcccgccaggccgaaggcgacagtgccggcgccgctgcgctctccgtggtcgccctggccgcagccctcgggcttgcaggcctcgccttccggatgatcgcccgcctgcccgggcttgaaagcgctttcggagaccgcccatgacgccgcgcgcccctgcctcatcacccccgccggatgccatccggctggaggcggtgacccgccgtcacggccgcaaggcggcgctcgaccgggtcgatcttcaggtcatgcccggcgaattcgtggccctgctcggcccgtccggctgcggcaagaccacgctgctgcgcctggtcgccgggctcgacggcgccgatgacggacggatcagcctggctggccggccggtggatcgcgacggccgggtcctggtgccggccgaggcgcgcggcgtgggcatggtgttccagagctatgccctgtggccgcagatgacggtcgcgcgcaatgtcgcctatgcgctggaacgcgcccgccgggcaccggccgaaaccgccgccctggtggcagaggcgcttgcggcggtggggctgcaggaccgcgccggggccatgcccgatgcgctgtcgggcggccagcgccagcgcgtcgccctggcccgggttctggcggcgcgccccccggtcgtgctgatggacgagccgctggccaatctggacccgcatctgcgccgcggcatcggcgaagagatccggcgcctgcatgatgccaccggtgccgccacgctttacgtcacccatgatcaggccgaagcgatggcgctggccgaccggatcgcggtgctgaaaggcggccggatcacccagatcgacacgcccgaagcgatctatgaccggccggccgatgcctggacggccggtttcatcggtcagggcgccgtgctgccggtcacgatcctgagggccgaagccgacggccgcgcccgcgcccgcattggtgccgggcccgatctggtcgaggcggtgcttcatgtgccgcccggcaccgccgccggtccggcacgcgccgtgttccggccggaacagctggtgccggtgccgcgcggcaccaccggcagcctgccggcactcgtcgaccggcgggtgttcgagggggcaggacgcctgctctggctgtccgccccctggtcgccagagccggtgccggtgcgcaccggccgcgaggccccgcgcccgggcgacgtgctgggggtggtggtgcgggacggctgggtcctgccgaccccgggctagatcccccgggctagatcaccgccagttctaccagcggccgcccctcggcaacccgggccgggctgaactggccgaggtcgagcgtgacgaagcggccatggacgatcagctcggcgagcccccggccggcggcggcggcctgctgcagaccatgaccgctgaacccggcgatgacctggaaattggcgaggtccggcatcgggccgatcagggcgttggcatcgaagacgttcatctcgtaatgccccgcccaggacgcccccggccgcagcctttcaaaggccggcacgcgcgccgccagcacgggccagatccgctcttcgaacaggggatgatcgacgatcagttcgagctgatcggggtccgcatccccctctcccggcgaccagccgcagatgaagcggttgccttccggccggaaatagacgccggccgggtcaacggtcagcggggcgtcgtgggggccgtgctcgcaatcgaacacgaagaccgagcggcagcgcggccgcaccggcagatcgagcccggccatcgccgccacggtcgcggccagggggcctgcggcgtcgaccacctggcctgcgcccagcctgcggcccgaggcgaggcggaccgaggcgatccgatccccgtccctgtccagccccaccacctcgtcgtcgagatagaccgccccgagcgcccgggccttgcgcttgaaggcctgaagcagcgcccagccgtcaaaccagccctcgccttcaagcccgagcgtgccgcccgacagcccctcggtcgcaagccaggggaaacgggcggcgaggtcggccggatcgagcagcgccgaccgggcgcccgcctctgcctgggcggcatggaccgccggcagatgggcaccgcccgccgggcccgccagcagcagataggccctgggcaccagccccagatcaggtacggcgccgtcgaccgccagcagcgacggatcgcgcaacagcgcatagccgaagcgcgacatgtggatattggccggggtggaaaattgctggcggatcgatcccgcagacagcgccgaggacgcccgggcatagccggggtcgcgctcgaccaccgccacccggccatcgaaggccgggtcgagccccaggaaataggcgaccgccgagcccatggctccgccgccgatgatcacgacgtcgaacgtctctgcggacgacatcccggtctcctcctccctcgcaatccgcaaccggcccggccggttgcgcgcgcccacgttaaaccggcgccacgggcggcgccagcgatggcgcttgacgccggcggccagcccaattagaacctctcaattagaataaataatttaattcgggagacccggatggtccgcaccccccgcttcgccgccgaagactttgtggaagccgcgatcgggctggtggccgagggcggcccttcggctgcgaccatggcctcgatcgcccgggccgtgggggcgccgacgggatcgctctatcatcgcttcgacagccgtgccgcggtgatgggggcgatgtgggcggccctgctcgatgaactcgccggcatcctcgccccgccgcttgccgcaggacaaccggcccgggcggccctggccctcgccgactgggcggcggcacggccgcgcccggcgcgcgccctgctgctggccgatctcgacaccgtgctcgacgccccgcccgaaggcggcacggccgcggcgatcgatgccgccgaggcacggatcgagaccgccttcgatgcctgtgccgcacggctcgggatcgcagccgaggatgcggcagcacgcaatcggctgcgctttctggtcatcgacgcgccggttgcggcactgcgcccggcgctcaaggcaggccgcacacccggcccaggggaacggcgcctgatcgaggaactggccaccctgctgcccaccgcacccggcatcgaagaggacgcagcatgacccgcctgtcgatcgaggccgacgataccggccgccacacgccgatccatggtcctgaggcgatcgccgccctgcgtgaagccggccggatcgcggcgctcaccctggaccatatcgccccgctgatccgcccgggcatctccaccgccgagatcgatcacgaagccgatgccttcatgcgggcagccggtgccgtagccgccaccatcggctacaagggctatgcccatgccagctgcatttcgatcaaccatgtggcggcccatggcatcccgtccgacatgaagcggctgaaggccggcgacatcgtcaatgtcgacgtgaccccgctggtcgacggctggcacggcgataccagccgcaccttcggcgtggggccactgccgctgaagctgaagcgcctggtgctggccaccttcgaggcgatgtgggcggggatcgacgccgtccggccgggggcgcgcctgggcgatatcggcgccgccatccaggcccgggccgccgccgaccggctggcggtgctgaccagtttctgcggccacggcaccggccgcatcttccacgacgcgccccaggtgctgcatgtcggacgtgcgggtgacgggatgctgctggagccgggcatggtcttcaccatcgaaccgatgctgaccaccggtcgcgaccgcaccaccattctgcccgacggctggacggccgtgaccgccgaccgggcccccacggcacagttcgaacacaccgtagccgtgaccgatacaggggtggaggtgctgacactctctcccgatgatccatcccccagatcgtggaattttgactgacggcagggaaccggacgcttttcatcccattcttgtcgctggacgggcgtgtcacctgcggggaacactgccgttaacgtaaactccatcggggcgacaagaatgaagatgatcaaacgggccggcctcactcggaccggttccgcattcggtggtacgctggttgccgggcttgggcttgccctgcttcccgatcccgcggccgcacaggcggccaatggcagtgccgtgaccggctcggtgaccgcagtggtcggcacggcggagggcacgccggaccagccggtggcggtggagcacgacgccgagaacggcaccttctcgctggtgttcgaaaacgactatttcgccgataccgaccgccattacaccaacggcttccgcttttcatacatgaccccgccgggcggcgacccgcaatggctgcgcgatgcggtgggcgcgatccccttcaccggctttggcggcgacatccgcgtggtctggtcgctgggccagaacatgtacacgccgcgcgatacctcgctccgcaatcccgaccccgacgaccgtccctatgccggctggctgtacggctcggtcggcgtgatcgccgaaaccggcggcgtgctcgaccagatcgaactgtcactcggcatcgtcggcccctcctcgcttgccgagcagacccagaagggcgttcacgagctgatttcgagcgacgacccccagggctgggacacccagctcaaggacgagccgatcgtccagctgacctatcagaagagctggcgcgcccttgcggccggctccgcctggggttttgccgccgatgtcacgccgcatgccggcttcgccctcggcaatgccttcacctatgccaataccggcgtcaccttccgcctgggccaggatctgccgcgcgattacggcccgccgcggatcagccccagcctgcccggctcaacctatttccgcccgaccgacagctggggctggtatctcttcgccggcgtcgacggtcgtgcggtcgcccgcaacatcttcctggacggcaacacctggaaggacagccgcagcgtcgacaaaaagccgctggtcggcgacctgcaggccggtctcgccatcaccatcaacggcgcccgcatcgcctacacccatgtgatccggtcgaaggagttcgacggccaggatcagcatgatgaattcggcgctctgtcagtatcgtttaacttttaaaggatgcgaatttgaacgccctcatcaattgacatgacgctttgattttccgtatttccggtttccataagtattttgttaaatcctccgacgtaggctccgagtgcggccggccctctcgtggccccgcctcagagccacgtcggagcacccgtcatcatgtcgtccgtccgttccctcaaaatcggcggcaagctcgttctcgcgtttgccgccctgatcctgatcatcctggccattgcgctttttgcgatcgaccggctggccctggtggagagcaccgccgccgagatgcggaacaatcgcgttcccagtctcactgcacttgcgaatctcgattcgaccgcactggagcatcgcgtggcggttgcgcgccatgtcatctcgcaggatgcgaagaccatggcggaggtcgaagcgaccatcggctcgttgaccgatcagatgcagaaacagctggacgcctatcgtccgctgatctccgacgaggctgaacggcaggctttcgacaagctgaccagcgcctggagcgactatacccgcggcactgccgctcttctgaccgtgtcgcgcgagaaccgcaccgccgaggccatggccaattacgagggcgagagccgtgtcgcacgcgaggcggtcgcgagcatgctcgaccagatcaccgacatgaacgtcgccgccgtcaaggcttcgggggaacatgcgctcggcgtttatgagggggctcgtttcgcccttctgacggcactcgccatcggcctcgtcatcgcgattgccgccgttctgctgctggtccgctcggtcgcccgtccggtcagtgccatgaccgccgccatgcgccgtctggccgacaaggacacctcggtcgagattccgggcgccggccgcggtgacgagatcggcgacatggccaaggcggtcgcgcatttccgcgacaacatgatccgcgccgaccagcttgccgccgagcaggaagccggccgcgccgcccgcgaggcggagcgcagccgccgggatgcggccaccagccgcttcctggaccagatcggccgcgtggtcagcaatctgggctcggccgcgacccagatgaacggcaatgccgaaacgctgagccatgcggcggatgaaagccagagccgcaccaccaccgtcgccgccgccgccgaacaggccacggtaaacgtccagaccgtcgccaccgcggcggaagaactcgccgcctcgatccgcgaggtcggcagccgcatcaccaccaccgccgacgtcacccgccgggccgtcgatcaggcagagaccaccaatgccgttgtgcaggacctgacccgcaccgcacagaagatcggcgatgtggtgctgctgatccagcagatcgccgcacagaccaacctgctggcgctgaatgccaccatcgaggcggcacgggccggcgaggccggcaagggcttcgcggtcgtcgcgtccgaggtgaagagcctggccagccagaccggcaaggcgaccgaagagatccagagccagatcgacgccatcgtcggcgccaccgaccgcaccgccggtgccatccggtcgatctccaccaccatcggcgaagtgggcgagctgacctcggccgttgccgcggccgtcgaggaacaggtcgccgccaccgccgagatcgcccgcaacacccagcaggcctccagcgggaccgacgaggtcatgcgcaccatccacggcgtcgcggaacgggcgatcgagaccggccgggccgccggagatgtccgcagcgccgccggatcgctcactggcgaagccgcgcgcctgcgcgacctggtcgagggctacgtcgccgagatcaaggctgcctgaccacacccacgcgttccgaccccgactgcagcctcccgcccttccgggcgggaggctctttttgcgtggtccatcacacgaccatacgcttctgtcaggctgatccgtcgcggattgcggcagatcaattcgccattgagccgcatgatgtaatcattccaggataagacatctccagcacgccgtccccggacgtcggtcacgaatgccccaacggagaagctgcatgcggtcgctcaactctctcaggatcggcaccaagctgatcctcgccttcgtcctgctgatcggatcgagcgtggtggtcgcggtcttcacgatcgaccggctggaccagctcgaggccgcttcggcggacatgcgcgacaaccggacaccgggcatggtgacgatcgcagaactcgacgtggccgccctggaacaccgggtatcggtggcaggccacctgcttgccgacaccgccccggccaaggcgaaactggaagccaccgccgcggaagatgccgcgcgtgtggagcgggcgctcgcggccctccggccgctggtctcggatgcggatgaacgggcacagctggagcggctggccaggggctgggcggattatcgccgggtgagcgatcggctgctcgccctgtcgcgcgacggcaagacggcggaggcccgggcgatctacgagggcgacgcccgccggctgcgccaggaggttgcgaccacgctggccgcgatgaccaatgccacggtcgaggggatccatcgcgaaggcgaggccgcccgcaccgactatcagctgacccggacgctgctggtcatcgtcaccgccatcggcccgctgatctcggccggcatcgtctatcttctgatcctgtcggtgtcgcgcccggtgtcgtcgatgacggctgccatgcggcggctggccgacaaggacacctcggttcagatccccggcgccgggcgcggcgacgagatcggcgagatggccggggccgtggcctacttccgggacaacatgatccgtgccgaccgcctgaccgccgagcaggagcaggccagtgccgcgcgggaggcggaacgcgcgaagcgtgacgcctcgacctcccgcttcctggaggaaatcgccagcatcgtcacccatctgggctcggccgccagccagatgcacggcaatgccgaaaagctgagccgcaccgccgacgacagccagagccgcaccaccacggtcgcagccgcggccgagcaggcgaccgtcaacgtccagacggtcgccaccgccgccgaggaactcgccgcctcgatccgcgaagtgggcagccgcatcgccgccacagccgacgtcacccgccgggcggtcgatcaggccgagaccaccaatgccgtggtccaggatctggcaagctcggcgcagaagatcggtgatgtcgtgctgttgatccagcaggtcgccgaacagaccaacctgctggcgctgaatgccacgatcgaggcggcacgggccggcgaggccggcaagggcttcgcggtggtcgcggcggaagtgaagaacctcgccggtcagaccggcaatgcgacccaggaaatccaggcccagatcgatgccatcgtcaaggcgaccgaccgggcggtggatgcgatccgttccatctccaccaccatcggcgacgtgggggagcagacctcggccgtggccgccgcggtggaacagcaggtcgccgccacctctgaaatcgcccgcaacacccagcaggcctcgtcggggacgggggaggtgctgcgcacgatccatggtgtcgccgaacgcgcggtcgaaaccggccacgccgccagcgatgtccgcaatgccgcgggatcgctgtccgaccaggcccagcggctgcgcaacctggtcgagggctatgtcgccgagatcaaggcggcctgacccccgcacccgacatcttcggaggacacctaccatggcgggttccgcatcggtcatccgtctgccggccgttgcagcgctgctgctgctgacggccgcctgcgccggccatccgcaggggcccgcacccggtgcccccgcctgcccggccggcgatacggcaatggtccagaccacgctgttcttcggcctggaccggcccggcggcgcgccgcagatcaccccccgcgaattcgaccgcttcgtggacgaggtggtgagcccgacctttccggacggcttcaccatccagcaggccgaaggcggctggcgggacaccgaaaccggcgccacgatccgcgaaccctcacggaccatcctgatcctggcgccggccgccgatgcggccgaggcgtcggcactccgggaccggctcgaccgggtccggtcggcctatatccaggccttcgaccagcaggccgtgggccttgccagcgcgcgggcctgcgtggacttctgagacatcactcccggcagggatcccggtgcagccagccggcaagcgccccgccgctcgccagaacctcttcgatccggccgcaggcgacgttcggcgggccggcgacgtcggggtctgccggcaggaagacggggttcccttccgcaggcgcatcggccgggctttcccgcaccggcaccagggtttccacccgcgatccggtcgcatcggcgatgcagtcgtggcgcgagccgtcgggcgcacgcagccggatgccggccatgccccggttcatcggccaggccgagaccaccgcctcgaccggtacccggccatcggcgatacaggcaccgatggctggcagcagatcggccagatggcgggtccagtcgtcgggctcgacatcgggcgccacccgggtggcatcggcaccggcaagactgcagcatccggcggcgacactgccatcggggaaggagaccacggcccgccagggcctctcgggggtctggtccgacatggtcgaggcacagctttcccggcgcatggtggcgaccagcagcccttcccgcccgtccccgcggaagaccgcggccggcggctccagaaaatccagcgtatccagccggccggtcaggatgatctcgtcgatgccggccgcccccggacgcgacagccgcgcctcggtacggccgatctccagcccccagaacggctcctcgcccacgcagctcatgccgcggatgctggccgcctgcggtcccggatccggccgcgtcggatccgacgcccgggtcggcacggatgccgagagcacgaccgccatgggggccagtaaggccagatgatgcagaccggcgcgggatgggaacatgatcgtctcctcgtcggatatcgcaagccaccccgtctcccgcagacgagcatatcacgtcggcgggcctatcacgtcggcggaccgctggcgccggcatgatcagcgggccgctggcgccgggaacgggtttgtcgcagactgggttacccccgcgcccgctcaggagggatgccgaacccccatgtccgccacctcaccgcgcgcacgccatacgatcgatctcggcggaacccgctgggccttcgacgatctgaaaaccctgctcgcccgggcaacgcccctgcgttccggcgaccagctggcgggccttgccgccgacacggccgtcgagcgcatggccgcacagatgctgctggccgacctgccgctctccaccttcctcgacgaagcggtcgttccctatgaggactgcgaggtcacgcgggcgatcatcgatgatcacgacccggccgcctttgcaccgatccgctccctgacggtcggcgcctttcgcgaatggctgctggggcccgaggcgacgccagaggcgctggcggcgctccgccccgggcttaccccggaaatggtcgcggccgtttccaagatcatgcggctgcaggatctgatcgcggtggctgccaaggcgcgcgtcaccaccgccttccgcaccaccctcggcctgccgggccggctcgcgacccggctgcagccgaatcatcccaccgacgacgaccgcggcatcgccgcggcgctgttcgacgggctgatcaccggtgccggggatgccgtggtcggcgtcaaccccgcgaccgacggcgtggacgactacatccggatctgcagcctgatggaggaggtgcgcctgaagctcgaggtgccgatgcagcattgctgcctgggccatgtcaccaccgcgatcgaggcgatcggccgcggtgcgccggtcgatctggtcttccagtcgatcgccgggtccgaagccgccaatcgcggcttcggcgtcgatctcgcccttctggccgaagcacaggaggcggcgcttgcgctggggcgcggcaccgccggcaccgatgtgatgtatttcgagaccggtcagggctcggcgctgtcggccgacgcccatcacggggtcgatcagcagaccatggaggcgcgcgcctatgcggtcgcccgccggttcaggccgctgctggtcaacacggtcgtgggcttcatcggccccgaatacctctatgacggcaagcagatcacccgggccgggctggaagaccatttctgcggcaagctgctcggcctgccgatgggggtggatgtctgctacaccaaccatgccgatgcggatcaggacgatatggacgccctgctcaccctgctggtgcaggcgggcgtcaccttcgtgatcacggtgccgggggccgacgacgtgatgctgaattatcagagcctgtcctatcacgacgcgctctatatccgcgaattgaccggccggcgccacgcgcccgaattcgaggcctggctcgtgaaggtcgggctgatcgaccaggccggccggctggccgacgccaatgccgccgcagcgctgcgcccggccctgggcctgatccgggggggcgcatgacccgtgacaccaaactgcccgccacgatccatgcggatcaggtggtcctgccggcgccggacgagatcacgcgcctgcgccgcttcaccgaggcacgcatcggccttggccgcgccggatcgggcctgcccaccgccgcccatctgcgcttcggcctggaccatgcccgcgcccgggacgcggtctggtcgggcatcgatgccggagcgctggtcgatgcgcttcacggacggggcctgagttcttgtcacgtttccagcacggcacgtgaccgtgcagaatatctgcgccgcccggatctgggccggcggctgtcggccgagggggcggccgcgctgggcgccctgccgccgccggcaccgggggcggaggtggtgctgatgctgggggacgggctgtcggccgccgcggtgatgctgaacggcctggcgctgatcgacgcgcttttgccgaggctcaccgccgcccgcatcggggtgatggccggtgtggtggcgacccaggcgcgggtcgccctgggcgatccggtcggcgcgatcctgggtgcccggctcgcgatcgtgctgatcggcgagcggccgggcctcagcgccgccgacggcctgggctgctatctcaccttcgatccccggccgggcacgctcgacagtgcccgcaactgcatctccaacatccgtccgggcgggctcgatccggcgaccgccgccgccaagatcgcctggctggcggcggaagcccttcgccgccagttgaccggcgtcgggctgaaggaggcatcgggtgtcgcggtgccggccgccggtcagccacgcgtgctcacggcggagtgagcgcggcgacggcctgcgacaatgcaggggccagatcgccacggggctcgacctccacacggtcgagccccagccacccggccatgagctgaagcctgagtgccagacgggccgcgaccttgccgaccgcatggcccggctcggcatgggcggctctggcgagcagcgccccgctcttccggtcggccttgaggtcgacccgggcggccagatgctcccccatcagaaagggcagcacgtaatagccatggacccgcttttcggcagggacatagatctcgatccgatagcggaagccgaacagccgttcagcgcggtcgcgctcccagaccagcggatcgaagggggcgagcagcgcgtcgctgcggcagcctttgggcgccggcgcctcgacatgcaggaaggcgggctggcgccagccttccacctcgaccggtagcagccggccggcctcgaccagatcggcgatggcgggcctggtttcggcggtcgcgaggcggaaatagtcggcaatgtcggatgcggtggcgatgcccagcgcccgggcggcgatgtcggcgagcgcgcgatgggcatcggcgacatccggcgtcggtacctccatcacctcggccggcagcacccgttccgtcaggtcatagagccgttcaaagcccccctgacggcgacgggtggtgatttctcccgcccagaacagccattccagcgcctgcttcgcctccccccatccccaccagccgccggctccacggcggccctggtcgaaagcgccggccgtcatcggcccttcggcggcgatgcggtcgcgcaccgcgcggatgaaatcctgccgctcgcggccgaatgtcgcgacgccgcgccagatgccgatgccctgggcggcccgggccatgcgccagcgaaacagcggctgcatcgccacggggatgagcgaggcctcgtgcccccaatactcgaacagatggcgggcatcggtcgccgccgcatccagcagccccggatcataggcgccgagccgggcatggagcggcaggtaatgcgcacgggccagcacgttgacgctgtcgatctgcaccagccccaaccgatcgacctggctcgccagccgacggatgccgatgccgcccgacggccggccgccgcccagcccctgggctgcgatcgcgatccgccgggcgtctgcaaggctgaggctcgcctgcgccgtcacgctgccgtcgcgcaaactctctctccccaaaatctcagcatggctgccccgatcatagccccggacgaatccgcaaggcgagcctccggcccggccacgtgctgtcgtcctgccatcctcctgacgcgtccggatgattgtcccattgcgcaagctggtacagtcatcgtgagattcccgcagatcgtcccttcatcaatccgccagccggtggacaattcatgaaataccggtgccccccatccaggtcatgaaccgccggcaccgcacgatcaagaaacgccacggaggaaaccatgcagagacgattgatcgcgctggcgctggccggctgcgcctgggttgccatgcccgccgcgcttcacgccgccggggcaccggcccttgaatacacggcggagatgcgcggccccgccccgatcccgccggcagagcagggattgcagaccatcaccgccacgccctggttcaaggtatccgacgatgggctgcagctggagggaccggtcttcgaccgggccggcaacctgatcttcaccgaggtcttcggcggcaaggtcttccgcctgacccccgacaagaggctcgagacgatcctgggcgagaatgcgctggcaccggcagggctggccatccacagggacgggcggatcttcatcgccgggctcggtgacttcaaagatgcgggctcggtggtggcgatgaacccggacggatccgggctgaccgccatcgtccccgacacggcgggtttcctgcccgacgatctggtcttcgacgacaagggcggcttctatttcaccgacttcaagggcacctccaccgatccgaccggcggggtctactatgtgggaccagagggcggtgagaagggcggcgagccggtggccgtgctgccgaacctctcggtcgccaatggcgtcggcctgtcgcccgacggcaagacgctgtgggtgacggagttcagcaaggggctgctgcatcgggtgtcgctcagcgacgccaccaccatcgcgcccttcgggaccacggtgccctatcatttcaccgggccggccccggattcgctgcgcaccgatgccgacggcaatgtctatgtcgccatgtacggccaggggcgggtgctggtgttcaatccgaacggcatgccgatcgcccagatccttctgcccggccgcgagaccggccataatctccgctcgaccagcatggtgatccggcccggcaccaacgacatgtacatcctgaccaatgactggaaggcgggcgagggatcgacgatcttccactgcaaggccctggccgccgcaccggtggatttctcccaccgctgacgcgagatcaggtcgggatggcgggtgagcattgctcgtttcacgccgcggtcgggcggcgccatgatcggggagcaaggattggagtcccgctcatgacactgcccgctttctccctccgcccaccacgcccggcggatgccgcagcgctcgaagctgtggtctcggacccggaagtggccctgcccaccgccgccatcccgcatccctatccgccgggcggagccgcggagcacctggccgatctcgcccgtcgcggcgccgccggccgggagatcgccgtcgccatcatcgatggccccgatcccgagacgggcagccttatcggcatggtcacgctgcgcctcgatggcgagggcggcgccgccctcggctatgtactggggcgggcctggtgggggcgcggcctgatgaccgaagccgtccgccgggttctgctcctcgcccgcgaccacccggagatcgcccggatcgaggccgatgtgatggtgtccaacacccgctccgccgccgtcctcacccgcctcggcttcaccgaaaccggccgggcccgggcagcgtttccggcacgggggcgggaggtggaggtcaggcagttcctgctgaacctcggcaatcctgtctgatacccccgtctgctcggccccctccgctcaacgcttttcacccggcaggatgtccgcttttctggccgcaagccgggggtcgggctgcgtcctcaggccaacccctccacctccaccctcacccggccgtcatcccgggcatccaccctggcggcgacgccccagacgtcgtgcaggatccggggggtgacggcctcggcgggggtgccgaaggcatgaaggcggccctggccgagcacggcgatgcgatgggcccagcggcaggcgaggtccaggtcgtgcaggaccacgatcacctgcaaggcccgctcgcgtgccagatctctgacggtggccatcacccggtactggtggcgcaggtcgagcgcgctggtcggctcgtccagcagcagcacccgcggatcgcggaccagcgcctgggcaagcgccgccatctgccgctgcccgccggaaagcgtgtcgagcggctgcagcgccagcgcggtgatgcccagccggtccagaaccgccacggcgcgttcggcatcacccttgggcgtgcccggcggcggatcgccggcagggccggcgcgcagggcgccgatcaccgcatccagcaccgtcagcgccacccggtcgggcagggcctggggcatgtgggcgaccagccgcgcgcggtctctcggcgtcatcgcgatcaggtcgcggctgcccaacatcgcccggccgcgaaccggcatggcgcccgccagtcctttgagcagggtggacttgccggccccgttaggcccgaccagcgccgtgatgctggcgggcggcagggggccgaggcggacatcatgcaccacgggcctgcggcgatagccggccgaaatgccgtcaagcgccagaatctcgcccgcaccgtcgaagatgccgatatcgcgcatcagctccgctccttgcgtccgatgatcagcgccaggaaggccggaacgccgatcagcgcggtcacgatgccgaccgggatcgtcacccccggcatcagcagcttgccggccaggctcgccagcgacatcaccagcgcgccggcaaaggcgctggccggcagcaggaagcggtgatcctctcccagcagcagccgcgcgagatgggggccgaccagccccacgaagccgatcgtgccgacgaaggcgacggccgtggcggccagcaggctgacccgaagcaaggccacgaaacgcagccgtgccacgttgagcccgaagctgagcgcccgttcctccccaaggcgcagcgccgtcagggcgggcgcctgcaccagcgcccagggcaggaccaccgccaccaccagagccaggatgccgaccttgttccagtcggtgcgcgacaatgagcccatgctccagaacaccagctgctgcagggcttcctgggatgccacgaactggatcatcgcggtcagcgcattgaaggcgaagaccagggcgatgccgaacagcaccagggtctcgatccccgcgccacgcagccgggccagcgcctgaagcgtcagcaccgacaggaaggcgaagatgaaggcgttggccgagatgatccagttggccggaatgcccggcaggctgatcccgagcacgatcgcgatcgaggcgccgaaggccgccgccgacgaaaccccgagggtgaaggggctggccagcgggttggagagaatggtctgcatctcggccccggccagggcgagtgcggccccgaccagcaccgccatcagcgcctggggcagacggacctggaacaggatcaccgactggacgcggctcagcgtttcggggtcgatcagcccgcggatcacggtgcccggccccatgcccgaggcgccggtcgcgatatcggcgatcacggccagacacagcagaaagccgagtgccgacacggtcgacacccggcgcgccatctgccggcgatggccggcgagagcttcaagaggcgttgtggtcattcgggcttcagggccaccgcataggaaccgtcgagggaaaccggcaggaagccggtgttgatatccgccagcacggcatccgggtcgagatcggcgaagagatccggccggacccatttcgcgatcgcctccaccgccacgatgttgagcggggaattgtagaagctgtgccagagcgcatagacccggccatcgcggacggccgacagatcgccgaccaccggacggtgcgccagacggtcgaggctttcgcgggtgaccgccggatcgatccccgcccccatctggatgccgccggtctcggcaccaccggccgtgccggtcgcgatgtagaccgccggatcctgcgtcaggacatattccgcatcaagctgcccgagcggcccgggcagcacgtcggcgccgatgttgtggccgccggcaaggtcgacgaactcacccagattgcccttgcccggagaaccgcagcagccgccatccatggtcgggcgcatgtccaccagcaccttcggccggggggcggtcgaggcggcgacccggctcttcaccagctccagccgcgcgcgatagaaatcgatatagcgcgcgacccgctcttcctggcccagcaccttgcccaggatttccaggctcgggatagtgttctccagcggcttgccgcggaagtcgatgaacacgatcggaatgcccgcctcggtcagccggtcgatgacctccttcgatcgcggcgaaggtccgtggccggcaaagcccagcaccgccagatcgggtgccaccgacagcgccttctcgatcgagaagctctcctcattggtgctgccgaccagcggcacccgttcgatcgccggataggcggccttgaacctgtcataggtgtcggtgtcgagcaggcgcagatcccccagccagccggccagcaccgacaccggatcgggatgcaccaccgacagggtcaccagatcacgcccctcgcccagcagcagccgctttgcgggcgccggaatggtcacctcgcggccggcgacgtcggtgacggtgatcggatcggcgaccgccatcccggcggtcgcgacgacgagggcgaccgcggcggctgcggccttgagcttgcgcagaatgatcatggccggcggctccaggtgatggtgagcgggtccttgaaggcgaagcggttcagatggtcggccaccaccccggtcagctgcccggccgtctcggcatcctccgcctcgaccacgatcccgagccggtcttccgacgcctgcatgatgcagcagctggtcccggagaacgggatccgtgccgacacggcatcagattcgacggcgaagcggtggctccagtgtttggcaagctgggtcatgtaacgccgcgccagcggcgtcgtgaccgaggcctcgaagatcgtggtcatgggctttgctccttgccgcggctccggcccccgcgtccgggggccggagccgtggatgaggggtgatcagaagcgcgccgaggcgccgacgaacacggtccggccgcgttcgacgaaggcataggcatcgtccgggtcgtcggtgcggctgtcggccacgttcagcacgccgccgcgcaccgagaaggtctcgttgatcatccagtcggcgccgaggtcgacgacggtataagggtcgagggtcagggctcccgaccgctggcggccggtataggtggcacgggtataggcggtcacctcgtccgacacgaaccagtcgagcttgccgttgatcgtgtgcttgggccggttgtcgagcacggcaccggtcacctcgttgcgcggatcgagccaggtccagttggccgacagccggccgaaatcccagagcatggtgtaggcattggcttcgacgccgcggatgcgtgcctcgttgatgttcacgggcacgaagacattgcggccgttctcctggccgaccggggtcacgccattgccgcgcggcgtctcgatcaggttctcgatatcgttctggaacagggtgacggtcgccccccaggaaccggtgtcatagccggcggagagttcgtagttcacgctctcctcgggcttcagatccggattgcccttgatgtagcagctgccgcggcaggacgaggtgcgcgaatcctcggtcagctgacgcagggtcggcgccttgaaaccggtggagacgccgcccttgatcgtgatctcgcgcgtcggtgtccagacgacatagccgcggggtgtgaaatgggtgccgaaatacttatcttcatccaggcgaccgcccgcgagcagcttgatctcgtcggtcagacgaaactcgtcctgaagatagagcgcctgggcatcggtttcggcccgcccgctgtcgaactcttccggcgatttgagttcgatccatcgcgcctcggcacccatcaccagggtatggcggtcgagaggcagcgagacattgccctcgatgacccggttctcctggcggatgctgtcttccgcggtctcggaggtttcggcataggcgcggatgaaggtggtgccccaatcccagtcgccttcgtgcgacagccccatgtcgcggcgcttcaccaccgcatcggcatcgccccagccgctgatatagtactcgccgaagcgggtctggcgcgactggccgtattcggcctcgattgtctggtcgtcgtcgggggtcagggtgaacttgacccggccctgataatcctcgcggccttcgagcgtggcgagatcggaccggttcacgaccgtgccgttcggacggatgaccgggttgccgctgccgtcggtgaccgcgccaccatccagcccgttccagatctcccggcgatcgaaggtgccggtgacggtgacggcgagcttttcgtcgaccagcggccccgacaggaagaagctggtccgggcttcggtaccccggtcgccctcggtcggcatgtcgaagcccagatcgacgctgccggtccagtgccgtgcggccggcttcgtgatgatgttcaccacgccgcccatggcttcggagccgtagagggccgacatgccgccccggaccacctcgatccggtcgatggcggcgaccgggatggcgccgatgtcgaaatcattgtggcggaaaacggattcggtcgaattgacccgcttaccgtcgagcagcatcagggtgaaggacgggtccataccgcgaatgctgatctgccggcgcccctggctgccggcggtcaggctgatgccgggaatgtcgcggatcgcctcggtcaggtccgagaccggataggccttcagatcctcgccgtcgaccacggtcaccgaggccggcgcggtgcgcgcctcttcttcggtgcgggtggcggagaccaccatctggtccagctccaccgccctccgctcctgcgcttcggccgccaccgacatcatcatgcccgccatggccgccccggccgtcgtggtggtggtggcgcgccagcgcgcgcgccgtccgcggcgatccgtcatcatcccactcccgtgcaagggtttactcaaactttgcgagtaactcgcacttgcataacggaaagggaaatacgcggttcggatatcggttatgcgcatgccggatcaccgacggccgccgttatgcgctcaatgagccaatggagcgccggatccctgcgggcgcgttcatgccagaccagccagtagtcgaaggtgccgaacacgtcgggcgcctcgaacatcaccagcccgcgggcttcggcgaagcgcttcgcagcgcgctccggcaggatcagcagcgcatccgactgctcgaccagcagcggcgccaccgagaaatacggcatctgcaccgccacctggcgccgcttgtccaggcggcgcagctggcgggcgacatggctgccggtcagatcgcccagcaccgtgatcaccacatgcggccaggcaaggcaggcatcgatggtgggcggccggccggccatgacatcggggtcgcgggtgatcgggtgatgctcgcgcaccagacaggcacggcgttcggtgaacagccggcggcgatacagctcgggccgctcgggcgtgcggccgatgatcaccatgtcgagcgcgccggcggccagcttctgatgatcgtcgtcgctcaacggatcgacggcgatctcgatattgggggtggcggcaagctcgcccatcacgggtgccagcaccgacagcacgccgtaatcggtcgacgacacccggaagcgtcgccgatcggtggcggggtcgaagccggccggcttgaacagccgccggatgtcgccaagtgccgccgcgaccggccccttcagcgccagcgcccggggcgtgggcaccatctccttgccggatttgatcagcagcgggtcgccgaacagctcgcgcagccgcgcgagcgagcggctgaccgccggctggctggatcgcagccgttcggcggcacgggtcacgctgccggtctcgatcagcgccgagaacacgaccagaaggttgagatcgatccgggtgaggtcgtcgtcggacatgggtctcgcggcgaaggcaggtgccggcaggcgggccggcatctcgaaccgcaaataagtcgcaagtgcaccttgagcgcaagcctgcaaccatgccccgcgacgctttcgcgcggacccgggtgcggaaggccacaatcgtgacggtccggcggtgacgggtctgcctgccggttcgggcccagccccggcgtttaccatgtttcaggtagagccagcgccgcccccccggcatagactggcggtgccatttgatcggcgcatcgctgtgatcggggagtgaatgacggaagaacgcgagacgcgccgcatacgcatcgtgctgaccgaagacgatgccccggttcgcgaccggctggcccagatcatccggggctggccgatggcggaactggtcggggcctgcgccacgctggccgagacctgcgccgtgatcgaggccgagccgatcaacctgctgatcaccgacctcaaactgcccgacggcaacggcatcgaggcgatccgcctgctgtcccgccggcagcgcgacgcccaggcgatggtcatctcggcactggccgacgagaccaccgtgctggcggcgatcgaggccggggcgaccggctatctgctcaaggacatggagtcgcacgatctctgcgaggccgtgctggatgtgatgctcggcagatcccccatctcgtccagcatcgcccgggttctggtgcgccgcctgtcggatactgcgcgccccggcgcgcaggaggcagcgacggttccggccccgaccctgacgccgcgggagatggatatcctctgggggatcgccaagggcttcacctatgccgaactggccgagcggctgggcatctcgcaccagaccgtgcccgtgcatgtccggaacatctatcgcaagcttcaggcgtccaaccgctcggaggccgtctatgaggcgacccgcctggggctgatccgcctgtgaccgcggcgggcccggcagatcaccggcacggcgttgcggtcgctgtgctgctggcggtcatgatcgctcttgccgggcttccctttctggtcggcctgccttcccccaaggccgcgctggtgctggatcgggcacagctgtcgctgaacggcggcccggctcatccggtccggctgccgcacagctggcaacgcgatctgcccgagcggacgcaagcggtttatctgatcgatgtcgtcatcgatgcggttcccgaccggccacagagcctgttcatcccgtcgatccggcagaagctggcggtgcagttgaacggccgggttctgtatcgccagcgggcggcatcatgggccgatctgtcgcgcggctatttcgagctgcggcagatcccgcccgatcttctggtcaccggcaccaatcatctggtactgacgctgacccgcacagacgggctgatcccggcccatctctcccggatctatatcggtgatgccgaggggatgatcgatcctccgtggctcaggccgctcatcaataccgagctgcgcagcatttcgctggcgctgcatctgttcatcgcggcagggctgttcgcgatctgggccgggcgaccctccgatccggtgtttcgctggctgatggtgctcagcgtcagcagtctggcgatggccgggatcgagctctggcccttcccgcgtctcatcccgttcgcgacgtctcatatcgtgctgatgctgccggctttcgggctgatgatgatcggccttgccctggcgatcaccggacgccccagaccgcgctggctggtaccggccatcatcctcgtccccgccctgctgctgacggtccggatcctcgccgatgcgccgatcgctcccacgcagcttctgggggcgggcatcggcattgccggccatgccgtggccggcctggtgcttctgcatgctttcgtcacacagcggttgtggacaggggggctgctcggcgtgtccgcgctgttgaccgcctggttcggcattcacgacgttgccgtggccttcggcctgatcccgggcgcgttcctgctgtcgaccttcgtgcggctgctgacctatctcgccttcctcatcctgctgatgtcgcggctcgccaccagtctcaaccggctcgaccgggccaatgacgatctgcgcgcccggctggcggagcgcgaagccgagctgtcgatcctgcacgagacggagaaacatctggtcggccaggcggtccgcgaacaggaacgccgccggctgatgcaggatctgcatgacgggctgagcggccatctggtgtcgatcatcgccctctccgagaccggacagcggcgcgacgacatcgagcggaccgcgcgcgaggccctcgacgatctcaggctggtcatccactcgctcgacctcggcgataccgatctgccgctggcgctggccggcttccgagaacgactgaccccgcggcttcggcggctggatgtccggctggtctggtcgatggaagcgctacccgaaatccagggcgtcacaccaggcaacgccctgtcgatcctccggatcctgcaggaagccgtgacgaatgccctgaagcacggccccgcacggttgatcgagatcaggggcacccccgaccccgcaggtgccggcggaaagatcgtcgtcacagatgacggcacatcgaccgcgcccatcggcaaaggcttcggccttgagaacatgcgacggcgcgccagacaggttggcggcagcatctccctggtcaagaacacaaatggcaatgcgctgcaattatgtttgccaactcggcttaacgactgttaattcgcgtaaatacgtatttattttgagagattttctgcaagcttataccatattgatggtattttgctcagatgtttcacgtgtctctctacgagggtacttgatcgcccctcacatgaaacatgggagacaatgatgatgaaaatacgcaaatgggcctgcagcgtgtcgagcatcgtcctgatcctcaacggttcagcagccttcgcccaggactgtgccagcctggcaagcgacgttggtacgcggatcgcggatctgaagaagaaggcagatacggcgcctgacgacgtcgagagcgactatgcgtcggcaacgtcgaaggactatgcgaacaagctcttctccagatttgaggatctcaacaagaaggcaatacaggcctcgcagctcatcaaccaaggatataatcttgccggttacacttcaccattcaaggaagggcagcagcagaccaagataccaccggttgtgaccaatacgatgagcaatgctgaagccctcgctcaggccgcggcggatgacgacaacaccaaactcgacatcctgagcctgcgctgcagccagtccaccgaacagactgcgctctcagcctatcttgcccaggctgatgccggcaccgtctcgtcctacgaggctgccaaatacaacatctgcaaggtcgttcacattctggccgatctccaggacaaacgacagaagctgaatgacatccgcgagaacggatatccactcttctatctccatgaaaaggagaagaagagctatgacggccacagccggacaatccagctcaaagttgacctccggctctaccccgtatacccggagcatgaggatcaggacattcttctgggtaagttggagaaaattcgcctgtcctacaattcgtactttaagtggagcgacaataactggaccaagctcaacgtcctccagaaactggtcgacgaccagaatgatgaaaaggaggtctgctggggcagcatcaagatcaccagcagcgtgaaagccgacatctgttcccaggtttacaacatcagcaccgacagcttgaagatcaaagtccgggcgaaattcaagtacagcggtgacacgcatgccgtcagcctcggtacggtcactgtcccggcgccgttcggatatctgtcggatctgtcggacatgaaggagaagaaaatgcaggatctgcaggcgaaggtcgtcgatcgcattgcatccctgttcggagcctatggtgacgtgatcgagaaagcccagagctggcagaaatcctgctcgtgatcctcaccacattcagggggcacggatgctggatgccgccgtgccccagccacatttccatgagagcccgggttcatggcggtcccagctcgtgagaaattccgggcccatgagaaattccgggccggagaccaggccgcagtgacctgccactgcaaaggtccggttcgacgactgccagcattcatgaccatcgtccgggatccgggccggagattcgctccgggtaccatgttgatggtattccgctaccggcgatcgtgtgcccctctaggaggtatcgcgcgtccctcggatgagacagaaagataatgaaaaagcagatgcataactgggcatgcagcattgcggcccttgccgtcatcctcaatgtttcaactgccgctgcccaggactgtctcggcctggcgggcgatgtcggcgcgagaatcaccgacctgaaaaagaaggccgatgctgcaccgggagacgtccagaacgactatgcctcggcgacctctaaggactacgcaaagagcttcttcacagcgttcgatgacctcaacaaaaaggccaatgaggcatctcaacttgtcggtcagggctacaagctggcgggctacacggcggtcttccaggaaggccagatccagacaaagatgccaccagtcgtgaccaacaccatgagcaatgccgaagccctcgcccaggtggcggccgatggtgacaagacgaaactggacatcctgagcctgcgctgcagccagtcgactgaacagactgcgctcgccacctatctcgcccaggcggatgcaggaaccgtctccgcctacaagaccgcaaaatacgaagcctgcaaggtcatccacatcctggccgaccttcaggacaagcggcagaagctgaacgatatccgtgaaaacggatatccgctgttttttctccatgccaaggacaagaagaaatttgccggccacagccggactatccagctgaaggtcgacctgcggatgtttccaatctaccccgacaagacaatgaaggtggatggaaaagaccaacccgtcctccttggacagatccagggaatcgacttgtcgtataatagctatttcaagtggagtgatgataactggactacactcaacctgtatcagtatattatttcggatacgcggaaggatgactacacctgcgccccctatttccacatgaccagccacgtggaggcgacgctctgcgtcaaggtcgaagcggcgagtgccgataaactcaaggtcggggcgaaggccaaattcaaatacaaaggcgacacgaaagaggtcggtttcggtacccagaccatcccggcgccctttggttatctcgccgatctctccgacatgaaggaaaagaagatgcaggacctccagtcaaaggtcgtgcatcgcgtcgcctcgctctttgacgcctatgatgcggtgtcggagaaggccgaagcctggcagaagtcctgcaaatgaacctggtgccgtctcctgcggccccgacgtccccccggcgcccacacggttttttcaggccgcccgaacgccgggccattccgggccggcgcatccgggcggccgcagccgccagcgcctgtatcatcctgtcggcctgcttcggcggcacaccacacttcgccgaacccatggctccgatccatgaactcgggcatgactggcgcaagcacttcagctacgggctggatctgctcgaccaggacaccccgctcaacaaccgggcagtcttcacgcgtgccgctttcgccagtgccgcacgttttgcccgtgaccatgccccttcctatgtcgggctcggcctcgccgagagcatgctcggcaatcagggagaggctgaggtcgcctttctaaatgccgcattgatcgaggatcgtagcctgtactgggcactcgcgaccattgcagccctgcgcaacggtgacgaggctgtcgcacgcaccctcttcgatgcgatgcaatccgcgaaaatccagagtgacgacccggcgagccgcttcgtgcgagaggtctatctggcagaaaaccctccgtcagaggccgccataaccaggatcccctatcaggccaggattgaaggcctggacgatgatctcatctgcaacgatacatctgatgacgacgtgtgccgcgacctgaacatcgtcgccaatctttacttcgtccgccggacgtcgtccgaaacgatggcccgaggcaccgacttcttcaacgaactcacggttcagctcggcgcagaacgaacccagagctgggagaaaaactccggtcaggactggcaaatgagcatcctgaacgaagtcacgctctcaatccccgagattcagtatgcggtccgcatcaccccccaggccagcaacagcaaggtctatgtcgacgcggcaccctcggtggtaacgtccatcggaaatacctcggagatccatgaaggggccaatctgacgatcctctacaactcgaccggcgatgccgaggagtacacggccgagacagggctgacgctccatatagaaccggatcgggcgacacccagatatgccagtctgcaattgcagttcgagttcagctcgatcgcaaccttcgaaccatcagccctggcacaggtcctgaacgtgtcgaagaacacctatcaaatcaccggctatttcccctatggccggccagtggttctcggcacgattgccaacaccacgaaacaacacaccaatagcggtcagactgtcctcgaccgcattcctctggtcggcggtgcttttgggcagtcggacacacagcttgcgacatcagacacactgatcctcgcccgattgtctgtcccatctgccttccatggctcgcacgagcaacgggtacttgatgcgatgcggggcatgggtgtcgaggtgatgggatatgacatgatcgaacgtcgcaggattgtccatctggcaccggaccttctcgacttcctgccagccttcctcaaaaccggtgccctttcgggcaccggttttgagggctgatcgcccgtcagatcttcagcacgacccggccttcgattttgccggcccgcatgcgatcgaagacgtcgttgacgtcttccagccgcgcggtcgaataggtcgccgccaccttgccctcgccggcgaaggtgaggcattcggcaagatcggcccgggtgccgacgatcgatccgcggatggtgcgacggttcaacaccatgttgaagatcgagatcgggaaggtgccgggcggcaggccgcaaagcgccatgatgccgcggcggcggagcatgtcggcggcctgggcgaaggccttctcggaaaccgcggtgaccagcacgccatgggcgccgccctcggtctcggtgatcatcttctgcacgacctcggggtcgcgggcatccagcgccacatcggcgcccaaccggcgggcgagggccagcttttcatccccgatatcgaccgccgccacatgcagccccatcgccttgccgtattgcacggccagatgaccgaggccgccgacgcccgagaccaccagccactggccgggccgggcctcggtctccttgatgcccttgtagacggtgacgccggcacaaaggatcggggccgccgcctcgaagcccagcgcctggggcaggtggccgacataggccgggtcggcaagcacatagtcggcaaaaccgccgtcgacggaatagccggtgttctgctgatcgccgcagagagtttcccagccggtaatgcagtgctcgcaatggccgcaggcggtgtgcagccagggcacgcccacccggtcgccctctttcaccgaccgcaccccggcgcccacggcggcgacataacccacgccttcatggccggggatgaagggcggttccggcttcaccggccagtcgccctcggccgcatgaagatcggtatggcagacacccgaggccacgaccttgatcaggacctgcccgggatccgggcgcggcacgggaacctcgtctatgaccagcggctggccgaaagcgcgcaccacggccgccttcatcgtgttcggcagagacatcttcgcgtttcctccatcggtgagacgtccggacggtttgtccgccccccttcatgcggacgcagccggcggggggtctcgttgtggatggtctggaaagagagatgatcgcgcaggtggcgcaacacgatcagcatagcgcgttccgggcggaaccgcacgcccgctgccccggggcgtatcaggatccggccgtccggagacgatgacgggggcggcgcacgggaacaccgcccccgcaagttaagcaccgcatccgcgagggatatgctgacgcggtgggggaaatggcgggtagggacgcccgacaccattccgacggatctattggcaaaggccgtgccagttgaggtttccccccggaaaccgcgagacagcgccgggtggacggccccggcgacagcggccgttgtcgaccgcctgtcgcaagacgcgacagttgtgcgacagatgtcgcaaaaggccgcaatgtcacgccgtccccgggccgccatcctgatgcgcaaacccttgcatcccttgcataactgtcaccgccggggcattctggagggatagtgttgcggcaaggcaggcgcccgccgccgcaaccgggaccggggtgacggcggccacagccataaccgacggtcgatgaacatcaaggggcgccgcggggagaacgaccggatgtcccagcagtccgggctgcagatgcagacgatcaccggcgtccgcggccagttccgcgatgccggccacctgcctgacggatccgtgcccgaggtgatcggccggtcctggcaacgctgcgcctctcgcgggctggcgatgaaccggccggcgcgacaggatccgctcggcctggcggcgctgcgccgccagcgggagcgcaatcacgacctgctgcgccttgccacccccgaactcgacctgctcgcccatgccatggcggatgcgcgcggcgtggcgatcctgaccgattcccgcggcctgatcctggatgcccgcggcgatgacggcttcgccggccgggcccgccgggtgttcctgcagccgggcgcctgctggtcggaagaacatgaaggcaccaatgcggtcggcacggcgctggccgaaggcggcctggtggaggtcgacggggcggagcattatctggacgagaaccgcttcctggtctgcaccgcgatgccggtcttcgatccgtccgggcggatcgccggactgttcgatctgtcggccgatgcccgccgcccgcaaacccatgcccggaccctgatccgcctggcggtcgtcaatctggagcatcgctgggcgatgcaggccgcagaggccgacggtgccgatctgctggtgcggctgcattcccacccctcctggctcggcaccccgcatgaggggctgctggccttccgagacgggcggctgaccgcggccaaccgcatcgccctcggcctgctcggcgtcgatgcctcgacgatcggcgagaccgactgggaagccctgttcgacggggcgatgaccggcgaggcccggcttctgcacacccgtgccggcggtgtgccgatgcatctgcgcgtctcgcgccccgcccccgcggcaccgcgccgccgcccgacgcctggccccgtcgccgaggcccaggccgtgaccgttcgcggcggcatggtgtgggacagcggcaccgatgccctgctcgcccgcgccgtgcgggccgcagatgccgatatcccggtgctgctacagggggaaaccggtaccggcaaagaggtcttcgtgcgcgcgctgcaccgccggtccagcctggccgaccggcccctggtcgccgtgaactgcgccgccattccggaaggcctgctggaaagcgagctgttcggctacgaggatggcgccttcaccggcgcccggcggcgtggctccaccggccgcatccgccaggccgagggcggtatcctgtttctggacgaaatcggcgacatgccgcttggcctgcaggcgcggctgctgagggtgcttcaggatggcgaggtcctgccgctgggtgccggcaagccggtcaaggtcgatttccggctggtcgccgccacccatcaggacctgaagacggccgtggccgaagggcgcttccgcagcgacctctattaccgcctgaaccatctgtcggtgacgctgacgccgctgcgcgaccgccggccgctggacggcatcgtcgacgccgtcttcgccgccaccggggccgccacacgcgccatccgcctgtcggacgaggcccgccgccggctgatcggtcacggctggcccggcaatctgcgcgagctggccaacctgctgcgcaccctggtcgcgctggcggatgacggagcggtgatcgaggcggaagacctgccggaagacatcagggcagaggcaaaacccaaccccgctaaccccaccaaccccatggccggggccgaggccccggcacagccgtctcaggcctctttggtcacgccggcggtttcggcctcgccgggccccgcctccctccgcgccctgaccgatgaggcggtcttccgcgccctggcggggaccgggggcaatatcagcgcagccgcccgtgtgctgggcattcaccgcgccacgcttcaccgccggctgaaggcttcgggctgaggaaggcgggggctgacgaaggccgggtgggcacccggccccggttatcgcaatggcgccccggttatcgcaatggcggtagtgccgccaccagatcctccagccgccgcggcaggggcccggccggcaaaagtccgcgggatgccagggcagaggccagacggtgcagcatcggcaggcgcagccccagccccgacagcagcacctcgtcttcgaaaaccgtgtcgggcgccccgtccaggacgatccggccacggccgaaaacggcgacacggtcggcccagccattggccagatccatgtcatgggtggcgatgaccacggcggtgccggtgtccgccaccgcatccaggcgctgcatcagttcgtccacccccgccggatccaggcccgccgtcggctcgtcgagcagcagaatgccgggacgcatggcgagcagccccgcgatcgcgacccgcttacgctggccgaagctgagcatatgggtggcccggtcggcgaggtgggcgacgcccatcatcgccagcgcctcggccgtgcgctccctggcctcggctgccgtcagccccagattgagcgggccgaagctcacatcctcggcgacggtcgccgcaaagagctgatcatccgggtcctgaaacaccagaccgacgcggtgccgcagccgggtcagccccttgcggtcgtgggtgaccggggtgccgtccagcacgacctgcccctgatcggtgcggatcgccccggccagcgccagcagcagggtcgatttgccggcgccattggcgcccagaatggccagccggccgccggccgggatcgccagatcaacatggtcgagcgccgtgacgccgcccggataatgatggaccagaccgcgggcttcgagcatcagccgatccagaccgcgccggccgcagcaagcaccagaccaccggcaagcagggcaagccgcgccggggccgcaaccgcctcggtgccggcaaagcgcagccggccgtcatagccgcgcaccgcgagcccggcattcatccgctgcgcccgatccagcacccggggcagaagcccggcaagcagccgcccgcccgaacggatctgccggccccagccggcatgccccagccgggccgcctgggcacgctgcccggtctccagacagtccagcaccagccagacgatgcggaacatcatcatcgccagatccgagatgtcgggggcagcccgcgacgctgaaccatctgcagcagcgaggtgagcggcgtggtcagcgcaagcccgatcagacagacgacgcaggtgatgcttctgaggccggtgaaggcggcggcagacagcatctcgggcccggcgatgcccacaaccggccccaccacttctggcccgcccgcccaatgcagcgtgatcatctgcaccgcagtaccggccaggatgaaaccggccggcaccacggccgcggcgcgcagatcccgcggcgccacccgtgccgcccccagcaccaggcagaggaccagcatcaggatcacgatctggccgatccagccggccgcgatgagcgagaccagcatcagcccgatgaagatcagggccttttcggcagccggtcgtctgcgccagcggttggtctgcgcggcacgatcgatggcccgcatcaggcgcggggtccgtcggcacgtgccggcgccgcctcgtccccggccggatccgcctcgcggcggccacggcgcaggccgaaataatagccgagcagaccggcgccgatcgctgcctgaagggcgaagagcaggctttcgatctcgccgctcggcggctcccacagcggctggaaccagggcacgtagtccggcgcgatctcgccgatcaccagttccgcctgaccgtcggccccggcgaattccaccgtgccgggcggatggatcagcagcggcgcgatcgccagcatcacgaccagggcgagcagaaccagattgcgcttcatcatgacgccacccgcccgcggaacagatccagcgccttcagttccgagcggctgtagcggccgagcatgttgaacaccaccacggtcagcagcccctcgctgatcgccagcggcacctgggtgagggcgaaaatgcccaggaacttcgacgccgccccggcgatgccgccggccggatcggggaaggcgagcgccagttgcagcgaggtcaccacataggtcgcaagatcgccgagcgtcgccgcaaagaagatcgcgagcgcggccccggcccccatgcgcgtcaggccgtggaacaacccccaggcaacgaagggcccggcgatcgccatggagaatacgttggcgccaagggtggtgagcccgccatgggcgagcagcagggcctgaaacagcagcacgatggtgccgagcacggtggtcaccgtggggccgaacagggtggcggccagccccgttccggtcggatgggaacagctgccggtcaccgagggcagtttcagcgccgagagcacgaagacataggcgccggatgccgccagcagcagcttcacttccggcgtttcgcggaccagccaggtgatgcggcgggcaccgtgaatgacgaagggtgccgagaccgccgcccagagggcggcatgggtcgccggcagataaccttccataatatgcaagggccgatcctccgaaggcgttggccacgtgcggcaaggccttcggagaaatcccggcaggttccggggaccccgcccccatccgaacaccccgttcggagagtggccctgtcagatgcgaaggcaggtttcctggcttgcgggtcaccatccgtcgccggccttcccggttgcccagtggcctgacggcccggaacctcaggtcccgggcgggcgacgaactctccgcttacagttgcgggggcagccatggctcccggacgcagcgcccgtgcccatgttcccttttacaccgccctcccccgtcaggagcgagaggcggaccttcatggggggtgattctgatctgtggttgtatcgggtgtcaagtcgtcggcccgcgggtggggtcggcaccggacatccccgcctcaaaaaaaatctcgggccgcacggcgtcgctgtcgaaatcgccatggcccggggctcatcattccggacggggaagagcggcccgcggggtgcgggcacggcgtgccgtccgcagatgagggatgcgaacgatgcagtacatgatggtgatctacgaaaccgccgaagcccatgcgaagcagaaggatccggcccgggccggggcctattggggcggctggggcgcctatgtcgaggcaatccgcgcctcgggcatcatgctggaaggccacgggctgctgccgcccgagacggcgacgacgctgcggatcacggacgggcgccgcgaggtgcaggacggcccctttgccgataccaaggagcggctcgccggctatttcgtgattgaggtgccggatctggacacggccctcgactgggccgcccgctgccccgcggcggccgagggcgcggtggagctgcggccggtgatgccgccggtgcaggaacccgggggcgcggcgtgaccggccccgacgcggcacacagggcggtcgaggcggcggcacggcattcccgtgcccgcctcgtcgccttcctggccgcacggttccgcgacctcgccgcggcagaggatgccgtggccgatgcctttcggatcgcgctcgacctctggccccggcagggtgtgccgcacgcgccggaggcctggctcaccacggtcgcccgccgccggatcacccatgccctgcgccatggggccgtgcgtcgggcggccgaaccggccctgaccctgctggcgggggaggcggaggatgcggcgatggcggcgcgccccctgcccgacgaccgcctggccctgctgttcgtctgcgcccatcccgcgatcgcccccgagatgcgcgcgccgttgatgctgcaggcggtgctggggctggatgcagcccggatcggatcggcctttctggtagcgcccgccaccatggggcagcggctggtcagggccaaggcgcggatccgcagcgccggcatcggctttcagttgcccgagccgcaggatctgccggaacggttgaaccatgtgctggatgccgtctacgccgccttcggcaccggctgggagatggtggccggcggcgatacccgcggcgccgacctgaccggcgaggccctgtggctgggccggctgctggtggagctgatgccgtccgcggccgaggcgcgcggtcttctggccctgatggcccattgcgaggcacgccgcccggcaaggcgcgacaccgccgggcgctatgtcccgatcgatcttcaggacaccacgctctggcgggccgatctgatcgccgaggccgaagcccagctgaccgcggccgcagccctggggcgccccggccgctatcagctggaagcggcgatccagtccgcccataacgcacgcgccgacccggccggccggccgcaacccggccccgacatccgcctggccctctataaggccctgatggcgatcgccccatccgcgggggccgccgttggccatgccgccgcgctcgccggaacggcgggcccgatgcacggccttcatgccctcgacgccgtcgccgggcttgagacctatcagcccgcctgggcgcttcgggcccatctgctggcggcgtcgggcgatgccgcatcggcgcgcgccgcctatgcccgggcgatcggccttgccgaggatccggccgtgcgcagctggcttgcggccgcggccgccggcctcaatgacggggcgtgaccgacggatcatcggtccaggcgctgctgccgtcgcggggggtgaagaacaggatgtcgagggcgggcgtgtgcaggaccgcgccgtgggtcatggccctgggcacacagaggacgtcgccgggcccgacctccagctgcatgtcttccccacccgtgccgatggtgcccgtgctgatggtaaaagtggcgcggccggccaggatcaccaggatttcgtcgccgccgtcatggcgttcccagaagcctttcacgctgcctgcatcgatccggatcaccccggtcatcaccggcccgtcggccagatgatgatcgagcagacggaaatcgccgcccggcaccagtgtcgcgagttcctgggcaatcgagaacacggccggcttcatcggaacacctcgttcatcggggggcttgatcggtcgccttcagaatacgaagattccttcggtttctgaattcgcatccggagccccgccgatgccgcctgtcccccttgccacaagcccgcggaaacggccggttcaggcccgatcgcgcgccaccgtcgagacgatcctggacggcgccgctcacattctgatccgcgacggcttcgaccgtgccaccaccactcgcatcgccgaggcggcaggcgtgggcatcggctcgctctatcagtatttcccgtccaaggaagcggtggtcgcggcgctgatcgaccgccacgccgcggccctgacccgggtgttcgacgatctggcgccgcggcttgccggcagaccgccggccgaggcggtggcgatgatcgtcgcggccgcgaccgatgcccaccggctgcacccggccctgcaccgggtgctgaacgaacaggtgccgcggatcggcgacatggcccggatcagggacgtctcggccacgatcaccagccatgtcgcccgctggatcgccaccctgcccctggcccccggccgggatcccgccattcttgccgtgctggtggagcggagcatcgaggccgtcgtccacggcgccctcgccgacgggcatgaccgcctgccccgggcgctgcatgacgaactggtcaccatgctcgcccggcatctggcgccggacacaccccgacaggatcagcgcatctcgaaagcttcctgatggaagcggccgcgggcgaggccaagacgttcgagcccgcgacggaggctgcggccgaacccggccggaccgcagaaccagatcgaagcctcgcgccagcccggcaccagccccgccagacggccggcatcgagccggccgtcgcgaccgctggccaggatatgcagccgcacaccggccgccgtcgccagcgcctggagccgggcgacgacatccggcgccggcgccgccgcgcaatagaccagatcgaccggccgccgctcgggtgctgccgccagcgcctccagccgtgcaaggaagggcgtgatgccgataccgccggccacccagagctgggccggctggtgatcgatgaagtcgaagcggccatagggcccttcgacggtcaccggatcaccctgtttcacccgggccggcagggcccgggtgtgatcccccaacgccttgacatggaagcgcagccgcccgtcgccctgccaggcggaggaaatggtgaaggggtgcgggccttcggcggcatcgaaggtgacgaaggcgaactgccccgcccgatgccccggccagctgcccgagagcgccagatcgacctccagcacatgggtggccggatcatgcgccaggcgggagacccggccggccacgcgccggcggatcccgatccggccgaacagggccaggagggccgagacggtgccggccgccagcagcagggccaccacgatgccgaccggctggacccactgatcgaaggtgaacagcaccgcggcatggaagaccagcaccagataggccagggccagcagccggtggacctgaaagacccggcgataggggaagcgccggatcagcgccagcaggataagtgccgccgccgcatagaaggcccattcgccgacgctttccgcgaagccgcgccagctgcgcagggtcgcctccaacgtgcccggctcgactggcacccggttgcgcgccggccggtcgagcagcccccagcccaccgcccatttcggcgcctgggcccacagccaatggatgacggccgcgaccagcgccgtgatgcccagccatttgtgcagccgatagcccttgtcgagcccgccgagcaggccttcaaggcgcaccggccgcatcgccagcaccagggccaggctcatcgcaccgatcgccaggatgccggtgccctgcatcatcgccgggcggatggcgaaaatctctgcgggcgcctggaagatctgcccggtggcgagccagaggccgggcaggacgacaaggaaggcaatcagcaaccgcttgggcgcggacatgggacgggtactccatcaggcgacgtcatcgctcctttttacgccgcctgactgggaaacctacggggcacgcatgcgacccggtgccgcatcccgaagattggcctccacctgcgccatgaccttgagcgtgacggccagatcggcatcggcaacgccccggaagataccctcgcgcagcgtggtcaggtcacggccgagccgttccgccagctcccgcccggccggcgtcaggcggacgagccgggcccgtcggtcgtcgctgtcctccacccgctcgacatggccgtcggcgaccagctggtcgatcacccggaccagggtcgggccctccaggttcatcacctcggccagccggccctgacgggtgccgtcgcccagccgcgccagatagcggagcggcaaagccctggcctcggacaggccgtgaccgtgcaacgcctgatccagcagccggcgatagagccgggcaatcaggaccaggtgcatgccgaagcgctccatgcggcccggccggccgaggggggcgtcgtcggtggtggtggcgtcgtcagtggttcgggcgtcgtccgtcatgccactcccttcccgaccggccccaggatcctgccgcccgccttcagcgccgcggccgccagcagaagcgaccggccgagatcgggatccgcagctgctgcggacagggcctccaacgcacgcgcggtgcctgccggatcctgggcgaagcccgccagcgccgcaagccccggccggccttcggggtgggcggccagcatcgccaccgcacgggccagcaccaggacggcgagcggccgcccgggcaaggccgccatgccgccggcccggcccagatgcagcatcagccgcagaatgccgcgggtgctccgcgccgcatggcgggcagccgccgcttcggtcgcagggccggcgatcagccggcgcagatcgtcgcgcagcacggccgcaacccgcgccgcctgaccctcgggccggcgcggcagggcgatgcaggtccccgccaccagcgccgcccccaggatcagggcggcggagcccgccagaatctcggacgccccggccgccggcatgccggcctgagaggcgagcaggaagcacatattggcatccagcgccggcagggcggtgcgggtcgaggcgcgcccgagcccgccgatcaggaagatcggcgccatggtcaggatcagcatggccgtgccgtccagatatggctgaaccagcaagcgatagccggtcgcgagcgcgacgccgctgaccacccccaggaacatcagcggcgccaccttttgcggcagcggcatcgatcccagcaccatcgaaaagatgcagaccccgagcgccgcaagctctgccgccggccaaccggtggcaagacctgcggcaccggcaagaaaactggcgccgcctgcgaccgctcccatgcgccaggccgccccgccagtcgcgatcggcgccgagtgtggggcggtcggacgtcagccgggtcgcttccggcggcgtcccctggccggccagtcgccgacgggccacttcaagccggatctctgctgcatcgggtcgcgcgccgtcatccagaccaaggcgtcgggtttctgctgccgccatcatgtcgaagcaggcgaagagcagcgcatcgacatggcggcgccggcgataaccgtcgaccgatccggcggtcactggcgccgtcagggcatcgagccgggtcatctgtgtaagcaggcgatgttcagccgcggccacttccgcctcgggcgcccgggcacggcacaggccggcaaaatcgcgcacacctccgaccagacggtcgagaccgtcgaggaaatccgcatggcgcgcgggcggcgtgaagaggccggtcaccagagtcaccaccaccacaccgatcagcgtgcattccacccgcgccatggcgagtgcgatcgactgatccggcgcaaagagcgatggcagcaccaccacggccgcggtcatgccggccatcagtggcgcataggacgccgtgccgcggatcagccgcgtggcaccggcgccggcggccatccagaacccgagaacgaccagcgtcagcaggggatcccccgcaaacgtgaccgccgccagcccaaagcccgccccgatcagggtgccgaggatgcgaaagatgccgcgctcgatcagcaggccgcgcgcggactgggcgaccacccagaccggcatcgccgcccaataggcgttctgaacatgcagcagggcggcgatcgagaaggcgatcagggcggcggcggcaaggcgcaccgcctggaagagcccggcccgatcgagcccgagccgcgccggccagccgtgaacggcgagagacatcatgacgaaccccgatgatgagcatgggagtcagattatcattaggtaggtgagctatctttatgcactttgcgcagaggacacatgcgggcgatgatggacaccgcacccgggccttccctccttcaacctggtggatcccatgaccggcaccatccgtatcggcatcggcggctggaccttcgagccctggcgcggccgcttctatcccgacgggctgccccataagcgcgagctggaatatgccgccggtcggctcagttcgatcgaggtcaacggcacctattacggcacgcaaaagcccgagaccttcgcccgctggcgtgacgagacgcccgaggatttcgtctttgccctcaaggggccgcgtttcaccacgaatcgtcgggtgctggcggaggccggggcgtccgtggaacgttttcttgaaggcgcggtggtgctcggccccaaactgggcccgatcaactggcagttcatgcccaccaaggccttcctgcccgaggatttcgaagccttcctcgacctgctgccgccggagcgcaacggcctgcgcctccgccatgcagtggagcttcgccatcagagcttcgcggttccggagctgatcaccctggcccggacccgcggtgtggcgatcgtgatcgcgggcgattcggagcatccgcagatcgccgaccccaccgccgacttcgcctatcttcggatcatgggcacgcacgaggacgcggagaccggctatacgccggaggcgcttgacctctgggccacccgcgctcgtgccatcgccgccgggaccacgcccgagggcctgacgatggtggggcaaccgcctgcgacgcccacgccacgtgacgtcttcctctatgtcatctcgggcttcaaacccgccaatccggcagccgccatggcactgatcgagcggctgagccgctagcttccaaggtcgaagccggtcaccgccagcaccaccccattgaccagcagttccaccgtatgatggccgggatgatggcggcgggtggaaaagtcgcggatcacctgggagcgggagagttgcagccgctcgccgggcccgagatcgacggtacgaagcttgaagaccttgcgggaaatgccggtcgggcggacatagccgatggcatagtcgatcaccagtcgttggggcgttgccgcggtggagaccagatcgacggcaagggtgatgcgatcgcccggacggatcctggccggggtgatcgccgccgcctccacccgcagctctgcgggccggtcggcaccgatcagcgccagcgcccgcgtatcgccggccttgatccggctgcgcagaccgtggcggatgatccaggcgatatgcggatgatcccggtcccagccggcaagccgatccagcagccagtcgggatggtccttcgagacgtcgttcaggtggttggcgaccgagcggcggacatagatcgcgggatcggtcttcagccggtcgaggatcggccaggtcagcgccggatcggcgaccaccgcctccagccggaaggaccagggcaggcgcggcctgcccccctcgctcgccaggcggcggacatgttcggatgcatcggcggtccagtcggtcatcacccccagcacatgggccgggtcgcggcggatgaaggggcggatgccgaactccgacgagccgaaccgggtgaagaaggcgagtgcatccagcgcccgatccgtgtcgtcggacgcaaaccgggccacccagtcgggcaggatcagggtcgcgaagcccgatcccatgcgcggcgccaggtcgcgcagcacatcgagcgcccgctcgaccggcaggtcgagcgccgcatgcatcgccccgctgacctgaccaagccgggccatcagggccagatcgtcgaggtcacgcagcgccgcctcaagaaagcacgcgcgatcgaaggcgggcgagagatcggccagatgaccggcgatcgtctcgatccgggcgcggtcgaagatttctttgagggcaggctctttgaggtcaggttggacggcagtatcggtcatggcatccgggcgcggttcggtggtgctggaaccggcatcctgccatggaagatgacagaaacctgtcaggaggtttcgcctgcgccgggcaaaccccgcgcctcaggccggcatgcgctcgcggatccggcagaccatcagcagaccctcgccattgaccccgccggcctcggccaggccgcggcggtcgatgagcagggcgtcgagcggtgcaagatcgaccgtttcgccccggatctgcacgccgacctgaccgctgacgcacagcagcagcacgatctcggacaccacggccagatcgacggggccggcgacccgcatccgctccatttcgtggacgaatcccgcccgccgggtcatcaggttgagatcggtgatcggcccgtcgatcagccgggcggtggtgggctgatcggcggggaaggcgaagggctcggcggcggggtccaggctgcagctgcccacccctgccaccgacagctccatccccgcgccccggatcaccgcgagcgaccggtcgatgccggggaagatcgagaacggcccgtcggtggcgacggtcgccatgctcaaccgccagtcaaagccgtcgagcccggcatcggcgggcgagatcgcgatttccacggtctcgccgccgccgttcttccagggcatgcgccgatgtccggccgcaggcagcagacgcatcggggccatgaccgttcctccgtcttgcccggccgccgacggccggtctcagttccccaggatcgcgggcagacgcagcccctgttcgcgggcgcagtcgagcgcgatgtcatagccggcatcggcatggcgcatcacgccggtcgcagggtcgttccacagaacccgctccacccggcgcgccgcatcctcggtaccgtcacagacgacgaccatacccgaatgctgcgaaaagcccatacccacgccgccgccatgatggaggctgacccaggtggcgccgctcgcgcagttgagcagggcattcagcagcggccagtccgacaccgcatccgagccgtccttcatcgcctcggtctcgcggttggggctggcgaccgaccccgaatccagatggtcgcggccgatcaccaccggtgccttcagctcgcccttcgcgaccatctcgttgaaggcgagaccaagacggtgacgatcgcccaggccgacccagcagatccgcgccggcagaccctggaaggagatgcgctcccgcgccatgtccagccagcggtggagatgggcgttgtcgggcagcagctccttcaccttggcatcggtcttgtagatgtcttccggatcgccggagagcgctgcccagcggaacgggccgacgccgcggcagaagagcgggcggatataggccggcacaaagcccgggaaggcgaaggcgttttccagcccctcatccttcgcgacctggcggatgttgttgccatagtcgagggtcggcacgccctggttccagaagtcgagcatcgcctggacatggaccttcatcgaggcccgtgccgccgcttccaccgccttggggtcgctctcgcgcttcgcccgccattcggccatgttccagccgatcggcagatagccgttgatcggatcatgggccgaggtctggtcggtgacgatgtcggggcggacgccgcggcggaccagttcgggcagaatctcggcggcattgccgagcagaccgaccgatttcgcctcgccggccccggtccagacccgaatcatctccagcgcctcgtcgagcgattccgtcttcgcatccagatagcgggtgcggaggcggaaatcgatcgagtcggggttgcactccaccgccaggcagcaggcgccggccatcaccgccgccagcggctgggcgccgcccatgccgccgagcccgccggtcaggatccagcggccctgcagattgccgtcataatgctggcggccggcttcgacgaaggtctcgtaggtgccctgaacgatgccctgggtgccgatatagatccaggatccggcggtcatctggccgtacatggccaggcccttgcggtccagttcgttgaaatggtcccaggtcgcccaatgcggcaccaggttggaattggcgatcagcacccggggcgcatctttgtgggtgcggaacacgcccaccggcttgcccgactggaccagcagggtttcgtcatccgaaagcgtgcgcagcgtggccgcgatccggtcgaaatccgcccaggtgcgggcggcgcggccgatgccgccatagaccaccagttcgttggggttctcggcgacgtccggatcgaggttgttcatcagcatgcggagcggggcctcggtcagccagctccgggcgctgatctcgggtccgcgcggcgccctgatctcgcggatgttgtggcgcggattgctcatcggatgtgctcctcgggcgaagtgtaggccgggtcggtctgggggcggcaggggctgaaaggcggacatcgccgtcagggacgggtggtcctgaggatggtgtgcagggcggcgaaatcgccgttgagcggccggtcgtcggcatagggggccacgcgtgcccggatgcggcgatagagcgcgtcggtgcgcggcgcccgggcgagggccgggggttgcagatcataggcctgggcggcggccagcagctcgatcgccaggatgcgctcaagattgtcgagcaccgccagcgccttgcccgcggccggggtggcgtgggtcaggatgtcttcctgaagcgccgaggtgatgccaccatccaggctggccggggcggcgagccgccggcattcggcagccagcgccgcggcggtgtactgggcgatcatgaagcccgaacacaccccgctgtcgccggcaaggaaggccggcagccggctgaccagcgggttgaccagccggtcgacccggcgttccgaaatcgcggcaagctctgccgccgccaccgccagcccgtccatggcaagacccagcgccgcacccacggcatgcgcctgggaatgcacctcgggtgcctcgggtgtgcccgacaccgccgggttgtcggtgacgctggcaagctcccgatcgaccaccaccgccagctgctccacctggtcgcgcaccgcaccatggatctgggggacggcgcgcaggctcagcggatcctgggtgcggctgccggcggcggcggccagcagctcgctgccggcaagccaggcatcgagcctggcgccgacagtctgcaggcccggggaggtgcgcagcgccagcggtgccggcgcgaaggcccccgcctgggcgcccagattctcgtaagccagcgtcgccgcggcatccgcccagtccatcgcccggtccatgcgggagagcgccagacaggcgaggccggtggcacagggtgtgccgttgaccaggctgagaccttccttggcctccagcaccagcggctccagcccgatcctggccagcgcctcgcggccggtcagcagctcggtcccgtggcgggccgtgccatggccgatcagcaccagcccgatctgggccgcatgggtcaggtagccgacggagccgcgcgacgggatcaccggcaggatgttggcattgagcagcgccagcaatacctcgaccgtctgcggccgcacgcccgagtgaccatgggcaaaattggcgatctgggccgccatgatcgcccgggtctcggcctcacccaaaggttcgcccacgccgcaggcatggctgaacaggatgttgcgcgacaggctctgctgggcggagcggtcgatgatcacgtcgcagagcgcgccgacaccggtgttgatgccatagccgcggatgccacggtcgaccagggcgtcgaccacccggcgtgccgcctcgatccgcgcccaggcagcgggcgacagctccagcccggccccttcggcaatggaggcgagatcgcgccagccgaggacgcggtcgaggatgatgcggttcgcctgcacgagcgcctccgcggtcacgtccccggaaaggaagccgtccggcgcggccggatcctgcatgggatcagtcatgtccacctccggtccggcgctggacgaaacgggcgacatagtcattggcgggattggtcaggatctcgtcggggctgccgacctgaaccaggcggccatccttcaggatcgcgatctccgagccgatgcgcagcgcctcgtccagatcatgggtgatgaagacgatggtcttggcgaggttctgttgcagctgaagcagctggtcctgcatgtcggtgcggatcagcggatccagcgccgagaaggcctcgtccatcaggatcacgtcggtatcggcggccagcgcccgggccagacccacgcgctgtttcatgccgcccgacagctggtgcggatatttgtcttcataacccgagagaccgaccgcctcgatccactgcatgccgatcggccgggcctcggcgcgcgacaggccacgcacccgctggccatagacgacgttctgcagcacggtgcgatgcggcatcagcccgaagctctggaacaccatgctgacccggtgggtgcggaaatccctgagcgccttcgcccccagatccaggatgttgcggccgtcgaagcggacctcgccggcggtgggctcgatcagccggttgatgtggcggaccagggtcgacttgcccgagcccgacagccccatgatcacgaagatccggccggcaccgatcgtcaggctgacatcgtcgagaccgacgctgcagccggtgcgggccagcacctcggccttgtcgagcccgtccttgacaagcttcagagccgtgccggtatcgcggccgaagatcttgtagacattgcggatctcgatctcagccatgacgggcgtcctcgttgcgcggccggccgaagccctgggtgatgcggtcgagcacgatggccaggatcacgatgccgagcccggcttccagccccttgccgacatcgagcgtctgaatgccgttcagcacctgctcgcccaggccgcgggcaccgatcatcgaggcgaccaccaccatcgacagggccatcatgatcgtctgattgaggccggccatgatggtcggcgtggccagcggcagttccaccccgaacaggatctggcgcgggctgccgccgaaggcctgcgccgcctcgatcacctcgcggtcgacctgacggatgcccagatcggtgaggcggatcagcggcggcacggcatagatgatcgtggccagcacggccggcaccttgcccaggccgaagagcatgatcgccgggatcagatagacgaagctcggcatggtctgcatcacgtcgagcaccggcagggtgatgccgcgcatgatccggcttttggcgacccagataccgacggggatgccgatgaccaccgagaccagggtcgccatcagcatcagggccagcgtctgcatggtcagatcccagagcccgagcacgcccacgaccagcagcatcgcggcgatcatcaccgtcggtgcgatccggcgggtcgcctgccaggcgagccccgtgaacaccaggaacaccacccaccagggcaggccgcgcaggatctgctcgatgaccaggatgccctggaggatgacgttcgacacggccttgaacacgaagccgtaatcgaccaccagcatccggacgaagtcgttgatcggcccgcgaatggagatgtgcagggactcagggaacatgggctggcttccttgccgcgggtgaagcggaggatggcgcggccccgccgccgggcgggggccggcggcggaccgtgcgagaggcagggatggaggctgcgggcgaggcgcggccccttacttcaccgccgcctcgatcttcgcccgggcctcggccggaacccagccgccccagacatcgcccttggtcgccaggaagcgcttcgcggcagcctcggcatcggccttttcgtcgaccatgtaggcgaggctggcattcacctcggccagcgggaaggtcgccttctccagcatctcgacgatctcgggcgccgccttggcgaaatcggcgttcaggccataggcgacctcgaccgccgggaaggcgcagccgcggtcgcgcttgccggtggcgctggtcagctcggtccagcaggcctcgtcataggccggttccttcagctggaccagatcgtacttgcccatgatcgcggtcggcgtccagtagtagaacaggatcggctcgccgcgcagataggcggccgagatcgccgcatccagcgcggtgccggtgccggggcggaaattcacatagtcgtcggtgagcttgtaagcctggagcttggcggtgttgacgccctcgcaggtccagcccgaggggcagttcaggaagcggcccttggacggctcctccgggtcggtgaacagcttcacgatcgccggatccttgagctgctccaccgtctccagcttgggcgcggtgggggcgatgccgcgggtggtgtcgcccttgaccatataggccgggacataccagccctcgctggcgccgacgaaggtcttgccgaccgacaccacctggccggcggcggcagcgttgttccagacgtcgctgcggccgatccattcctcggcgaagatctggacgtcgttattggcggtcgcctgttccagcgtcaccgaattgccggggatcgcatccacggcgcagccatagccttcggacaggatggtcttcatcacctcggtgatgaaggcaccgctttcccagtcgatgccggcaaaggtgacggtcttgccgtccccgcaatacgaggcctgggcgctgccggtggagaccgcgaacacggcggccgtggtggcgagcgcgagcttgagcgtggtgaaggtgaaattcgacaccgtgcgttccctttattgcttggcgtacccggtcaggatcttcggtcgtcgcctcctcgccgggccgcacggacaggggccgccgggccgggggtgcgctttggcccgcgcgccccccgtcgttccccggagcgccacaggcaagttgtatatgcaagatgacccatttcccgaagggacgcaatcctgtatggtcgaaaaacatgcaacttcgcgcatgcccaccatacaggcagccccccatgacccagatcggcgtccagatcgaggcgacccggccgaccccggccggcgaagacgggctgcgcgagctgccgctttacgagcagctgaaggcgcggatcaaatcgcgcatcgccagcggcgactggccggccaatcaccgggtgccgtcggaaaacgagctggtcgaggagatgggggtgagccggatgaccgcgcatcgcgccctccgtgagctggcggcggaaggtgtgatcctgcgcattcagggcaagggatccttcgtggcgcctgcgaagcgcagcgcgccctttctgggcgtgcgcaacatcgccgatgaaatcgccgagcgcggcgcggcccacacggtcgccatcaccttgagccaggcggaaaattgcggccccgaccttgccgacgcgctggaggtggcgatgggggccgaggtcttccacaccgtgatcgtccatcgcgaggacgatgtgccgatccagatcgaggaccgcttcgtcaacccggcggtggcgccggattatcttggccaggatttccggagcaccacgcccaatgcctatctgacggcgctcgccccgatcacgcgcaccgaacagtcggtggaggcgatcctgcccaaagcctgggaatgccggctgctcgccatcgcccggaccgaaccgtgcctgatggtccgcaggcggacctggtcgggcgcgcgggtggtgacggcggtgcgcctgctctaccccggcacccgctaccggctggagagcagctactgacaaaaacagccggcggcccccggaggagccgccagcttacctatacaacctgagtgatccgcagcctcaggcgctctgccgccgcagcgccggccgcggcagggcctgctccagatcctccagcaggtcctcaggatcctccaggccgaccgaaagccggatcagcccgtcggaaatgccataggcggcgcgctcctcgggcgtgtaggtcgaatgggtcatggacgccggatgctggatcaggctttcggcatcgcccagcgacacggcccggccgatcaaccccagccggttcatggtctcgcgcccggccgcaagcccgccggtcagttcgaaggcgatcatcccgcccggcagcgccatctggcgccgggccagatcgtgctgcgggaaatccgccagtcccggataccagaccgacgccacggccggatgggtattcagcatctgcgccaccgcaagcgcgctcgccgaatgacgctccatgcgcagcgacagggtcttgagcccgcgcaggatcagcatggcgttgaacggcgccatcaccgcgccggtcatgtccttcagcccctccagccggatccggccaacggtttcggcatcaccgaccaccagccccgccaccagatcgccatggccgcccagatatttggtcgccgaatgcaccaccagatcggcgccaagctcgatcggccgggtaagacggggcgtggcataggtgttgtcgaccacggtcacggcacccgcggcacgggcgatctccgacacgcggcggatgtcgaccagccgcatattcggattggccggggtttcgaaatacaccacccgggtgcgcgggccgatggcggcggcaaggttttcggggtcggtcaggtcgacatgggtgatggtcaccccgaaacgcgccaggccgtggcgcatgaaggcgaaggtgcagccatagagcgtgcggtcgacgatcacctcgtcccccggcgagaccagcgtccagagcgttgcggtgatcgcccccatgcccgacgccagcgccagccccgcctccgctccttccagatcggccatgcggcgctccagcaggtcgagggtggggttggagatgcgggaataaacatggccggggcgggtgccggcgaacatctcgccacctgcctcggcggtctcgaacacgaaggtggaggtgagatgaagcggcggggtcaacgccccgtcattggcggccggatcatagcctgaatggatggcacgggtcgaaaagctgcgcgaggtggtcatggggcgtctccctctgtctcttgaggcatgatacgccctcgctcagggcatttgattgccatcttcgccctaaatcggcaagatcggggtcatatatgccagggaagaggcagcgccatggacgacaaggaccggcagatcgtccgcatcctccagaccgaggggcggattaccaatctggagctggccgaccgggtggcattgtcgccctcgccctgcctgcgccgggtgcgcgccctggaagagaccggcgtcatccgcggctatggcgcccgggtcgatgccaaggccttcgggctcggcctcaccgccttcgtccatatccgcctggaccggcacaaccgggcggtggtggacggcttcgaacgccggatcggcgtgatcgacgaggtggtcgaatgccatctggtcaccggcaagtcggattatctgctgcgggtgatggtggccgacctcgcggcctatgaggatttcgtccgcaaccgcctgcacgatatcgaggggatcacctcgatcgaatcgatcttcgtctacagctcggtcaaggatgcgggggcctggcccgatccggcgtgacgccggcctttcgccaagatgacggctatccgggccggatccctgcggtaaggtgcttgcgagacaccgacccgcctgaagacgcgaggagcagaattcatggccgaaggaagcgaccgtcgacaggccgccgccgcgggcccggaccagcgggtcagaattacgcatatgacgtcctatcagtacgaccgtgccgtcacgctggggccccacaggctgatgctccggccgcgcgagagccgggagcacaggctgcttgccttcgatctcgacatttctccgacagcccgcgtggactggtcgcacgacgtcgcggggaatgccgtggcatccaccacgttcgagaccccgtccgacacgctgacgatccaggcccggacggtcatggaactgtgcgcgccggcctggccggtctttccgatcgcagcctccgcgatcagctatccgttcctctatgccgcagacgactggacggatctgggcgcacttgcggtgccccaatatgtcgatgcgacgggacggctgtccgactgggtcgaaggtttcgtgatgagcaggccgaccgacaccctgtcgttgctgaaagacctcagcaacggcgttgccgcccggatcgcctatgaaagccgcgaaaccgagggcacgcaggggccgctcgaaaccctggacagggggcggggatcctgccgcgattttgccgtgctgttcaccgaagcggcaagaacgctgggattcggggcgcggctcgtctcgggttatctctacgatccggccggtgatcagctgggatcggcggcggccggatccacgcatgcctgggccgaggtcttcgtgcccggcgccggctggatcccgttcgacccgaccaatcgcgcggtcggctctgccaatctgatcccggtcgcggtggcccgcaatatccagcagatcctgccgatcgcgggaagtttcgccggcgcggatgtcgaccggccggtcatggacgtcgtcgtgaaggtcgaagatctgtagacggcgggcccgggagagcggctggcgccgcctgcacccggtctcggcaggtgatgtcacaaccgttcaagacgccggcccctgacctcccctagcctcctcacgactggcggccccggcatcgaaggccgccccggatcgggaggacgagatgaccgaaaccgtcggattcatcgggctcggcgtgatgggccagccgatggcgctcaacctggcgcgcgccggcacgccgctggtggtgtggaaccgcacgcgggagaaatgcgacgccctggccgcggccggtgcccaagtggcggcaagcccggacgaggtctttcgccgcgccgatgtcgtcattctgatgatgatcgacgaggcctcgaccgatctggttctgggccgcagcgtcgcgcatttccggaccaatgtcgcaggccatgtgatcgtcaacatgggcaccctgccggccgattattccagcgcccttgcggccgaaatccgcaccgccggcgggcgctatgtcgaggcgccggtctccggctctcgcgcgccggccgaggccgggcaactggtcgccatgctggccggtgcgcccgaagacgtggcgcgggtcgagccgctgctggcgccgatgtgccgccagaccgtcgcctgcggcgccgtgccccaggcgctgcagatgaagctggcggtcaacctgttcctgatcaccatggtcaccgggctcgccgaagccttccatttcgccgaaggccatgggctcgatctcgaccgcttcgtcgaggtgctggatgcaggtccgatggcaagtgcggtgtcgcggatgaagctcgccaagctgcgggccggcgactacggcgtccaggcatcgattccggatgtgttcaagaatgcgcgactggtggccgaagcggcccgggcggctgagatcgcctcgccggttctcgacatctgccacagcctgttcggcgagacgctcgccgccggccatgacggcctcgacatggcggcggtggtgaaggcgatccaggcccggacggcggctcagcgcgccgcgaccgccccggcccagcgggcaggggtcaggccgtagccgcgcttgaaggcgcggctcatatggctctgatccgcgaaacccgcgtccagcgcggcttccgacagcgccatgccccgcctcatcgccgcccgggcgaggtccagctggcgcatggtgcgatagcggctggggctggtgccgaaggcgcgccggaactgacgggccagcgtccagcgatccaggcccgaaacggcttccagggcagcggcggtgtggcgagtggcgggatcgtcggcgatcagccggcgcacccgctccagcgccgcgaccggcagccggccgcccggggccgcttgcgggatggaaccatccagccggcccagcatatccgccagaccgccgaccagttcggcgctctctatgtctcccagcggcgcatccagatcggccagcccctgcaacaggaccggatcgatcgccgtcgcgcccaccaccggatcggcgatgaaaggcagcggccgaccgtccagcgccgccaggatcagcgccgggtcgacatagaggatgcgatagccgaagccaccgggcgcaccggcggccccgtcatgcatctcgtcgggatggagcacatgcatctgcccggcaagacaggccctgcgggcaccgcgatagcggaagctctgcacgccatgggtggtgatgccgatcgcataggtgtcgtggcgatggggcgcgaaggcccggccgtcgaaggccgcggccagccgctcgacgcccggcgcccctgcgcccatgcgcagccgcacccccgcctcggcggcgggagccgcatccagccccggcagcggggcctctggtccagggttggcagataggtcagtcatactgccatactacccccgtcttcgttcagcgtacaggagccggatcgatggccgctctctccagcctcgccctgcccgggcctgccgccctgcccgagcttgccggatttgccgccgcaagcctcgcgatcaccttcagcccgggccccagcaccatcgccatgacggcaaccggcagcgccttcggtctggcccgggccgtgccctatgccctgggcagcgcgctcgggacgatctcggttatggcggcagtcgccgccggcctcgcctcgctgctgctggcggagccggccgtggcgaccatcctgctgatcatatcggccggctacatcctgtacctggccctgcgcatcgccaccgccccgcccccgggcgtacccgaggccggcagccgcccgccggggccggccggcggcgtggtgctggcggtcaccaaccccaaggcctggctcgccttcgctgccctcttcgcgggcaccggcaccacaccgggcgagatcgggccgcggatcctgatcctggcggcctcgatcttcgccagccatgtcgtctggctgctgctcggcgccggcttcgcccgcctgctccgccggccgcgggtgtcgcgggcggtcaatctggtgctggcggttctgctggtgggatcgatggtggtggcggtcagggggtgagggtggggactcagaggtctgcgagaagacgctcgatatcctgccgcccgtggaggaggcgcagaacgaacacgttcccgtccggccgtcgcgtatagacgatcacgtgacggcgataccccagcatacggaccggcggcctgaactcggggcggacccgccccatttccggatgctccccgatcaaaagcagaaggcgcgaaaggcccgcctgatagtcttccgcctgacggacgccgaattgagccattccgtaggcgtaagcggcgaggatatcttctaccgcagcacgcgaaagctcatagcccattgtctgccgacagagcagcccgccgccgagcttccgtcagcacgtcctgcatggacaggccgctgctgccgctcgccaatccctcgtctatcaggcgctggatgtcggcaagtgcggccctgcgttcctgatcccgtcggatgaggtctcttatatagtcgctggcgtttccgtaccgcccgctctcgacctgtccttccacccagatcttcatctggtcggtgaccgacacattcatcgtcgccatggccataccccctcagttcgggaagattttggcataaattgccaaagactgccactgaccaagggggacggaccggcttcggtcagtctgccagctcgccggtcgccacgacattggcataggcaaaacccaacgccgccatgaaggccgcatggacctgggcggccgggaccgtcacgccaccgaattcctggtcgcgggtggcgcaggcatcgtgggcgacggtgacctcgaagcccagatcgcgggcggcgcgggcaccggcatcgatgcacatatggctcatggcgccggcgatcacgacctgatccacgcccatctcgcgcagcagcgcatcgagcccggtctcgcggaaggcattggggaagtgcttcagcaccaccggctcgccctctgccgggctgacgctgtcatggatgcgggcaccgtcggagcctgccgcgaagaagggggcgccctcaccggcaaattcgtggcggacatggatcaccggctcgcccgccgcgcggaaggtggcgatcagccgggcgacattggccgccgcggcctcgatgccgaccagcggccagcggccgcccgggaaatagtcgttctggacgtcgatcacgacgagggcgcgcttgcccatgatggctgcctcctgacaggggattccgcccggacgcgcccgggcagtgatggacaggctagcgggatgcaggcaggctgtggattggcggaaccgacattcagagaggcaaaaccgacaaatggccgaggccctgccggagctgatcgaaatcggcctcctgctctatcccgaggtccagcaggcagcgatccacgggctcggcgatctgatcctgatcgccgaccggctgcgcgcggaagatcagcctgcggggccggcgctccgcctcagccactggcaggccgatgcggccggtgcggtacggcgggtcttcgacagccatcccggccgccccggccggccggcggccctgatcctgccgcccagcctggcggcgccgatctcgcccgaagccgccgcaccgctggcccgctggctgaccgcccgccatggtgacggcgccgtgctgtgctcggtctgcgccggcgccttcctgctggccgaaaccgggctgctcgacggccgcccggccaccacccactggaattatcacgaccacttcgccagccgcttcccggccatccgggtcgataccgcccggctgctgatcgacgacggcgatctgatgaccgcgggcggggtgatgtcgtggaccgatctgggcctggcgctgatcgcccgcctgctggggccggcgctgatggtgcgcaccgcccgcttcctgctgatcgacccgcccggccgcgaacagcgcgcctacagcctgttcgtacccaggctggaccatggcgatgcggcgatcctgaaggtccagcactggctgcaggcaacgggggcgcgcgaggtgcggctgcccgatctggcggcacgggcagggctggaggaacgcaccttcctgcgccgcttccgcaaggccacgggcctcaggcccgtcgagtactgccagcatctgcgcatcacccgcgcccgcgaacggctggaacgaagcgccgacaccgtcgaccgcatcgcctgggaggccggttacgaagacccggcatccttccgcaaactgttccagcggatcaccggactgacgccggcggcgtatcgggagaggttcggggtgggcgccggccccgcctgaccggggccgcccgacccgcgggcggcggcaaattcgtggtgcgagaggggggactcgaacccccatacctttcggtggtcgattttgagtcgactgcgtctaccgattccgccactctcgcgcgccggtgcagctcgtgccgcatgagcatagccaagtgctgcggcaatgcaacagatcccgaggatccgtcgtctcgacgtgccaacggaggttgcagggcggttccggcgggtcggttatctgcccgtcgctgttgacaaaggacgcgcgacacatatagtcgcggggtcccgggcagcggcggcgatctcacagtcggcgccgacccggtcgctttcgtccgcaacccgaggcgggacacccgatgatcgcagacggcaggtcactgcccgagcggtgccggggaaaccgatcggcgggtgacccgcgggtgtaaccactccaactgttccgcgccgcgagccggccgggcggaccgcctgacggcggaccaccggatgggcggcgtgatgacgactatcgggaagatcgatcatgttcgcggtcatcaagacgggcggcaagcagtacaaggtcgcggagaacgacgtcatcgccgtggagacgctgggcgtcgagccgggcgcgacggtcgagttcgagccgctgatggtcggcaccgccgatggcgtgaagatcggcgccccggtcgttgccggcgcgaaggtcacggccgaggtcgtcgacctggtccgcacccgtcgggtgctgatcttcaagaagacccggcgcaagggctatcgtcgcctgaacggtcatcgtcagagcctggcgaagatccgcgtcacctcgatttcggcctgatcccgtcaccgcggcgttgacgtccgcgacgggttccagacctgacagctctcccagcaactttccccgttcgcggcaatccggccccggacgggcatcacggaggtctccgagatggctcataaaaaggcaggcggcagctcccgcaacggtcgcgacagtgccggccggcgcctcggcgtcaagaagttcggcggcgaagccgtgatcgccggcaacatcctcatccgtcagcgcggcaccaagtggtaccccggccggaatgtcggcatgggccgcgaccacaccctgttcgccctgaccgacggcaccgtgaccttcagccgcggccgcgacgaccggaccatcattcacgtcgagccggcgcaggcctgatccaggccggccgcccgacgcgagacatgccggaaccgacgcgcgcccgggccttgaggtcacggctggtcgtcggttccggaaatgcgacacgagggggatggctcggccatcccccttgtttgcgttcccgcccatcctcatcttgcaggcgaacggcgctcccgcccatgatcgggccatccgacgatcgggaccgtccgcccttcgaaagtcgcccccggtgaagttcctcgaccaggccaagatctatgtgcgcggcggcgacggcggcaatggctgcgtcagtttccggcgagagaagtacatcgagttcggcggcccggacgggggcgacggcggcgatggcggccgcgtgatcgcggttgcggtcgagaacctgaacacattgatcgacttccgctatcagcagcatttcaaggccggtcgcggcgtccacggcatgggccgcaaccgccacggcgcccgcggtaccgatgtcgagatccacctgccggtcggcacccagatctgggacgagcatggcgagcggatgctgatcgacctgaccgagccgggcatgcgggtgctgatctgcgacggcggcagcggcggcttcggcaatgcccggttcaaatcctcgatcacccaggcgccccgccgggccaatcccggcaccgagggcaccgagcgctggctgtggctgcggctgaaggtcatcgccgatgccgggctggtcggcctgcccaatgccggcaaatcgacttttctggccggcgtcaccgccgcacgccccaagatcgccgactatcccttcaccacgctgcaccccaatctgggcgtggtcaggaccggcgacgaagaattcgtgctggccgacatccccgggctgatcgaaggcgcccatgaaggccatgggctcggcgaccgcttcctgcgccatgtcgagcgctgcggcgcgctgctccacctgctggatgtcacggccgaggatccggtgaaggattaccggatcgtgcgcggcgagctggaagccttcggccacggcatcatcgacaagcccgaaatcgtggcgctgagcaagatcgacgcggtcgacgacgacacgctcgcgctggtgaaggaccatgtcgaagaagagctgggccggccggtgctggcgctttccggcgtgtcgcgccggggcgtgaccgaggcgctgcacgcccttctcccccatgtccatgcggtgcgcgaggccgaacgcgaggcgcgggaacgccagcgccgcgagttcggcgtgatcgaggatcccgtcgacgcctcggcccagaagcgcgcgcccctgctgcgcctgccgccgccggaagacgccccggccgaaggccgcgcccgcgccggcagctcggatctcttcgacgaatacgaagacctggtcgacggcctggaagccgatcgcctggtcgtcaccgcctcggacgacgaggactgggacgattgggatgacgaggacgagagcgacggggacgagagcgacggggacgagagcgacgaggccgaagacgagatcgacaccgacgaggatgacgacctcgacgcggatgaggatctcgacgacgaagacgatctcgacgacgaagacgatctcgacgacgaagatttcgaagacgacggcgaagacgaagacgagaacgaagacgggccggcagatgacggcgaggatggggacgcccccgcccgcgggaggaaacggtgacgatcgccggaaccgacctggccgacacacccgccgcggcgggcctgcgtgccgcgaagcgcgtggtgatcaaggtcggatccgcccttctggtcgacgaggccaccggccggctgcgtgacacctggctgcagagcctggccgacgacatcgcgcgaatgcgcgcccgcggccaggaggtgatcgtggtctcctcgggcgcgatcgcgcttggccgccgactgctggggctcggccagggcgtgctgcggctggaagagaagcaggccgccgccgccaccggccagatccgtctggcccatgcctatgaaaccgtcctcggcccccacggcatacaggtcgcccaggtgctgctgacgctggaagacagcgaagcccgccggcgctatctgaatgcgcgcgccactctcggcaccctgctcaagctgggggccgtgccggtgatcaacgagaacgacaccgtcgccaccgccgagatccgcttcggcgacaatgaccggctgtcggcccgggtggcagaaatggcatcggccgatctgctgctgctgctgtcggatatcgacgggctttataccgccgatcccggcgtcgaccccaccgcgcgccacatcccgcgcgtgccgcggctgacgccgcggatcctggccatgggcggcggctcgcgttcggccgtcggcaccggcggcatggcgacaaagctcgccgctgcccgggtcgccggtgcggcgggctgcgccatggtcatcgcgctcggccgccatgtcgggccgatcagcgcggtggaagcaggcggccgcgccacctggttcgaccctgagaccaccccccataccgcccgcaagcgctggatcggcggcaggctgagcccccgcggcacgctgaccgtcgacgagggggcggtgaaagcgctcgcccgcggcggcagtctgctgcccgccggcatccggctggtgaccggccgctttcagcgcggcgacgccgtggccgtggtcgaccccgccggccgcgagatcgcccgcggcctggcggcctatggcgatgccgatgcccgtgccatcgccggccaccgctcggcggagatcgagcagatcctcggcttccgcggccgggacgaaatgatccatcgcgacgacctcgtcttccatggcggcgacatgcccgccacgaccggagacgacacggaggaggcccaagcgtcatgaccgacaccctgagcaccgccgcccggaccgtttcggccgctccggtcgccaccccggccgaaccggcaggcacccatgctccggtggacgccgccgccctgatcgccgatatgggccgccgcgcccgtgcggcgcagcgtgcgctcgcccaggcgacgcccgaggccaagaccgccgggttgatggctgcggccgcggcgatccgcaacgccgtgcccgccatccttgccgccaacgccgaggacatggccgccggtcgtgcccgcggcctgaccggtgcgctgctcgatcggctggcgctggacgagggccgcatcgcgggcatcgccaagggtgtcgaggatgtcgcccgcctggccgatccggtcggccatgtcatggaggaatgggatcggccgacggggctgcatatcgcccgcgtccgggtgccgctcggcgtggtcggcgtgatctatgaaagccgacccaatgtcaccgccgatgccggcgcgctctgcctgaaggccggcaacgccgtgatcctgcgcggcggctctgagagcttccgctcgtcccgcgccatccatgccgccatggtcgagggcctgacgtcggccggcctgcccgccgatgcggtgcagctggtgccggtcaccgaccgggcggcggtgggcgccatgctcgccgcctcggggctgatcgacgtcatcgtgccgcgcggcggccgttcgctgatcgagcgggtccagaccgaggcccggatgccggtcttcgcccatctcgaaggtctctgccacgtctatgtggacggcgccgcggatcccgagatggccagggcgatcgtgatgaacgccaagctgcgccggaccggcatctgcggctcggccgagacgctgctgatcgatcgggacgccgccccccggatgctggcgccgatcgtgacggcgctgctcgacgccggctgcgaggtccgcggtgacgaggcagtccaggcggtcgacccccgtgtggtgccggccaccgaagaggactggcggacggagtatctggacgccatcatctcggcccgggtcgtcgacggggtcagcggggcgatcgatcatatcgaggcctatggctctcaccacaccgacagcatcgtgaccgacgaccaggcgaccgccgaccggttcctggccgaggtcgacagcgccatcgtgatgcacaacgcctccacccagttcgccgatggcggcgaattcggcatgggggccgaaatcggcatttccaccggccgcatgcatgcccgcggcccggtgggcgtcgaacagctgaccacgttcaaatatgtcgttcgcggccagggcacgcttcgcgcctgagcgggcggtccccgatgcggccctgggcgacccgctgtggcgggccgcgggccgccgccggggcatgacggtgggcctctatggcggatccttcgatccggcgcatgagggccatgtccatgtcgcgctgcgggccctgaggcggctcggcctcgacgaggtctggtggctggtgagcccgggcaacccgctgaagctgaaggcggggcgggtgagcgcgccgctcgccgaccgggttgccggtgcccggtccctcgcccggcatccgcggctcagggtaaccacgatcgaaagccggctcggcacccgtttcactctcgacacggtgcgtgccctcaaggcccgccgcccccatatcagattcgtctggatcatgggggccgatggcctggcggagctgcaccgctggcgcggctggcgggagctgatggcagagctgccgctgctggtgatcgatcgtcccggctatggcgcccgggcagcggccgcccccgccgcccggcgcttcgcccgccaccgcctgcccgaggccagggcccgcgccctgccccggacggcaccgccggcctgggttctgctgcatggcaggctggacccacgttcggccaccgaaatccgcgagggcaggcggccgcggccagcggctgccccacctcgccggcccccacctcgctagaccatcgcgaaaagccgcgatgcctgttatggttacaccatggcgcctgcggggttcgcggtcggccgctccggcgacccgccgctcctgaccccgcccccgccaacgcttgatgaggttcgctctgttgcagaccgacagtcccatcacggtgcccgcgacgccgccggcaccgctcagcgcagaccaggtgctcgatctggtccgcgcgtcgctcgacgacgacaaggccgaggacgtcgtgatcatcgacctggccggcaagaccgatttcgccgactacatggtggtcgcgagcggccgatcgagccgtcacgtcgcctcgatcgccgaaaagctcgagatgcgcatcaaggcctccggcgatcagctgccggtgaccgagggcctgcccctggccgactgggttctggtcgatgccggcccggtggtggtgcatcttttccggccggaagtgcgcgccttctacaatctggagaagatgtggggcgccagcctgccgggcgacggcgcccagcgcgtcgccgagtgacgggcgccatccggcgcggtgtcaccgcgcggtccgggccgggccgcgcggggctgcaccttgcgccccttgaccttctcccccgcaggccggaacagaacccggcccgcacggccaggcctgcgccatgagcctgatgctgaaggtgacgctggtcgcggtcggccgcgcccgcggcggcccggaagcggccctggtcgaggattacgtccggcgcctgcgctggcccttcaccctggtggaagtccaggcccgcaaggccaccctgcagggtgaggcgctgaaggccgaagaggcggcggcgatccgcgcaaaactgccccagggcgccgccctggtggcgctggatgaacgcggccgtctgctcgacagccgcggcttcgcggcagcgctcggcggttttgccgaaagcggccggcgcgaggtcgccctggtcatcggcggtgccgacgggctggacgcctcgctccgcgaccaggcggatctcgtcctcgcgctcggccgcctcaccttcccccacatgctggtacgtgcactgatcgccgaacagatctatcgtgcgcagaccatcctcgacggccatccctatcatcgggactaggccgccgagccagcgccagagacccgggggatccatggaattcgacatgcgccgcatggcggcacccgaccgctacaagattctgggatcgaccatcactccccgcccgatcgcctggatcacctcgctgtcgaccgaaggccgggtgaacgccgccccctacagcttcttcaactgcatgggccacgagccgccgatcctggcgatcggcatgctccgccaccccgaagaccggttcaaggacacgcccgccaacattctggcgacgggcgagttcgttgtgcatctggtctcggaagctgtggcgccgcagatgaacgtcacctgcatcgatgccccgcccggcgtggacgagctggcgctggccgggctcgacaccctgccctccacggccgtgcgcccgccgcggatcgcgaccgccccggtcgccttcgagtgccgcctgcacaccgccgtcaccaccggcccccgccaggccatcatcctgggcgaggtgctggtcgcccatgttcgcgatgatgcgatcctggatgccgcccgccaccatgtcgacacccccgcccttggtctgatcggccgtatgcatggcggcggctggtacgcccgcaccaccgacctgttctcgatcgaccgtccgcaatggtcgagctgggcgccggagcatcccgaggcggtggcccgggcgacgcccgacggcgcggctgtacgggacgattgaaagggcacattcccggatcagaccgtcgtgacaagccgggggcatgtccccccggcctgtgatccgggcccccaaccccctatatgtagagcggaaaacctgatagaagcaggaccgttcacgaccgcctgcgccgatgttgcccgaggatccgagccccatgaccaccgcccatacgcagccgccgcgccccgtcgttctgtgcattctggatggttggggttatcgcgcgcccgccgacgacaatgccatcgcgctcgccaacaccccaaattgggaccggctgacctcggaacagccgatggccttcctgaacacctcggccgaagaggtcgggctgcccgccggccagatgggcaattccgaagtcggtcacctgaacatcggtgccggccgggtggtgatgcaggaactgcccaagatcgataccgcgcttgctgacggcagcctggcaaccaatccgcggatgaccgggttcatcgcggcgctcaaggcatcgggcggcaccgcccatattctggggctggtgtccgatggcggcgtgcacagccatcaggaccatatcgccggcatggcgaagatcatcgcgggtgcgggtgttccggtccgcatccatgccctgctcgacggccgcgataccccgccgaagagcgcgcctgagttcatccgccggctggaagccgcggttgcaggcgcgggtgacatcgccatcgccaccgtcggcggccgctattggggcatggatcgcgacaagcgctgggaacgggtggtccgcgcctatgacgtgatcgtgaaggccgagggcgaccgtttcgccacggcggaggaagcggtcgccgcggcccatgccgccggcaccaccgacgaattcgtcgatccggcggcgatcggcgactatgccggcgtgaagccgggcgacgggctgctgatggcgaatttccgcgccgaccgcgcccgcgagatcctgcatgccctgatcgaccccgccttcgacggcttcgaacggaccatccgccccgatttcaccgccgtgctgggcatggtggagtattcctcggcgctggcgaagatgatcccggccctgtttccgcccacccagctgaagaacattctgggcgaggtggtggccaaggccgggcgcaagcagctgcgcatcgccgagaccgagaaatacgcccatgtcaccttcttcctgaacggcggcgaagagcagctttacgagggcgaggagcgtatcctggtcccgagcccgaaggttgcgacctatgatctccagccggagatgtcggcgccggaagtgaccgcgaagctggccgaggcgatccgctcgaagcgtttcgacctgatcgtggtcaacttcgccaatggcgacatggtcggccatagcggcgttctggccgcggcgatcaaggccgccgaggcggtcgacgcagcgctgggcgaggtggtcgcggccctggacgaggtcggcggctgcatcctgatcaccgccgatcacggcaatgccgagcagatgttcgaccccgagaccaacggcccccacaccgcccacaccaccaatgtggtgccgctggtgctggccggggccggtgcgcccaagggggtgagcctggatgacggccggctggccgatcttgcccccaccgtgctgaagctgatggggctggcccagcccgcggagatgaccgggcgggtgctgatccacgacgccgccccggcccgccgcgcggccggcgcctgatcccatgtcccgacgcgaccgtcgccgccgcgcggccgcggtcgcgctttccctgtccctgatcctgcccggcccggtctggccgggctgggtgcggacggcgcgtgccgaggatccgccgagcggccgagaccttcaggccaccgagcgcgcccgcgacgaagcccgcgcccggcgggccgagctggagcgccgcgccgcggatgcccgcgccgaagccgaagccctggggctgcaggcacgggaagcggccgccgctgttcagcgccaggaagcggcccttgccgaacagcgcgatgcccttgcccggctggaggccgaaatctcggcccgcgagaccgaacttcaggttgaacgcgcccatctgggccggctgaccgaagccctgatccggctgcgccgccagccgcccgaagcgatgatcgcccgcgacggcccggcgaccgcccccatccatgccggcatcctgatgggtgccaccctgcccgagatcgaggcggaggcacaggcgctgcggagcaagcttgccgacctcgccagtgccaaggccgaggccgagcgccagcgcgagcgtatcgccgccacccgcaccatgctggagggggaacgggtccggcttgcaaaactgatcgaagaccgccagggccgcgccagcgcgctggacagcgaggcgacccaggaggcaagccgtgcccgccagctggccgaacgggccgacggcatccgcgacctgctggtcgccctggaagccgagcgcatgcagaacggcccggtggtcaagccggcaagccccgaggcccgggccggggtgatcccgcgggcgaagccgaaaccgcccccaccgccgccgcctcccccaccgccgcctcccccgcggcaggttgcggtcgccacgcccccgccaccgcctcccccaccgacagcggccccggccaccaaccctggggcaccgccgcgcgatccggtgatgccgcgcgtcgccggcaccccgcccgaacgccaggtggccgccatccccgcccccggtgccggcatcgcccggcggctgccggtgtcggggcggatcgtctcgcgcttcggcgatgtgcatgaaggccaggagcggccgggcatcacctatgcaacgccccccggtgccaccgtcctcacgccctttgccgggcgggtggccttcgccgggccgttccgccattatgggctgctcttgatcgtggaacacggcgacggatatcatacccttctcgccggcctcggccggctcgacgcccgtgtcggcgatcgcgtcaccgccggcgatccgatcggcgccatggccgacgggggcggaaccgcctatctttatctcgaggttcgccgtggcggcgatccggtcgatccggcgccgcttctcgcccgcgccaacggaggctgaagccgcatgacggcagggacgacaggtcgaaccaggaatgaggccggaacaccggcaggcggcagacggtcgacaggaaaggtcgggacgacgatgcgacgcggattcgtcacggggctggtgagcctcgtggtcctctccctgcccctggtgggcagcgccgccaaccgggacagctacaaccagctcaatctgttcggtgaggtgttcgagcgcatccgccgcgactatgtcgagccggtggacgacgagaagctgatcgaggcggccatcaacggcatgctgcagtctctggacccgcattccagctatctggatgccaagggctatcgggacatgcaggtccagacccgcggcgagttcgggggcctcggcatcgaggtcaccatggacacccagctgggcctggtgcgcgtgatctcgccgatcgacggcagccccgccgacaaggccggcgtgaagccgaacgacctgatcgtggcgatcgacggcgagcaggtgcagggcctgaccctggccgatgcggtggagcgcatgcgcgggcccgcgggcagcaatatcgtggtcacgctgcgccgcgagggcctcgcccaggatttcgacgtgaacatcacccgcgcggtgatccccgtcgatgcggtgcgggtcgaagccaagggctcgatcggctatatgcgggtgcgcagcttcaacgagcggaccgacgagcagctggaagacggcatcgcgaagctcgagcgcgagaccggccatatgaccgggctgatcctcgatctgcgcaacaacccgggcggcctgctcgaccaggcggtggcggtgtccgacgccttcctggaacagggcgagatcgtctccacccgcggccgcgatccgcaggcggtgcagcgcttcaatgcgcgcgccggcgacgtgatccacggcctgccgatggtggtgctgatcaatggcggctcggcctcggcctccgagatcgtggccggcgcgctgcaggatcatggtcgtgccgtggtgctcggcaccaaatccttcggcaagggctcggtccagacgctgatcccgctgccgggtcacggcgccatgcggctgaccacctcgcgctactacaccccctcgggccggtcgatccaggccaaggggatcgagccggatgtggtggtcgatcagccgatcgtctcaccgctgggcgtggtgatccatccgcgcagcgaggccgatctgcgcggtcatctggaaaacgaccaggagccgacgaccccggccacggcgctgcccgacgatgcgaagccggaacaggtgcagccgggcgctgcaaagccgggggatgcaaagccgggcgccacggcccccggcgcccagccggcggcaccggtcggcaacccgccggtgccgggcagtgacgaggattatcagctgcagcgggcgctggaactgctgaggggcgttgccctgttcaaccgccagcgggacaacgcgctcgccctgaacggctgatcatcggacggccgggcgcgacggacggggacggatcatggccgcaggatccaaacgcaggcgcgaccagccgaccgccgcaagcggccggggtgatggtgcgcgcacgatctggaccatcaccggcctgcttgcgcttgccggtgttgcggcggccgggctgatcgcgcttgccgccgcccggcccgatccggaaaccgaggcgcagaagcaggcagagcggaatctgccgcagatcgtgctgccgatgccggccttcaccgacccggccccgcgcggcaacccgatccaggccagccgcgaggaaccgctggcccgcgatacgctggcgacggtgcgcgaggcggcgaaccagccgcccgcaaccccgccgccaccgccgccgcccaccgcaccggatgcggcggtgaccatgacgccggcccccgcccccggcctgacccaggaaagcacccagggcccgctgccggtgcgcggctccgacggagaggcgccctggcaggtttatgcccgccccttcgatcgcagcgatgcccgcccccgggtcgggctggtgatcggcgggctgggcttttccgagacggcgaccaaggcggccatcgatctgccgggtgcggtgacgctggccttctccccctatgcgccggaactcggccgctggatcggccttgcccgtcaggccggccacgaggtgatgatcgaactgccgatggagcccgacggctatccgcgcaacgacgccggccctgctgccctgctgacgacgctggagcccgcccgcaaccgcgagcgactgcaatggacgctgagccgggtgaccggctatgtcggggtgaagccgctgatgggcgaccggttcatgcgctccccccagcatctccggcccgtgctcgacgagctgcaggagcggggcgtgatgatggtggtgcaggaagaaagcgacaccgatgtcggcgcggcactcgcccgcgagatcggcgtgccgcgggcgaccgcgcggctgacggtcgacgccgtggcgacgcctcaagcgatcgatcagcggctgaatgcgctggaaagcctggcccggcgcgagggcaaggcgctggccgtggccgatgcctggccggtcaccctggaacgggtggccaactggatccgcaccatcgaaagccgcggcgtggccttcgcgccggcaacggcccttgccgaggcgccgggccttgcccccgatggcggtgcggccccgccggccgtgtcgggccctgcctcgacaccggccaccacggcgccggccgaaagcaccccggccccggccagcgacgcccatgcccctggcggcgcggcccatggtggcgggcattgagcaagtgactgcgccgcgcacaggcatgtggcgcgccctccccaagatcaccccccaagatacagtcgtcccggagaacatcatggccgcggatcccgccgatcttccctatcgtccctgcgtcggcatcatgctgctcaaccccacccgcgaggttttcgtgggccagcgcatcgacaccacggccgaggcctggcagatgccccaaggcggcatcgatcccggggaaagccccgaggtcaccgctctgcgcgagctgaaggaagagatcggcaccgacaaggcccggatcctcgccgaaaccgccgactggctgacctatgacctgccggcggagctgatcggcaaggtctggggcggcaggtatcgtggccagcgccagaaatggttcgccatggacttcctcggcaccgatgccgatatcgatcttgccaccgaacaccccgaattcgaccgctggcgctggctgccggcgcaggatcttccgcggatgatcgtgccgttcaagcgcgccctttatgaacaggtgctggccgaattcgaccatctgctgcgctgagcggcggcaggcggcgggcatgttcaccaccttcaggtgacgtgcccattgacgcggggggccggctcgttcaccgttatatctgcccagatatagcggagccccccatgaaagcctttctgaccggcctgctgcttgccgcccttgccgtcaccaccagccagagccgggcagaggccgcggaccggccattgctggtttttgccgccgccagccttgccgaggtgatggatgaagccggcaagggtttcgtggccaaaggcggagaggcgccgcaggtctcccttgccggatcgggcacgctggcccggcagatcatcgccggggcgccggcgacgctgttcatctccgcccatcccaaatgggtcgacgaggtcgaaaaggccgggctgacccgcgagatccgcccctatgccgccaaccgggtcgtgctggtggtggcgaaggacagtgcggccaccccgcccgccgatgacggcgatgccgccttgtccgccgccatcgatgcggtgatcggcgccgacggccggctggcgatcggcgatccggcaagtgtgccggccgggcaatatgcccgcgacgccctcacctcgctcggcatctggtcgaagatcgagccgcgtaccgcgccggtcgagaatgtccgggtcgcgctgtcgctggtggcccgtggcgaggcgccggccgggatcgtctatgcctcggatgccgcagccgaacccgatgtgaaggttctggcggtgctgccggaacggctgcaccagccggtgcgctatccggcggccctgctgggcggcgccgatgaagaggcagcaccgtcggcggtcgccttccttgactacctgacaggtcccgaaggggcggatatcctgcgcaggcacggattggagccgatcgcgaagtgacctgcacgccccggaacatcggcaggacgacggcatgaccggctggcccggcctggactggatgggcctggactggatgggtcccgccgaacgcgatgccatcctgctcagcctgcaggtggcctcggtggcgctcgcctgtctgctgcccgtggcggtgatgctgggctggatcctggcccgctggaaatccgaggcacgggtggtgctggacgtcatcgtccacctgccgctggtcatgccgccggtggtgaccggcttcctgctgctgctggccttcgggcgcaaggggccgatcggcgccgtactggaccaggtcttcggtctggtcttcgcctttcgctggaccggcgccgcccttgccgcggcggtgatggccctgcccctggtggtccgcccgatccggctggctttcgaagcggcggatccgcggctgaccgaggcggcctccagcctgggcgtcccgccctggcggtcgtttctcaccatcaccctgcctctcgccctgccggggattctggccggcatgatcctgggcttcgcaaaatgcctcggcgaattcggggcgaccgtcactttcgtgtcgaacatccccggtgagacccgcacattgtcgctggcgatccagaccctgctgtccgccccgggcggcgacgggccggcgctgcgcctggcgctggtcgggatcgtgatcgccgtcgccgccctgatcctggccgagatcgtgacccggatcatgcgccgccggctcggcctcgacctgccgcggtcgcgacggtcgcgaggcccggcatgacgatcgccatccgcatcgcccatcggctgaccgccggcttcgcgctcgatatcgacctcgctttgccggcccatggcgtcaccgcgatcttcggccgctccggtgccggcaaatcgacgctgctttcggccgtcgcgggcttcctgtctcccgaagacggccgcatcagcatcgacggcacaaccctgttcgatcgcgccagcggtaccaaccttgccccgcacaggcggcgggtggcggtggtgtttcaggatgcccgcctgttcccgcatctctccgtccggcgcaatctggattatgcccgccgccatggcccggcgcggccggccatcgggcggttcgatgcggtggtcgatcttctgggactggaggcgctgctggaacgcaagccgcgcacgctctcgggcggggaggcgcagcgtgtggcgctgggccgggcgctgctggcggagccccggcttctgctgctcgacgagccgcttgcggcgctggacggcgcccgcaaggacgagatcctgcccttcctcgaccgtctggcgcgcgagggagaggttcccatgctctatgtcagccacgccctcgacgaggtcatgcggctggccgaccatctggtgctgatggaagacgggcgcgtgatcgcgagcggcggcacaacccgggtgaccgccgatccggccctggcgcggatcgcaggcgaggctgcgcggggcggcgtgctcgatctgctggtcaccggcctgccggatggcgacggactgctggaactggccgtcggccagggccggttgcggctcgccgccggtccgacgccaccgccgccaggcaacatgatgcgcctcagggtggcggcacgcgacgtcgccctcgcattggatggtgcggcactcgatgccgccgggctcagcatccgcaaccgcctgccctgccgggtgaccgcggtgacgcaggaagcggacgggctggtggcggtggccctggagatcgagggcacagacactgatggaggggagagcggccgtctgctcgcgcggatcacacctgccgcggcgcgggatctgaggctggagcccgggcgacccgtgctggccctgatcaagaccctggctctggggacgtagggcctgggggtacagggtccggggatacagggtccggggagatagggtctgaggataccgggctgaccggccccgccagatccgcgaagcgggcaagaggcgcctcggcggccgccgaggctgcctccagcgcggcccgataggccgccagcacggcatgtccggtctctgtcagcagggcaccgccgccgccggcgccgccggcctgacgctggaccagcggcgcggcgaactcggcattcatggcctcgatcagccgccaggcgcgcgcataggacatgcccatctcgcggccggccgccgcgatcgatcccagagcctcgacatgggcaagcagggcggccttgccaggtccgaaccggcggccgcccggcagatcgatgcgcagggacagggtgccagagggcaggttggcaggcgccgcctcggccatcaggcggcgcgccgctccagccagccgaccttcttacgcatcagccaccaggatgcatcgcccagcagccgggccacccggctctgcggatccagcccggccgccttgcaggtcatcatgaccgcgcgctcgacatgcgggcgcttgtacatgccataggcacgccggctgtaggcggcgatgcaggcggagcggtcatagggtccggcaagcccgttggcgcagtgataggcataggccagttcgtcatcctcggtctcgcggatgcggctgagcgcgatcatcagccggcgggtcgggcccagctgctcccgctccagatagcggttcaggtggttgtagaacagcttgtaatggcgcagctcgtccgcccggatgcgcatggcgatggatttcaggaccggttcttcggtcgcggccgccatggcgccatagaaggacgaggtgccgacctcgacgatgcagcgggcgaccagctcccccgaacgtgacccgcgaatcgactgcttggcgtcgagcggcagggtgatgtcacgcgtgaagcgggcgaaggcgtcatcgaagtcgaaggtcggatcggcgtattcggcccagcggcggagggcgcggccgtgctgcacctcctcttccgcccagtccttcgcggcctggcagaagtcgggatcatcggcgaacacgctgcacagataggccgcgtagtcgtagccgttatgctcaaccagcgcggccgccttcacggccttcaggatctcggggtcgaccttcgaggggtcgaagtgctcccaggcgatgtcgtcgatcgtccaatgtttcatagggcttacccgcgtcaatccggttcacgcaaggcagggacagggggccatatttccctccccaccgctcgtatgcggagcgttggcggcgcatctcttaacaagtggtgaacgcttcaccaaggtcaaggccacatcatctattgccatcctgaccgaaaaggcaccggttgcgggtgacaaaaaaagagcgaccgcccccacgggacggtcgctcttttttcacggaacccgcacggcatcgcgtgatgccggcagcccctatgtcgtcatgcgccggacggtcaggcgaccgcctggagcagggcctcggcctcggcgatcttccgctcggcggagaggcgctcggcctcgtcgcgcgccagcgagagatcctcacgagccgccttggcacgggcctcggcgtcgccgcggttgacgtccttgaggttgagggcgtcctcggcgagcacgatgcagctcgcttcggtgacctcgaccatgccgccggcgacgaacagacgatcgacgaccgtctggccctcatagacctcgatcacccccggacgcatggtcgcgatcaggggtgcgtggccgggcaggacaccgaaatgtccctccgacccggggacgacgaccatgtcgacatcccgggccaggagcagacgctccggcgacaccagctcgaacctgaccttgtccgacatcggtcagcgcctttctcgtaggtgggcgggccgttaagcgtgacgaaaggctgcggctcaggccgcggccttcgccatctcgcgggccttctcgatcgcttcttcgatcgaacccaccatgtagaacgccgcctcgggcaggtcgtcgtgcttgccgtccacgatctccttgaagccccggatggtgtcctcgagcgagacgagcttgcccgggaagccggtgaagacttcggcgacgtggaagggctgcgagaggaagcgctggatcttacgcgcacgcgcgacgaccagcttgtcctcttccgacagttcgtccatgcccagaatggcgatgatgtcctgcagcgacttgtagctctgcagcacgcgctgcacttcgcgggccgtgcggtagtgctcgtcgccgacgatacgcggatcgagcatgcgcgaggtcgagtcgagcgggtccaccgccgggtagatgccgagctcggcgatctgacgcgacagcacggtggtggcatccagatgggcgaaggaggtggccggcgcggggtcggtcaggtcgtcggccggcacgtaaatcgcctgcaccgaagtgatcgagcccttgcgggtcgaggtgatccgctcctgcagacgacccatttcggtcgccagcgtcggctgataacccaccgccgaaggaatacggccgagcagcgccgacacttccgaacccgcctgggtgaaacggaagatgttgtcgacgaagaacagcacgtcctggccttcctcgtcacggaagtactcggccagcgtcaggccggtcagcgcgacgcgggcacgggctcccgggggctcgttcatctgaccgtagaccagggccaccttcgaggcgcccagatcgtccggcttgatgacgcccgagtcgatcatctcgtgatagaggtcgttaccctcgcgggtacgctcgccgacaccggcgaacaccgacacgccaccatgggccttcgcgacgttgttgatcagctccatgatcagcaccgtcttgcccacgcccgcaccaccgaacaggccgatcttgccgcccttggcatagggcgccagcagatcgatgaccttgatgccggtgacgaggatctcggcctcggtcgactgctccgcaaaggcgggcgcctcggcgtggatgggggcaacgcggctgttgtccaccgggcccttctcgtcgatcggctcgccgacgacgttcaggatgcggcccagcgtggcgggaccgaccggcacgctgatcggcgcgccggagtcgaccacgtcctggccacggatcaggccttcggtgccgtccatggcgatggtgcggacctggttttcacccaggtgctgcgccacttccaggaccagcttgttgccgttgttgtcggtggtaagcgcgttctggatcgccggcaggtcgccgtcgaactgcacgtcgacaacggcgccgatgacctgcgtaatcttgccgaccttgttcttcatgctgtcgctcccgtcggaactctctaaaacctgcgggcggagaccgataccggccgccgctcccgggaccgttctttacagcgcctcggcgccggaaatgatttcgatcagctcgcgcgtgatgaccgcctgacgcgtgcggttgtattccagcgtcagcttgccgatcatctcgccggcattgcgggtggcgttgtccatcgccgtcatccgcgcgccctgctcgctggccgcattctcgagcagacccttgaagatctggaccgagatgttgcgcggcagaaggtcggcgaggatcgcctcctcctcgggctcgtactcgtagacagcgccgctgcccgccgcagtcgcctgcgtatcgttcgcggcctcgggggtcgcgaacggcaccagctgctgcagggtcaccacctgattgatcgccgacttgaagtggctgaaaatcagggtggcgacgtcgaactcaccggcttcgtagagcgcgatcaccttgtcgccgatggcctgagcctcggagaaggccagacgcttgcggccgatgccctcgacggtatcgatgatcaggctgccgtattcgcggcgcagctggtcgcggcccttgcggcccacgcacagcaccttcaccgtcttgccctgggcggtcaggatctggatctgacgcttcgcggcacgcacgaggctggtgttgaagccgccgcacaggccgcgatccgccgtcgccaggatcagcagatgcacctgatcgctgcccgaaccggcgagcagcttcggcgtggtgtcggtcacgatcacacgcgaagcgagcgagcggagcacacgctccatacgctcggcatagggacgcgaagcctcgacctgctcggtggcacggcgcagcttcgacgccgcgaccatctgcatggccttggtgatcttctgcgtcgccttgacgctgttgatgcggactttgaggttcttcaggttaggcattcggctgacccttgatcgaccccggaggtggatcctgtccgtcgcggcccggaaccccggacctgatatgcccggccgcggccggtccgcccggaccgggtccggacgacgccgcccgcatcagccgggatgtcccggcgatacgggcggcgcccttcaggcatccgccggatcaggcggcgaaggtcttggcggtgcggtcgacgaccgccaccagcttcgcttccacctcgtccgagagcttgccctcggtcgcgatggcgtcgaggatcgccttgttctcgccgcgcaggtcggcgagcagcgcctgctcgaacttgccgatcgaattgaccgggatcgcgtcgagatagccgcgcacgcccgcgaagatcacgcagacctgctcttccatcttgagcggcgagaactggggctgcttcagcagctcggtcaggcgcgcaccacgggccagaagcttctgggtcgcggcatcgaggtccgaaccgaactgggcgaaggcctccatctcgcggaactgcgcgaggtcgagcttgatgcggcccgcgacctgcttcatcgccttggtctgcgcggccgaacccacgcgggacaccgacagaccgacgttaatggccgggcggataccgcgatagaacagctcggtctcgaggaagatctggccgtcggtgatcgagatcacgttggtcgggatataggccgacacgtcaccggcctgggtctcgatgaccggcagcgcggtgagcgagcccgagccccgctccttgctcatcttcgcagcgcgctccagcaggcggctgtggagatagaacacgtcgccgggataggcctcgcgtcccggaggacgacggagcagcagcgacatctggcggtaggcgacggcctgcttcgacagatcatcatagatgatcagggcgtgcatgccgttgtcgcggaagaactcgccgatcgcgcagcccgaatagggggccaggaactgcagcggcgccggctccgaggcggtggcggccaccacgacggtgtattccagcgcgccgttgtcttccagcgtcttcacgatctgggcgaccgtcgaacgcttctggccgaccgcgacgtagatgcaatacagcttcttcgtctcgtccgaaccggcgtgggcggccttctggttcaggatcgcgtcgatcgccacggcggtcttgccggtctggcggtcgccgatgaccagctcgcgctggccacgtccgatcggcaccagggcgtcgatcgccttgagaccggtctgcatcggctcgtgcaccgactggcgcgggatgatgcccggggccttgctctcgaccagcgagcgctcggtcgcctggatcgggcccttgccgtcgagcgggttgcccagcgggtcgatgacgcggccgagcaggccacggccgacgggcacatccacgatcgccttggtccgcttgaccagcgagccctcggtgatgttgcggtcttcgccgaagatcacgataccgacattgtcggcctcgaggttcagcgccatgcccttggtaccgtcggcgaactcgaccatctcgcccgcctggacctggtcgaggccgtagacgcgggcaatgccgtcaccgaccgacagcacccgcccgacctcggcaacctcggcctcggtgccgaagctggcgatctgctccttgatgatcgccgatatctcagcggcgcggatgtccatcatccaacccctttcatggcgagtttcagactgtgcagcttggtgcggatcgagccgtcgatcatgcgcgaaccgacacgcacgacgagacctccgatgagggagggatcgacgtcggtccggatcgcgaccgcaccgccgaccgcctgcttgagcgcggcttcgagcgcgctcttctgctcatcggtgagggcatgggcggaggtcacctccgcgatcacttcaccgcgcgcccgggcgacgagcgcctcgaaggagcggatcatggccgcgagagagaagagccgccgctggctcgccacatagccgacgaagttccgggtgagctcgttcatgccgagcttgtcggcaaccgccgtcaccgccttgacctggtcgtctcgcgacacgatcgggctgcgcaccagccgagcgaactctgcgctctcgtccagcagctgcctgaatcgggcgagatcgccggtcaccgcatcgagcgcttcacgctcctgcgccaaatcgaacaaggcggtcgcataacgccccgccagtccggtcgcatccgcttgcgcacctgccactgggaccgtccctgaagcctgtcgtgaaaagaaaagcgacgaggccctgcggtcacgtaatggaacgcgtgagcaggaccaaggccacgacacacgccgtccgtggacgccgtcatgccgagggcaggcgatacctaacacaaggacccgggaggtgcaacccgcgttgcgacagcgaaaatcgccgttgtgcctgtgacgcgcatccggggctcgcggccgcccggtaccggttaccaccccggaggatcaaccggcggatcaaccgcccgcgcggcaataggtcgcaaccggatcctcggagaccgtcagagaaaactctgcggatcgacgtcgatctgcacacgaaccgcaccgcgcaccggcacgagatcgcgggcgcgggccatggcggcgggcaggtccgcggcacgatcggccatcaccagcagccgcacccgatggcggccccgcaacaggctgatcggcgccggtgccgggcccagcagccgggcaccgggcggcagtgtccggcggagcgcgcgtgcgaagacatcggccgtggagcgggcatcgcccggatcgggtgccgagaccaccaccgccgcccatcggccgtaagggggcgcgcccgcggcccgtcgctccgaggcttccgcgtcgaggaaaccgtcccgatcaccggcgatgagcgcgcggatcaccggatggccgggatcataggtctgcagcagcacccgccccggatgttcggcccgccccgcccggccggcgacctgggcgagcagctgataggtccgctcggccgcccgcagatcgccgccggcaagccccagatcggcatccaccacccccaccaccgtcagccggggaaagtgatagcccttggccatcatctgggtgccgatcagcacatcgatctcgcccgcctccatacgcgcgatcagatcggcggcctcgaccgggctggcgatggtgtcgctggtcatcaccgccacccgcaattcgggcatcaggctgccgacctcctcggccagacgttccacgcccggcccgcagggggcgaatttgtgttcggccccgcaggcggggcaggtgtcgggttcgggctcctcgtggccgcaatgatgacaaaccaggcgcgggccgccggcacggaagcgatgctcgaccagccaggcctcgcaggacgggcagcgcatccggtgcccgcaggcacggcacaaagtgagcggcgcatagccccggcgattgatgaacagcatcgactgctcgccgcgttcctttgcggcaagcatggcgtctttcagcggttccgaaacgaagcgggtggcgggcaggcgctcggcacgcatatcgatcgcctccaccgccggcagcacggcggcgccgtggcgggccgccaggcgacggcggcgatagcggccgcgctcgacattggcgagcgtttccagggccggcgtcgccgaggccagaaccaccggcacgccttccagcgcgccgcgcatcaccgccatgtcgcgggcgtgatagacgacgccgtcctcctgcttgaaagcggcatcgtgttcctcgtcgaccacgatcacgcccagcgccggaaagggcaggaacagcgccgaacgcgcccccaccaccaccggagcggtcccctccgccaccgcccgccaggcgcggcggcgatgggcctgccccagattggaatgccacaccaccggcggcgcgccgaagcggccgcgaaagcgttccagccactggctggtcagcgcgatttcgggcaccagaaccagggcctggcgcccctgacggagggcggcggcgatcgcctcgaaatagacctcggtcttgccggagccggtgaccccgtccagcacttcgaccgcgaaccccgcccccaccgccgcaaccagggccgcggcggccgcagcctggtcggggccgaatgcggggccaggcaggtcggggtccggcagatcgaaggcccgcggcaccggccggtcgaccggcaccagcgccccgccatcgatcagcccgcgaaccacgccatcggacacgcctgccgcagcggcgagcgccgccaccgtcggcgggctgccgccctcttccgccgtcacatgctccagcgtctccagcaccgcccgccgctggggcgtcagccggcccgcgggcgcggcaccggtcgccaccagcccggtctctggccgcggcggatccagcgcgtcgtcgaccggcagcaccatgcgcagcacggccgcgggcggcgagacggtataggccgcaactgcatccaccagccggcgcagcgcctcgggcaccggcgggcagtcgcgccgcgccgtcaccggtttcagccgcccggccgcaaggtcgccctcaccggggccccagaccaccccggtgatcgtgcgcggcccgagcggtacctgcaccacatcgccgggggcgagcgtcgtgccgggcgggacaagatagtccagccggtccagccggcgccccgccgggccgcccatcgtctgcagcggcagaacggccacgcgagacgcatcggcaggggcacggtcgggaaacaacccggcggacgggttcggacttgtatccggggcggtcatcgcataagcagcagtcgggtgcggacgggtcgggcggatggcatcatgcaactggcggcggcgcaaggctttcgttaaactccgcgccaaaccggcggccccaccatcccttgccggaagacccggaccgggttttcaggcatcaccgaccgccacggaagtgtccgcccgaacgccggcttcccctgtcttcgcccggtcaggacggtccgtcacttccatcggaccgtcacccgaccgccgataccctggtttccagaggcccgcatcatgaagttcttcgtcgataccgccgacgttgccgaaatccgcgatctcgccgccaccggcctggtcgacggcgtcaccaccaacccgacgctgatcgccaagagcggccgcaagttcgtcgaagtgatcgaagagatctgcgccgtggtcgccggccccgtctcggccgaagtcaccgccctcgatcacgagaagatgctggccgagggccggtatctggcccgcatcgcccccaacgtcaccatcaaggtgccgctgaccatcgacgggctgaagacctgcaaggcgctctcggacgagggcaccccggtcaacgtcacgctgtgcttctcgcccgcccaggcgatcctggccgccaaggccggtgcccgcttcatctcccccttcgtcggccgctatgacgatatcggcgcgcgcggcatggagctgatcgagcagatcgtcgagatctacgccaactacccgaccttccagaccgaagtgctggtcgcctcggtgcgcaatccgctgcatgtggtcgaagccggccgcatcggagcggatgtcgtgaccgtgccgccctcggtcctgcgccagatgtaccagcatccgctgaccgacaagggcctggccgcgttcatggccgactgggagaagaccggccagacggttctttgaaccacggccatctgaacccggcgcatcatccgatgccgagcggcgcggtctgcagcgatgaccctgagggtcgaccccgcagccgcgccgttccatattgaagggcaacccccttcccgccaccccgaggcagaccgacccgccaagatgaccagcagctccgacaccgccgcccccgccgccggccgcccgatccaggacgccgacgtgctggcgcatctcgcccgccacccggatttcttccagcgccaccccgaagccctggaagccctggttctgccgggccgtcgccacggcgacggcgtcgtcgacatgcagcgcttccagatcgaccggctggcacggacggtggacgacatgcgcagcaaccagaagcgcctgatcggcacggttcaggccaatgccgagatcgaccagcgggtccgccagtcggtcctggccctggtcgaggcgcagaccgtcgatgccgtggtcgaccggctggtccaggctgtcccccaggcgctgggcatcgaatgcgcgctggttgcggccgaaggcgatgccggccggatgccggcgggtgtcaccgcccttccccccggcacgatcgatcgcctgctgggcgccggtcggccgcttcggctgcgcggccggatcgaggccgatgcccgggcaccgctctggaccgggaacgataccgtccggtccgacgccgtcgtccgcctggagacccgcgccgacatgccgccgatggtgatggtgctgggcaatggccgcgaagccacctggcatgacggtcaggcgagcgatctgctcgatttcctggcggccgtggccgcccgctgcctggcccggtcgtggcccggcgcctgacgcaggatccggccgcccccctgccggcggatatcgcggcggccgtcgaagactggcggcgctggctggtggccgagcggcgcgcctcggccaatacggtcgccgcctatgaccgcgatctgacgcagtttctgcgcttcatcaccgactgggccggtgggatcggtgatctttccgcactggccgccatcgacatccaggggtttcgcgcctggatggcccggcggcgcgccgacggcctgaaacccgcctccaccgcccgggcgctggcagtggtgcgcgggttctatcgacggctcgatcgggtgcacggcctgccggcgccggggctcgccggtctttcggcaccgaaacacgtccgcccggcacctcgccccgtggcggcggccgatgcccgccggctgatcgccgcagccgccgatatcggcgccgaaaccggccgcgactgggtggcgctgcgcgaacgcgccctcttcgccctgctctggggagcggggctgcgcatcggtgaggcgctgtcgctggacgggcgcgactggccggcgccgggcagccgccagccggccctggtggtgcgcggcaagggcggcaagcagcgccgggtgccactgatcccggcggtggtcggcgcggtcgaggcctaccgtgccgcctgcccgcatccgcagacctccgaccggccggtcttcaccggcgtgcgcggcggccggctggaccgggcggtggcggaacggcacatggcggcggcgcggcgcgcgctggggctggatgcgaccgccaccccccatgcgctgcgccacgccttcgccacccatcttctggatggcggcgccgatcttcggatcatccaggatctgctgggccatgagagcctggcgaccacccagcgctacacggcagttgcgaccgaacggatgatcgccgcctatgccgcggcgcacccccgggcacggctgcgcagcggcgaggacgagacggacggcacggaccgcccccctcagacatagaccagttcggtcatcatgccggtggccatatggtagaggctgtgacagtggaacagccagcggccgggattgtcggcggtgaccgcaatggtgaccgcactgcccggcaccacctgcaccgtgtcgcgcaggatgccacccaccggccggccatcgatcgccgtcacccggaaatgatggccgtgaaggtgcatgggatgcgccatggcggagcggttgaccatggtcaccgccagcacctcgccggcgcggacctgcaccgggcggcgatcggcccagctccggccgtcgatggtccagcgatagggcatcatcccgccatccagcaccatctccacccgccgtgcaggccggaccaccgcggcatcggcgggcatcaggatccggtccagcatcgcatcgaccggtgcggccggtcgtgccgcccgctcggatagtctggcgaccgccgcccccggcgtggcgagcagaatgccggtgcggatggtatcgccctcacgcgtcgccagcagcggcaccaccccgccttcggccggcatgtcgaccagcagatcgacccgctgcccctgggcaagcgggacgtccgcgacctcctgcaccggcacctcgttgccgtccaccgccgccacgcggaggggatggccgcccagatcgagccggaaggcggtggccgtcgccgcattgatcaccctgagccggacccgcccgcgccgctcggtccgcaccaccagcggatcgtcgagcgtgcggtcctcggccaggaaggcgtcgtaatcgacatcgttgagatcggggcccgccgcagcctggcccatattcccgtggttcatggcaccgtgggtcatcgtgccgtggttcatgcctccatgacccgccgccgccatgcccgtcaggccggccaggatctcgtccggcgtccggaagctgaagtcatggagcatgaccaccacctcctgccggtcggcggcgaggtcggcggcactgcgcacgatcaggggcgccgccagcagaagctgttcctgaaggccggcatgggaatgcatccaatgggttccgggccgggccgcgaaatcatagaccgcttgcccatcgggtggaatcagcccggcatagccggtatcggtcacgccgtcctgatccggcggcggggtcaggccgtgccagtggatgatggtcgactcgtccatccgattgtggagggccaggtgaaaccgctcgccgggcatcagttccagcccgttgccgccgtcgggacggcggaggccccagaccgtggcggcacggccgcggatgtcgatgacccggcttgcggccgaaagatggtgacgcggcgcatcggcataggccgatggcagcaggccgcgcccggccgcggccagggccgcagcggcgcccgccgcaccaagcaggcggcggcgggtgatgttcatggacatggaaaatccctttccgtccggatatccgatatctgaagagaggccccgtggcggggcgccgtcagacgatcggcggacggaacgggcctgccgggttgcggccgtcgggcaggaagatggccggcagcgatggccggcccgcatggccgaagccgaccgggatcagcagggccggcagggctgccggcgcacacagcatcgcgcaggcggccatgcaggcgcgatgctgacgatcgggcgccccgccatgatggtcggggcaggggctggcggccatgaccaccatcgccggcatcgcctctgccgcatgcgatgccgccatgtccccacccgaccaggcggtcaggaccagggcaaaaacggcaaggatgatgagggcgatgcggcgcatgggcgtgtgcctgcggggtgtatcagcgggcgagcagcgcttcggggcggtcgccggccgccacccgcagcaggcgcatgcgatccggcaccaccagcatgcggccccggcgttccaccaccccgtcctcttggagctgagaaagcacgcgggccaccgtctcgcgcgccgtgccgacccgcgccgcaatgtcgcgctgggccggaagacggtccaccacccagcggcccggggccccggcattgccgtcagagggcttggccagacgcaggatctccaccgccacccgctcgaccgcacgcagcgtgctcagatccatgatccgttcgtcgcaggcgcggatgatccgggccagacgcaacatcaccttgcgcgccaccgtcggctcctcggtcaccagccggtcgaagagctggggagagagtgcggccagccggcaatcggtggccgcgaccacccgcgccgagcgcggcaggccgtcgatcgccgacagctcgccgaaatagcccccggcctcaatgcgggcaaacgagacttcgcggccggtcagggcgtagttgatgacgtccaccacgccttccagcaccagaaagacgtcgcgattgctgctgccgtcatcggcatccagcaccaccgcaccggcgccgtgacgcatggtgcgcacctgcgccgccacggcggccaggctgttgcgcggcagatcggcgagcagatcgacacgggccagctctatggcgagagtcgtcatcggcaacagggctcctggcggtatgcgatgcggcggcgaacggaccccggagccggcgtggaaatgccccgggcgacgcctcggggacagccgtgcgggggcggacggcggtctgcaccgcccggccactctgccgttactccgagacgttaaccgtggccggaaggcctgtccacctcgtctctgcggcgatgcgaaagtaatcgtcgcgtcgcggcaagttattgagacatccgtcacatcgcgtctcgcgatgcctgggacctcagggcccgggcgcgaattccggcagcatcagctccaccgcccggcgtccctccggagccgtgccctcgaccaggagcttctcgggaatgcgcccctgcagccgcccctcgaccgggccgagcagatcgccgaacagcccgtcgcagagcatcgaccagtagccggagagggggatcgggtccaccggatcgtcgatccattccgacccgatattcggcggctcgtaggcgatcgagtccagctcccactgcccgcggcagatggtggggcgtgcgccatcccgctcggcgtccgggccggcgaacagcatcagcatctgccccttcgccccggcgcgcatgccgagcccgatgccgtcgacataagccacaccacgccagagaccgagcggcgggccgtcatccgccgccgcatcggctgatccggtatcgggcagggccctgacggccagatcgaccaccaccgggcggccgagggggctgcgcggcggtaccgcctcacccacgacgccgatcgaccccacggccagggcggcgagatcggcatcatagcgccggcccggttccaggcagtggaagcccgcaaccaccgcggtgggcggcataggcaccggggcggcttcggcggtcggcacaggcggcagggcgggctcaggcgccgccgccgggggcgggtcgtccgcgacgaccggtggggctgcgtagccataggcgcccggcgccatcggtgccagaaagccgatacagtcccgctccgtcacccggaagcgctcgaccggcagcggcccgaaccggctcgggatcacggccagaggctcgaccgacaggcggatcggcccctcatcatccttgaaggcgaagagatcgtcgaagcgcggggagcgggtctgcgcgcccgaggcggcgagcgccccgacataaagcccggccatgggttctgcctcgtcggccggtgcccagaacgcgccttcggcatcgacctcgccatccgcacgctgatgatgacgcgcgatgtcgggcgcattgttcacgccatagcgcgccgcccggaagatcaggcggccatcggccacgggaatccgcatccaccgcccggacggagccggcggttcggcctgatcatcggtgtcggcatccgggacggcttgcatctcttctgccgggtgagccggggcctggggcgttgcagcctggggggccgcagcctcttccgcaagggcggcaggcgccagcatcagggcaagcagcagcagagaggctgcccgcagccggcggccatcggttgtctgatcccgggaggcggttctcatgccgtcgatcccatgtctccacacgcgcggccatgtcgccggagcggcatggccgaaggacgatacccggcttcgcgccgaatcagaaggctttcgccacggaaccgacgtcatcgcctcgtccggcctcccccaaccgaccgtcctgcatcacaagccggcgatggaacatgtccaatgcccggtgatcatgggtcacaaccagcaccgctgcaccacgatcttcggcaatgcggcggaacaatcccatcacccgggccgcgcgatccgcatcaagcgccgccgtcggttcgtcggccagcaggagaaccggctgattggcgatcgccctggcgatcgccacccgctgctgctctccgcccgagagatgcaccggcagggctgcggcccggcgacgcagatccagccagtcgagcagttcggctgcccgcatccgggccggacgccctgtcatcccggccacctccagcgcaatgcgcacattctcttcagccgtcaggaagggaatcagattggctttctggaacacgaagccgatatggtcgcggcgaaacctgcggcgctcggcggcggtcatcccgcagtcggagccggcggcatcgcggccggcaatccgcacccgaccccggtccggcggctccagcagaccggcggtgagcagcagggtcgatttacccgagccgctgggcccaagcagcgccgccatctcgccgggtgcaagcgccaggtcgatgtcatccaacgcccgcaccacctcgtcgccactgcggaaatcgcgaccgactccccgcatctcaagcaccggcgccgccatcaggccagcacctcctgcgcacgaacccgcatcgccttcacaatgcccgcggcactgccggccaggcaggtcgccagtaccatcgctccgatcagggcgatatcggcatccagcagcagcacccgtcgcgggaacatcggaaacagcagccgcccggccgcaagaccgaccccaagcccggtcacaccaagggccagggcctgggtcgcgatcatggcgacgatcagccggtcggcggccccgatcagcttcagcatggcgatggtgtgcagcttctcgatcgtgccggtatagaggatcagcgacaccaccaccgcggtgatggtcatcagcagcaggctgaacagcaggatctgcatgcgaagccgttcaagccgggcattgagcaacagatcgcgctggtcccgggtggtgagcaccgcgacatcgccccatccggcgatctcggccgccaccgatatggcggcaccgggccgcacatcgaccgccagagcctggacgtcgccgtgatcgccggcgctccccgcggcccggcgcagcaaaatggcttccgaggggcgcgccgccctcagctcgatcaggtcgggaatggtcagagccagaaccggatcaccattgatgtcgaccatgtcgcgcgtcagcccggtgacccggagatgctgatgccccaccaccagcacgtcgccgatcgcgagacccaggctgcgatcggcgatggccacgtcatgccgctggccgagcggcagtccttccgccaggggcagccagccgccgtcgtcgtccggccagtcgagcccaagcaggctcacctgccgcacctgcccgtcgatgcgcaggctgcgggtcagcgacaggaaggggcgcaccctgatcaccccgtccacaccctcgacccgccgttcggtcgcgagcggcaccgccgatgtctcggcaaaggggccacgggtatcgccctgcaccacccagagatcggcgccgatccggtcgatgaccatcagggcgtcggcgacgatgcctcgatagatcccggtcatgccgaaagcgcccatcgccagcaggccgatgccgatcgcggtcagaacgaagcgcagcaggtcgtggcggatatcggccagagccagcatcatcgggcgtcctccaccagccgcacccggcgcagcggatacaggtcatccggcgccagaaccacttcgccgggtatcaggccgtcggtcacctccacccgtccggcactcaccagccccagggttatccgccgccagcgggcccgaccgtcctggcccagcagccacacgccgctgtcgcctgccggctgccccggtcgcggggccagcatcgcccccggcacccaggtgacccccatgcgctcaccggtcaggatctggacatcgacccgctggcccagtgcccaatgccccggcaggttctcagggaccagatcgaccatcacctcacgcgtttcggcatcgaccgcgcggccgacgcgggccacagccgcccgccacacttgatcagggtccgagcggaagatcagcgtcgccggctgaccgggtgccagaccgctcatccggctctcatcaatgcgtgcggtcacgatcaggctgcggggatcaaccagatccatcagcggcgcaccggcaccgaccagtgatcccagatcggcggcacggtcggtgacgacgccatcgaacggcgccggaatcgccgtatcggccagccgggcgcggacagcatcaaccgcggcggccgcggcgatgaccgcggcatcgcgctcacggatcatcgcatccgcctgggcgatggccgccaccccactctcggccgcggtgcggtcggcatcgagggttgcgggtgacacggcaccacgggcgctcaaggtccggctgcgccgatagcggcggtcggcctcggttgcagatgccaccgcctcccggcgcgccgcccgcgcctgatcggcagcctgacgcgcgccggcatggtctgcttcggcggcggcaaggctgcccgtcaggtcataggcatcgagcctgatcagcagatggccggcctcgacccactccccccgctcggcgcccagggccagaacccgaccggatacccggctggccagagtggcgcggatcgtcgcgtccagcgtgcccggccccgataccaccagcggcatgacccggatcgccgcggtgaagcccgtccgatcgatcggcacgacatagcggcgatggatcagggtcgccgccatcaacaccatgccggcggcaagaagccacggcaccatccgccggagcaggcggccgggcctgcgatcgagaggatggggatggggaggatggggatcagcagcacggggatgggtgggttcgggatcgatgatcggcatcaggcgggctttcgcgatgaacacaggcatcagcccttacgcgcccgcaggccgcgctccgtcggctcacggctgagatttccgatgacggccctgttttagcggcgtcgacagctttccttcacttttcgcgacggaaaggtcgaggaccatccgtaagccctcttgaccgtcgcagccggcgccgccggccggccgtcatacctgatatccagatccggagaccccgtgatgaccacatccatccatctgcggcttgccgcgctgctgtccggcggctgcctgctgattggaaccgccggcgccgccatcgccgccgagccgccaactttccaatcgatcgataccgatggcaatggcacgctcagccgcacggaatggggcaagatggtcgaggaacagatggccgtcgccgaaggccgggcggcgaagcgtctggccgagatgcccgaggatcggcggaccgaggcgctcgaccgacgattccgcagcatagacagcgatagcgacggcagcttgtcccaggcggaatgggatgcgcgccggcgcaactgagccatggccaccggctccagcccgtctcctccgtccgcctttacaatctgctccgaccgggggccgttgatatgatcccgctcatcaccggccgtgacagcccggctgcgccatgaccgagcccagcgacgacagtctggtcgttcgggtggcggccggcgatcacgccgcattcgccctgctgatgacgcgccatatgcggcgcgccatcagcatcgcccgtggtgttgcccgcaacaccgccgatgccgacgagatcgcccaggatgccttcctccggctctggacccatgccggtcgcttcgatcgcacgcgtggcggcttcaccgcctggttcggccgcatcgtgctcaacctgacgctcgatcgacggcgccggccggtgaccgagctgctggatgaccggatcgcggtcgccgacgaccggccggatgcgttggaccggctgatcggggccgaacgcgatgccagcctgcacgccgggctcgatcagctgggtgaccggcagcgcgccgcgatcgtcctgtttcatgtcgaggggatcagcgggcatgactgcgcgcagatcctggatctgagcgacgatgcattcgaaagcctgctgtcgcgggcacgccgcagcctgcgccgggcgatcgaccggcaaaccagccggaaggagaggtgtacaccatgacccccgacagattccgccgtctcctggatgcctatggcgccgacatcgaccgctggcccgcgcccgaccgccaggcggccaggacatgcctggcccaccatcccgatctgctcgtgccgatgggccgggcagccgcccttgatgcatcgatccgccgcatcgcgcccgccgtgtcgccggacgcggtcgcggcagccatcgatgcggttaaccggcgccttgaagccccccctgcaaacacccggcggcctgccgaccacggcggtgtcggtcgggccccacatcaggccgtggcattgggctggccgctggccgccctggccggcgccgcggccatcctgctcgccatcggcctgcacggcctgcccggcacggcggatggtgcggccatgatgaccctgctgttcgacagcgatcttattctgcttgatggagccgtccggtgatccgtccgctcatccaccgcctgcggcgcccgcgtgcagagcggctggccctcatcctgtcggtcgcggccaacctcgcggttgcggcgtatctgctcctcgccgagcctgcccggcccttcggccgggatatggcgccgcgcgccgcgcgcctggtggagatgatttcaaaccgcctgccgccggcggacggcgccagattgacggccctctatgcagcgcggcagcccgcgatggcggcggaggacatggcgttccgccgggcgatgatcaccgtcatggccgagatcgacaaacccgaggtggaccgtgccgccctgcatgcggctttcaacgaggcgcgatccatccgcagccgctccgccgatctcatgatcgacatcttcgtcgagacgctggccgatgcctccctcgaggccaggcagcagatcgtcgcggaaatccgcgaggcgcgctgacagcgcgccgaagccggccccctacgcaaaacgcccggcagcgcagaccgctgccgggcgtttgtgcgaaaatattcccgcgactatatagtcacgagatcttttctttacatgttgagcgtgcggccgtccaccgccagcgccgcttccttcaccgcctcttcgagggtcggatgggcatggctggtgcgggcgatatcctcggcgctggccttgaactccatggcgagcaccagctcggagatcagggtgccggcatcggggccgatgatgtgggcgcccagaatccggtcggtctcggcatcggccaggatcttcacgaagccatcggtctcgcccaccgcgcgggcgcggctgttggccgagaaggggaacttgccgggcttgtaggcgatgccgtcggccttgagctgttcctcggtccggccgacgctggcgacttccggccaggtgtagatcacacccgggatcaggttgtagtcgatatgacccgactgaccggcgatcatctcggccacgatcacgccctcttcctcggccttgtgggcgagcatggggcccttgatcacgtcgccgatggcgcggatgttcggcacattggtgcggaaatgatcgtcgacctcgatccggccgcgcgggccggtctcgatgcccaccgcctcaagccccaggccctcggtatagggcttgcggccgatggcgaccagcacggcatccgcctcgatggtctcggcatcgccgcccttggccggctcgaccgtcagcctgatcgcctcacccgaggtatcggcgccggtgaccttggtcgacaggcggaacttcaggccctggcggcccaggatgcgctggaactgcttggaaacctcgccatccatctcgggcgtgatccggtccatgaactcgacgacggtcacggccgagccgaggcggctccagaccgagccgagttccagaccgatgacgccgccgccgatcacgaccagacggcccggcaccttctcaaactcgagcgcgccggtcgaactgacgatccgcttctcgtcgatctcaacacccggcaggtcgacatgggtcgacccggtggcgatgatcgtctcgcgggccttgatcgtctcggtgccgccgtcgttcagcgccacctcgatggtggtcgcgtcgacgaaacggccggcgcccttgaagtaggtgaccttgttcttcttgaacaggccttcgataccgccggtcagctgggagacgaccttgcccttgcgggtcatcatcgcggcgaggtcgagttcgacacccgacagcttcacgccatgctcttccagcccatgcttcgtctcggcataaagctccgacgactgcagcagcgccttcgacggaatgcagccgacattcaggcaggtgccgcccagcgcgccgcgcttctcgacgcaggcggtcttgagccccagctgggccgcgcggatcgccgcaatgtaaccgccggggccgccgccgatgatgacgacgtcgaaggattgggtatcgctcatctcatgcatcctcgaaaagtcggaacgcccgccgccggatgatggcggcgggcgcgggagggatctgcgtgccgatcagagatcgaacagcagccgctccgggttctcgatgcattccttgacgcgcaccaggaagctcaccgcttccttgccgtcgatgatgcggtggtcgtaggacagcgccagatacatcatcggacggatcacgacctggcccttctcggccatcggacgctcctggatcttgtgcatgcccaggatgcccgactgcggcgggttcaggatcggcgacgacatcagcgagccgtacaccccaccgttcgagatggtgaaggtgccgccggtcagctcttccatggtgagcttgccgtcgcgggccttcacgccgagcgcgttgatggtcgcctcgacgccggcgaaggacagctggtcggcgtcgcgcaccaccggaaccaccaggccctgctcggtgccgacggcgacgccgatgtcgtagtggttcttgtagatcagctcgtcgccgtcgatctgggcgttgaccgccggatactccttcaggcccgcgatcgcggccttcacgaagaacgacatgaagcccagcttcacaccgtgcttcttctcgaagccgtccttgtagcggttgcgcagcgccatcacctgcgacatgtccacctcgttataggtggtcaggatcgcggcggtgttctgggcatccttcaggcgctcggcgatgcggcggcgcagcttggtcatgcgcacgcgggtctcgcgctcgccggccggctgggcgaccttgggcgccggggcggcggcgggctgggccggggcggcagcagactgggccgcagcggcgcgctgcacgtcgtccttcatgacccggccgtcacggccggtgccctcgaccgaacccgcatcgataccggcatcgccggccgccttgcgggccgcgggcgacaggatcttctcggcggcgggggccgcagccggtgcaggctcggccttcggtgcaggcttgggggcctcggccttcttcggcgcctcggcgggcttcgcggcagcggcaccctggccctcgccgatcacccccagcagcgcaccgacttcgacgtcggcaccttcctcggccaggatatcggtcagcacgcccgaggcgggggcattgacttcgagggtgaccttgtcggtctccagctccaccagtggctcatcggcctcgacacggtcaccgaccttcttgaaccactggccgatggtggcctcggtaaccgattcgcccaggctcggaactttgatctcgacgctcatcacgatcccgatttcgttcatgtcccggcatcgacggccgggaagctacaacacgtggcttaggtggcgtatccacgcacggatgacaaggcattaacgcacgagaagggccgcatgcgacgcatgcggcccatgttcccggcgatcagcccgccagtgcgtcgtcgatcagcgccttttgttctgcgacatgcttgtggtgcgagccggtggcaggtgccgccgcctcgggccggccggcatagcgcacgcgcttgccggaagcccccatgctgtcgatcaggtcgtccaggcgcgggctcatgaagaaccagtagccctggttcttcggctcttcctgcacccagagcacctcagcattcggatagcgccgcagctcttccgcgatcgaggtcgccgggaacggcgccagctgctcgacgcggatgatggcgacatcctcgatgccgcgggcacggcgctcttccagcaggtcatagtagaccttgccggtgcagagcagcacccggcggatcttgtcggcatggcgcagctgatccacttcgcccagcacccgatggaagctggagcccgggcccatatccgacagtttcgacaccgccagcttgtgacgcagaagcgacttcggcgtcatcatgatcagcggcttgcggaacttgcggtggatctgccggcgcaggatgtggaagtagttcgacggcgtcgtgcagttggcgacctggatgttgtcctcgccatagagctgcaggaaccgctcgggccgcgccgaggaatgctcaggaccctggccttcatagccatggggcagcagcatcaccaggcccgacatgcgcagccacttcgattcggccgagctgatgaactggtcgatcatcacctgtgcgccgttcacgaaatcgccgaactgggcttcccagaccaccagcgcattgggctctgccagcgaatagccgtattcgaagcccagcaccgcatattccgacagcaggctgtccaccacctcgtagcccaccgaggcaccgaggttgttcagcggcacatagcgctcttcggtcttctggtcgaccaggaccgaatggcggtgcgagaaggtgccgcggccgacatcctggcccgacaggcggacggggtagccctcggtcagcagggtgccgaaggccagcgcctcgccgagcgcccaatccaggccctcgccgttcgcgatcgcttcgcgcttctggcccagctgacgctggatcttgcggtggacgttcacgccctcgggcacgtcggtcagcttgaagccgatctcgcgcagacgctccagcgacacggcggtagagccgcggcggtcgtcgttcggcgcccgctcatagcccttccacacgccctcgaaccagtcggccttgttcggcttgtaggtcttggactgctccagatcctgctcgaggcgctgatggaaactcttgagtgcgccatcgacctcgtcgcgggtcatgacgccgtcattcaccatccggtcgccatagatctgcagcagggtggggtgctgcgcgatcttgcggtacatcagcggctgggtgaacgagggctcgtcggcctcgttatggccgtggcggcgatagcagaagatgtcgaggacgacgtccttgtggaagatctgacggaactcggccgccagacgcgccacccagaccaccgcctccggatcgtcgccattcacatggaagaccggcgcatcgaccatcttcgccacatccgacggatagggcgaggagcgcgagtatttcgggctggtggtgaaaccgatctggttgttcacgatcacgtggaccgtgccgccggtgcggtagcccttcagctccgacagcgcgaagcattcggccacgacaccctggccggcaaaggccgcatcgccgtgcagcagaatgctcagcaccttcacccggtcggtgtcgccgcgctgaccctgcttcgcccgggtcttgccgacgaccaccgggttcaccgcctcgagatgcgaggggttggcggtcaacgacagatgcaccgtcttgccgttggcgagcgtgcgatcggtcgacgtccccagatggtacttcacgtcgcccgagccctggacgtcctcaggggtcgccgatccgccgttgaactcgttgaacaccgccgtgaaggacttgcccatcaccgcggtcagcacgttcaggcggccgcgatgcggcatgcccagcacgacttcttcgcagcccagatccgacgaactctcgaggatcgcctcgagcgccggaaccagggcctcgccgccttccagcgagaaacgcttcgtgccggtgtacttgatgttcaggaagcgctcgaagccttccgcaatcaccacctggccgaagatccgcttgcgggtctcggcatcaaaggcctgctcggggcggtcggcttcgatgcgcgactgcagccaggccttctgctcgggcgactggatgtgcatgaattcgacgccgaccttgccgcaataggtcgactgcagcttgtgcaggatctcgcggagggtcgcgttctcaaggccgagcacgccgtcgacatagaaggtgcggtcgaggtcgtcctcggtgaaaccgtaggaagccggatccagctcgggatggcccgacggggtttcaagcccgagcggatccagattggccaccagatggccgcgcacgcgataggcgcggatcagcatcagcaggcggatgctgtccaccgttgcggaacgttccgtcggaagctcgccggtcttgccgttgaccgggccgacccgcagcccggtcgcgccgtcggccttgaaggccagggtgtcggcatgaccgttggtcgcagtgccgggcacgatgccgggcgcccagggggcaccgcggacttcggccagcaccgacgcggcttcgtcgcccagatcggcgaagaacccctgccagctctcatcgaccgacatggggttctggacgaaacgcgcgtagagatcggcgataaaggcgccgttgctcccgaacaggaacgaaagttgctcgctttgcgcagccatcttgagcaatgggagcgccgcttacgcggcgccctctccaggtttgggtctggttcgtggatccgtcagcctcggagcacctggaccatggtgctaccgagagccgcgggcgattcggcgatgacgataccggcggaccgcatcgcctcgagcttgtcgtcggcgccgcccttgccaccactgatgatggcgccggcatggcccatgcgacggcccggaggcgcggtacgcccggcgatgaagccgacggtcggcttcttcaccttggactgcttcaggaactcggcggcgtcctcttccgccgaaccgccgatctcgccgatcatgatgatcgcctcggtctcggggtccttcaggaacaggtccagcgcgtcgatgaagttggtgccgttgatcggatcgccgccgatgccgatgcaggtcgactggccgaggccggcggcagtggtctgcgcgacggcttcataggtcagcgtgcccgaacgggaaacgatgccgatcttgccccgctggtggatgtgaccgggcatgatgccgatcttgcactcaccgggggtaatgacgccggggcaattggggccgatcaggcgggtcttggagcgctccagcgcccgcttgacacgcaccatgtccagcaccgggatgccctcggtgatgcagaccaccagctgcacttcggcatcgacggcttccaggatcgcgtcggccgcatacggcggcggaacgtagatcacggaggcatcggcgccggtcttctccaccgcgtcggccacggtgtcgaacacgggcaggtcgagatgggtggtgccgcccttaccgggcgtcacgccaccgaccatgcgggtgccgtaggcgatggcctgctcggaatggaaggtgccctgctggccggtgaagccctggcagatcaccttggtctgggcgttgacgagcacggccatggtcaggcggcctccttcacggctttcacgatcttctcggcagcgtcggccagatcgtcggcggacatgatcggcaggccggaattggccaggatcgccttgcccttctcgacgttcgtgccctcgagacgcaccaccagcggaacctggaggctgatctcgcgggccgcagccacgacaccctcggcgatcacgtcgcaacgcatgataccgccaaagatgttaacgagaatcccctcgacattggggtccgagagaatcagcttgaaggccgtggtcacgcgctcgcgggtcgcaccgccaccgacgtccaggaagttcgccggctcgccgccatacagcttgatgatgtccatggtcgccatcgcgagacccgcgccgttgaccatgcagccgatgttgccgtcgagcttgatgtagttgagggcgtgacgcgaggcttccagctcggagggatcctcctcgctctcgtcgcgcaggtcctcgatgtccttgtgacggaacagggcgttgtcgtcgaaattcatcttcgcgtcgagcgcgatgacgtcgcccgcgccggtcacgaccagcgggttgatctcgacgatgctcgcatcggtcccgatcacggcctggtacatggcgagcatgaacttggtcgcaaccgacacctgcttgccttccaggccgagaccgtaggcgatcttgcgggcgtggaagggctgcatgccggtgatgacgtcgaccggcaccttgatgatcttctcaggggtctctttcgcgacctcttcgatctccatgccgccttcggtcgaggccatgaaggtcaccgacgaggtctcgcggtcgatgacgacgccgagatacagctcacgacggatgtcgcagccttcctcgatgtagacccgcttgacttccttgccctcgggaccggtctggtgcgtgaccagggtcatgccgagcatgttcttcgcggtcgcagcgacgtcgtcgagcgacttcacgaccttgacgccgccggccttgccgcggccgccggcgtggatctgggccttcacgacccagaccgggccacccaggctcttggcgacctcgaccgcctcttccggcgtgtaggcgacgccgccgcggggcaccgcgacgccgtacttcgcgaggagcgccttcgcttggtattcgtggatgttcattgagcctcttccctagaccgctcgatcagccgcggaggtgccggcgcctgcagttatagcacccgtctcccggtgcgcaaccgccgtcccccgcgaaatcaagcgcttgaagcccgtttgcggaccttttccgagaccgtctcggcaaggctgcaacagggtttcgcgcgcggtgccgatcagaccgacagcgcctcgttcagcttcttcaccgcatcgaccgagtgcaggaaggcagccttctcttcctcgttcagctcgatctcgacgatccgctcgacaccgccctcgccgatcacgaccggcacgccgacatagaggccgtccacgccatactggcccgacagcttcgcggcgcagggcaggacccgcttcttgtccttgagataggcttcggccatctggatggccgaggcggccggcgcatagaaggccgagccggtcttgagcagcgagacgatctcggcgccgccgtcacgggtgcgctggatgatctggtcgagcttctcctgggtcagccagcccatctcgaccagatcggtcagcgggatgccggcaacggtggagtagcgggccagcggcaccatggtgtcgccatggccgcccagcacgaaggcggtcacatcctcgaccgacacgttcagcgcctcggcgatgaagtagcggaagcgggcgctgtcgagcacgccggccatgccgacgaccttctcgggcttcaggcccgagaacttctgcatcaggccgaccatcacgtcgagcgggttcgtgatcacgatcacgaaggcatcggggcaatgggtcttgatgccgtcggccacctggccgacgatcttggcgttgatcgccagcaggtcgtcgcggctcatacccggcttgcgggcgatgccggcggtgacgatgacgacgtcggcaccggccagggccgaatagtcgttcgcaccggtcagacggctgtcgaagctgtcgacgggggacgactcggcgatgtccagcgccttgccctgcggcatgccctcgacgacgtcgaagagaacgacgtcgccgagctccttgagcccggccagatgggccagggtgccgccgatattgccggcgcccaccagtgcgatcttgttgcgtgccatcgggtttcctcgcgactttccagcgtctggcgtcggccgggagcgggccgggccgcccgtccgcgaggagcggggggtacggtcacgcgcgccggtcgcgccgccgacgcacagaagggccttcatgcgcccgtctgtgcggatgtgaaatccgtccctccgtgtaccgcccgcaagggccacggatcccgcatgtccgggatcgacgcggccgtctgtcggccggcactcacaccgcagatccgccggtattgagacgccggcaaccctgcgacacgaagctgtaatcttaccgaagcagaagccggtgaacccggcgtttccgttcggaaaatctcgcgccgtaactactctctttcgcgcgccgaagcaagggggcgcaccccgcttcggccgccgcatcagaccagatgcggcagggccagatactctttgctctgcatctcggcaagccgcgatgcggtgcgggcaaattcgaaggatccgtcaccggccgggtacagatcatcgggcagggccgccgccgaacagaccagcttcacccggtgttcgtacagctcgtcgatcagggtcacgaaccgcgcggcacgatcccggctgtccggccccatcgccggaatgccgtcgatgatgaccgtgtgatggtggcgggcgatctcgatatagtccgcagccccgagcggccggctgcacaggtcgtcgaaaccgaaacgcgcaacgcccccggccgccttcggcacatcgatccgccgcccggacacgtccagcacctcggccgaggccggcgcgccgcccgacagatcccggaaggctgcatcgagcgccgcgcgtgccgcggcatcggccggcacatgatagaccggcatcagcgtcagtcgatccagacgatagtcgcgggcggagtcgagctccatcacctcgagcgtgtcgcggaccaggcggatgaaggggatgaagcggtcgcgctgcagcccgtcgaggtagagatcctcgggcgggcggttggaggtcgcgatcacatagacgccgcgggccagcacatgggtgaacagccggcccaggatcatcgcatcggcgacgtcgcggacctggaactcgtcgaagcagagcagcttcgcctcggccgccaccgcatcggcgatgcgcggcagggggtcgggctcgcggtcctggtcgcccgtcgtccgccaggcatgcagacgggcatggatgtcgagcatgaaggcatgaaaatggacccggcgcttcggcgccaccggagccgccctgaaagccatgtccatcagcatcgacttgccgcgaccgaccccgccccagagatagagcccgcgcggcccgggcggcatcggcggcgggccctcttcggacgcgctgccaccgaacagccggccaaacaggccgcgtttcggggccggtgccgggggtggcgcccccctgtcctcgcgcatgcgccggatcaacgcgctcaaccggtcggccgccgcggcctgggcgggatcggcggcaatgcgcccctcagccaccagggcggcataggcgcgtgcaggatcttgggcggcgtcgggcacgggtgcggacattcgtcgacggttggaggacggccggcgagagggcggccagccggggcgatggggcggtgtcggccctgaagatggggcattctgccgcattgcacaacccgcagaggacggttggcggccatgcagccggtgccggtcggcaccgcccctcgcgcagggcgcgcattcgtgtcacaatcgacagcgcttcacgatcttttcggaaggacccccgccagatgcgtgcccgccagatgcgtgacttccagcgccccggtcgctccgccgtctatgccaacgaggcaatggcggccacgtcgcacccactcgccactctcactgcggtcgaaactctccgcgccggcggcaatgccgtcgatgcagccattgccgcggtggcggtgctcgggctgctggaaccgcacatgaccggtatcggcggcgattgctggatgctgatccagcgcgccggcgatgtggccccgctctgctacaatggcaccggtcgtgccgctgccggcgccggacctgccgtacagcggctcctcgatagcggggcggcgaccgtgccgcaatcgcaccccctggcggtgacagttccgggtgccgtggaagcctgggaccgtctgtccaccgatcacggccggctgggtctggaccgaattctggcccccgccatcgaccttgcccgggcgggagccccggtcgctccgcgggtggccgccgactgggcacgccatgtcgatcttctgcaggcgaacgatgtcacggcacaaagcttccttgccggcgcacgcgcacccgcagccggcacccgcatgccccagacccagatgtgcagaaccctctctgcgatcgccaaggacggtgcccgcggtttctacgagggctgggtggctgaagacatggtcgccacactcaagggcctgggtggaccgcatgatcttcaggacttggccgggcatgccggcagctatgtctccccctccaccgccacctatcggggcacgacggtcttcgaaaaccctcccaacagccaggggatcattgcacttgccatgctggcgatgatggagccggccgatgtcgccgccctcggtccggacagtgccgccttccacgacctgatcgcgcgggcatcggaggccggcatcgccctgcgcgaccgcttccttgccgacccggccgatgatcacggcgcccctgatggcgggctcgcgcagatcatggatggcgcacgcctcgcttccgccagcattgccgcaggaggcagggcagaggcaacacccggccggccgggaggaagcggtgatacggtctatgtcagcgtcgtcgatcgcgaccagacggcggtgtcgatggtcaactcgatcttccatgccttcggcagcggtatcacctgcccccgatcgggcgtgctgttcaacagtcggggcaccggattccgcctggcgccggggatgcccgggcactaccgtccgggtctgcggccgccgcacaccctggtcgccggcatgaccggcgatggccgccggccggtcatgagtttcggggtgatgggcgggcactaccaggccatcggccatgccaccctgctctcccggatcatcgatcatggcctggatccgcaggccgcgatcgatctgccccgctccatggcaatgaatggggtactggaggtggaaaccggcgccgattccgcgctgatgccgcggttgatcggtctgggtcaccgggtaagggcggcagaacagcctttgggcggcgcccaggcgatcctgatcgattgggaccggggcgtgctgatcgccggctcggactcccgcaaggacggttgcgcgctcggctactgaacctgcggccgaggggcaggcgcccgagaagttttcaaccgagcccgccggtatgccggcgggcattgcgtgtggccatccaagctgttagcgtgcgccgcgcttgcagacgggggactctgtgccatatctccgtcctgcgctcatcaacctctctgcctccaaggaacagccccatgcggatcggtatcgtcggcgccaccggcgcggtcggtcaggagacgatccaggtcctgaaggaccgtggtttccccgtgaccgagcttcatctcttcgcctccgagcggagcgccggcaaaaccaccgaaaccgcgttcggcaccatcaccatcgagccgttctcggtggatgcggcgcggggcatggacatcgtgttcctggcggtttcgggtgatttcgccaaggaatatgcgccgcagatcgccgccgaaggcggtgcggtggtgatcgacaactcctcggccttccgctacgacgatgcggtgccgctggtggtgcccgagatcaacggccgccgcgcgctggggcagaagctgatcgccaatccgaactgcaccacggcgatcctgctgatggcgctcgcccccctgcacgaggctttcggcgtgaagcgcgccatcgtctcgacctatcaggcggcgagcggcgccggcgccgagggcatgaccgagctggaacagggcgcgcgccagtatctggcgggtgagccggtgacggcgtcgaagttcgcccatccgctggccttcaacctgatcccgcatatcgacagcttccaggacaatggctacacccgcgaggagatgaaggtcctctgggagacgcggaagatcatggaagcgcccgaggtgctgctgagctgcacggccgtgcgcgtgccgaccatgcgcgcccatgccgaagcggtgaccatcgagacgcggcacccggtcaccccggcggcggcgcgcgaggttctggccaaggcccagggcgtcacgctggccgatgatccggcgaacaagctctacccgatgccgctgaccgcctcgtcgaagtatgacgtggaagtcggccggatccgcgagagcctggtcttcggcgaaaccggtctcgacttcttcgtctgcggcgaccagctgctgaagggcgccgccctcaacacggtgcagatcgccgaactgctggtctgaccggctgctggtctgactggccgcaccggacactctgccggaaggccggcctcccattggtgaggccggcctttttcgtgcggatcgcgcgggctcgtgctacccaggaaggacagcccccgcccggcccgaaaccggccgcagaagcagacggggcacgagggagtggagatcatgcacatcctgcgtccgcccttccgcatggaggatgatgccgccctggacttcgccgcccggcgcggcttcggtctggcggtcgcggccgatggcggcgatccgctggggtcgcacatccccttcatcatccggcgcgaccccgatcagaccgtggtgcagttccacctgaccgccggcaatccgctggtggcgcaggcggcggccggcgcccgtttcctgatcgcggttgccgggccggacgcctatgtctccaacgactggtatgtctcggaagaccaggtctcgacctggctctacgaggcggtgcatctgtcgggccgggcgcggctgcagccggtggacgacaatcgcggccatggcgatgcccttctcgccgtagccgaagcacgactgcccaaaccggcctggagcctggagacgatggagccgcagaagcgccaggccatgctcgacggtatccgggtcgtcgaggtgatcgtcgatcggatcgaggggcagtccaagctcaaccagcacaagaccgacgccgaccatgtggcagtggccaaccggctggcatgggccggaacgacgccggcgcaggagcttgcccgccgcatgcgggagctgcgcccggatctcgtctatgattttccggacgccgacgacatgccctgatcagccgaatcgggtgacggccagttgccgccccagatcgtcggcgcgtaccgactgaaccgcgcgataagcggcaatcaccgaagatgcctcggggcgattggtgacgaaattctgaaacagcccgaacagacttcccgcgccccgcgccgtggccatgccgccatcaccggccccggccgtatcgtcgaggacggttgaattggccgtggcctcgtagcgcgcggctgcgcgggacgggccggtgacgtcggcggggctgtagctgcgcgccgtgaagccgggatcggcctgaagtgcgatcagagtggaaagcgtgccggcagaaaaccgctgcccgaagccggatccccgctgctgttcctggttctgctggtcgcgcgccagtgcctgttcgaaggcactgccgccatcctcgccgccggtgcccgagggatcgacgcggcggatttcatcctgccagccgtcgcccaccgccgtgctgcgcgcggtcgaaccgccccagcccggaaccgggcgggccgtctcgatacggcggatggcgtcgagcgcggacatgggcggccagaggctcccgagggtggatcagcggataagggacggtccaggcatcggcggaacagactatgcgggacggaaacgcctggaatgatcggagtttagacaattcccggcggtcccgccagtggccgtgagatgtcctgtcaatggcggtcgatgggcaggctgcggcaaagggtgggccggccgtgacaggatgatgtcacgaccggcccggggcatgcgtcatccggcgagggtcagggctgagccagcacctcctcggcacgatgacaggcgacccgtcgcggccctaccggccgaagctccggccgctcggtcttgcagcggtcgatggcgaacgggcagcggcgatggaaggtgcagcccggcggcggcgccaggggcgacggcagctcgccgccgatcggctggcgcaccgcccgctcatccgggtcgatgcgcggcgtggcggcaagcagggcgcgggtataggggtgcgccggcgcgtcgaacaggacgtccttgtccgcctgctccacggcgcggcccagatacatcaccatcacctcgtcggcaatgtggcgcaccaccgacagatcatggctgatgaaaacataggcgacgccgaattcctgctgcagatcgatcagcaggttcagcacctgggcctggatcgacacgtcgagcgccgagaccggctcgtccgccaccaccaccgccggatcgagcatcagcgcccgggcgatggcgacgcgctgacgctggccgcccgagaacatgtgcgggtagcgccccgcctgttccggccggagcccgaccctggccatcatcgccgccaccctctcccgccgcgccgcgcggtcgagatcggtgttgatggcaagcggttcctccagcgtctgagccacggtcttgcgcgggttgagcgaggcataggggttctggaacaccatctgcacccgccggcgcagccggcgcagggtggcggcatccgcacccgccacatcggcaccgtcgatgaccagccggcccgcggtcggcttttcgatcatcaccagctgacgggcaagggtcgacttgccgcagccgctttcgccgaccaccgccagtgtccgaccgggcgccacctcgaagctgaccccgtccagcgccttgagcacggccgggcccttgaggaagccccgcggcacctcgtaatggcgggtcagatcctccgacaccaggatcggtgcgatcggctcagccatgggccatctcctccgccggacttggccggccggcatcgtcgagcggcgtgtggcagcgcaccgccgcatccggcccccagggcctgagcgacggctgcaccgcccggcaatgcggcacggcatgggggcagcgcggctccagcaggcagcccggcgggcggtcatactggcccggcacgacgcccgggatcgcattcagccggcgcttgcccgccgcccgctccggcagagcctccagcagggcggcggtgtagggatggcggggatggcggaagatcccgggcacctgccccgtttccaccacctgccccgcatacatcaccgccacccgttttgcggtttccgccaccacggccaggtcatgggtgatcaggatcagggccatgccccggtcgcgctgcagccccaacagcaaatccaggatctgcgcctgaatggtgacgtcgagtgccgtggtcggctcgtcggcgatcagcaaccttgggttgcaggcgatcgccatggcgattaccacgcgctggttcatgccgcccgaaagctggtgggggtaagaatcgatccgcgctctggggtcgggaatgcccacctggtccagcaggtcgacggcgcgttcgcgcagctgccggcggctgccgccttcgtgcacctttaacgcctcgatgatctggaagccgatcgtgtagcaggggttgaggctggtcagcgggtcctggaagaccatcgccacatccttgccggtgagccggcggcgggcacgtcccgacagcgacagcaggtcggtgccggcaaaggtcagccgctgcgcctccacccgggcggtcggcggcagcagccccatgaccgcgagcgagctgacgctcttgcccgacccgctttcgccgacgatgcccagcacctcgcccgcatccaccgagagcgagacgccgtccaccgcccggaaggcacgatcgcccgtgccgaaggtaacggtcaggccgtcgatatcgagcagggccatcagcgtttcatcctgggatcgagggcgtcgcgcaggccatcgcccagcagattgaaggcgagcacggtgatgaggatcgcaaggcccggcagggtgaccacccaccaggcgcgctggatgtattgcagcacgccggccagcatggtgccccattccggggtcggcggctgggcaccgagacccaggaagccgagcgccgccgcatccaggatcgcggtcgaaaagccgagcgtcgcctgcacgatcaacggcgccatgcaattgggcaggatggcgctgaacatcagccgcagcggccccgcgcccgccaggcgcgaggcggtgacatattccttgttcacctcacccatcgccgccgcacgggtgaggcggacataatggggcagcaccacgatcgcgatcgcgaacatggcattggcgaggccggggcccagaatggcgacgatcgcgatggcgagcagcaggctgggcagggccagcatgatgtccatcagccgcatgatcaccgtgtcgaccaccccgccgaaatagccggcgagcaggccgagcagaatgcccgccgccagcgacagggtgacgacgatgacgccgatcagcaggctgagcctggcgccgtggatcagccgcgagagcatgtcgcggccgacatcgtcggtgccgagcgggaagctccagctgccgccatcggcgaaggccggcggcaccagcagggcatcacggaactgcgccgacgggtcatggggcgccacgacatcggcgaagaccgcgagcagggtgatgatcacgatcaccaccagcccggcgacggcaccggggttgcgcctgaaatcggaccagaaggcggcgagcgcgccagggggcgtcggcgccgtggttgacggggtggcggtgctcatcggcaaccgcggtcccgggccgctatggcaaagaccatgaccgcagggggtctggtcgcaatggacatgcggcagcagagatcagcgtgcatgtcggatccgcggattgatgatgccgtaaagcaggtcgacgatcaggttgacggcgatcaccacgcaggagaccagcaggatgccgccctgaaccgacgggtagtcgcgccggccgatcgattcgatcagccatttgccgatgcccggccaggcgaagatggtctcggtcaggatcgcgccggcaagcagcaggccgacctgcagaccgatcaccgtgatcaccggaatgagcgcgtttctgagcgcatggaccagcaccacccgggtcgggttcagccccttggcacgggcggtgcggacatagtcctcgcccagcacctcgagcatcgacgagcgggtcatgcgcgcgatgacggcgagcggaatggtgccgagcacgatggccggcagcaccagatgatgcagcgccgaccagaaggcctccggctcgtccgagagcagggtgtcgatcagcatgaaaccggtcaccggctccacgtagtacatcacgctgatccggcccgacaccggcgtccagccgagcgtcaccgagaacagcatgatcagcagcagcccccaccagaagatcggcatcgaatagccggtgagcgccccggccatgaccgtatggtcgagcgccgaaccgcgccgaaccgcggccagaatgccggcgggcaggccgatcgcgaccgcgaagatcatcgcggcgaaactgagttccagcgtggccggaaacagggtgaggaagtcgttcagcaccggcgagcgggtgacgagggagcggccgaaatcaccctgggcgagcgaccacagatagctgaaatactgctccaccatcggccggtcgaggccgagctgggccagcatctgggcatggcgttcgggggtgaggccgcgttcgcccgccagcagggcgaccggatcgcccgggatcagccggatgaggacgaaggcgaagagggtgacgccgaggaaggtcggcacgaccagccccagacgtcggaacacgaaagcgaacatctgacggcgaccgcagctgcggcgcggccggcatcatccgcggacacgggatggcacatggacgggggagttgggatgcaccgaggccggccgacggtgtggggagcccccgcacctccggccggccgccgcagatggcgccagcgcgcgcctcagtccttgaggcccgggccgtagaagtagtgaccgccgagcgggtcgatcttccagtcagtgacctcgggacggatcggctgatagaccaccgaatgggcgatggtcacccagggggcctgctccttgaagatcacctgggcctcttcatagagcttcgtgcgctccgcctggcccgagaccgtcttggccttcatgatcaggtcgtcgaagggcttgtagcaccagccggcatagttggagccgccattggccgcatcgcagcccagcagcaccgccaggaagttgtcggggtcgccattgtcgcccgtccagccgagcagcagggtctgatgctcaccggcctgggcgcgcttcagatactcgccccattcataggacacgatctgagccttcacccccacggccgcccagtcggcctggatcatctcggccatacggcgggcattggggttgtagggtcgctgcacgggcatcgcccagatgtcggtctcgaacccgttctcgaaaccggcctccttcagcagggccttggccttctcggggtcgtaggcgtagtcctcgaccttgtcgttatacgaccagatggtcggcgggatcgggttcttggcggccttgccggcgccctgatagatcgcgtcgatgatcgcggccttgttgaccgccatgttcagcgcctggcgcaccttcacgtcgtcgaagggcttcttgcggacgttgaaggccagatagccgatgttcaggccttcctgcgacatcaggttgaccttcgggtcttccttcatcttcgcaagatcggccgggttcggatagggcatcacatggcactcgcccgcctggatcttggcgtagcggaccgaggcatcgggcgtgatcgagaagaccagcgtgtcgaggctgctcttgccgcgccagtagtcgggatgcgccttgtagcggatcaccgcatccttctggtagttcaccagctgatacgggccggtgccgaccggctccagatcgaccttctcgggcgtgccggccttcatcatctgatcggcgtattcggccgacaggatcgaggcgaaatccatcgcgatattggcgatgaacggcgcttccggacggttgagcacgaagcggaccgtgtggtcgtccaccttctccaccgccttcagcagcgagggcatgctcatgccctggaagtattcgtaggtgccgcccgacaccttgttgtacgggtggttcgggtccagctggcgcatgaagctgaacacgacgtcgtcggcgttgaagtcgcggctgggtgtgaagctcttggtggtctggaacttcacgcccttgcgcagatggaaggtgtaggtcaggccgtcatccgacacctcgtagcgctcggccaggccgggctgcacggtcgtggtgccgcgctcgaactcgaccagccggttgtagacattgcgcgagctggcatcgaaggtcgtgccggtcgtgaacagctgcgggttgaagccctcggggctgccctccgagcagtaaaccatcgtcttggcttcggcagcgccgaccgcgccgagcagggccgcggcggcaaccgcgcccatcagagccttattcatgaagtctccctccggaaatcgtcccgcgggaccagggcgtcggcggcatctcccccaagatgccgggctcctcggccctcctcctgcccgcggatttccgaaagcctatgccagctttccggggagcgtcaacgccgctgcaacacacgccggcgcttcatgttggtataccggatgggcgcaccggttgtgcgatgcaacgaaagcgggatgccggggagatggcgctcagtcgagcgcaggcgcgggccatgacggatcgaggcgcggcggctccgccgggccgaggggcaccacccgggtcgggttgatggtcgtatggctccagtaatagtgccagcggatatgggcatcgtcgaccgtctcgcggatcgccggcaccgccagcagccgggcggtgagcgcggtcagcatcggataatcggcgatgcggcgcaggttgcacttgaaatgcccgtgatagaccgggtcgaagcgcaccagcgtggtgaacaggcgcagatccgcctcggtcatccggccgccgaccagccagccctgcccgtcggccagccgggcttccatgcgatccagcgcctcgaacagaggcaccaccgccgcctcataggcagcctgggtggtggcgaagcccgccttgtagacgccgttgttgatccggtcatagacatcggcattgaccgcgtcgatctcgtcgcgcagctcgtccgggcagaggatcaggccgggattgccatgtttgggcgccagatggtcgaaggcgcggtcgaacatgcgcacgatctcggcgctttcgttgttgacgatggtcccgcgcagcttgtcccagagcaccggcacggtcacccggccgctgtagtcgggattggcgcgggcatagacctcgtgcagggcccggttgccgaacagcgcatcgccggtggcaccggcaaaagggacggcctcgtcgcccgcttcggcgggcgcgccgaaggtccagccggcaccgcccatgcgcgggtcgaccacgctcaccgaaatcgccccctccagccgcttcagccgccgccagatcagcgtgcgatgcgcccagggacaggcgagcgagacataaagatggtagcgcccgggctcggccggcaggccctcgccaccgggttcggtcgcaagccggtcgcggaaacggctggcttcgcgttcgaagcggccgccggtctttgcggtgtcgtaccagcggtcgtgccagacgccgtcgatcatcacgcccatgagcggtctccccggggatggctgaaggttgaaggaaccgccgcctgcggaacggcacaggcggcggcgcaacggtcaggcaggcatcagccggcggccagcttcttcgcgatgccggcgacgtggcggccctgggcgcgggcggtggagagttccttttcgctcggcgtccggctgccgtcggggccggcgatggtgccggcgccataggggctgccacccctcacttccgagatatcggccagctcgggcgccaccgcatagggcaggccgacgatgaccatgccgtgatgggcaagcgtcggccacagcgtcagcgcggtcgattcgttgccgccaccggtaccggtcgacacgaacacgctgccgaccttgccgagcagcttgccctgggcccagaggccgccggtctggtcgaggaaattgcgcatctgcgaggcgacattgccgaaacgggtcggcgcgccgaagatgatcgcgtcgtaatccgcgagctcggcgggagaggccacttcggccgcctgatcgagcttggcaccggccttttctgccacgtctcgcggcatcagctcgggcacccgcttcacggtcacctcgactccgtccacctcggcggcgccggcggccacggcgccggccatggtctcgatgtggccatacgtgctgtagtagagaaccagaaccttggtcatcgccgtcattcccggttgatgaggatgtcgggggtggcctgcaggaggccccgcccccgtcgtcccctcaaatgtagcactggcggttttgcgcaccaccggcaacaatggaaatgaattgtcagcctgagggaaacggtgcgcgatgagggcggcatggaccatctgaccagcatggcggtctttgcgcgggtggtggaggcgcagagcttctcgtccgccgcccggacgctgggcctgtcgaaatccgccgtctccaagcatatcggccggctggaggacaggctgggtgcgcggctgctgaaccgcaccacccgccggctcagcctcaccgagatgggcgaggtctattatcgccattgcgcccgcatcctgcgcgaggcggaggaggcggatctggaggtcggccgcctgcaggacgagccgcgcggcacactgcgcatcaatgcgccgatgtccttcggcctgctgcatctggccccctgcctgcccggcttcatggaagcccacccccatgtccgggtcgaggtctcgctcgacgaccgtttcgtcgatgtggtcgaggaaggctatgacctggtggtccgcatcggcaatctggccgacagcagcctgatcgcccgcaagctggcggaaagccggacgatgatcgtcgccaccccggcctattggaacgcccatggccggccccgccatccgcgcgatctctcccggcacaactgcctggaatatgcctatctctccacccgcaacgaatggcgcttccgcgctgccgacggcggcgagaccctcgccgtccggatctcaggaaccctgaacgccaataacggccagatcctgtgcgacgccgcccttgccggtaccggcgtcgcccgcctgcccgccttcatcatcggcacggatgtcgccgcggggcgtcttgaagcagtgctcacggaattcgcaccgccccccgtcgatatctacgcggtatatccacataaccggcatctgtcggcaaaggtccgtgccttcatcgatcattacgtcgactggctgcgccagcggcgccaggagatgcctttctcctgagaccgcggggcaagccacccgaggagcctacctccgatgcctctggacgatagttcgctcgcgcccgagctgttcgacctcccggccttcagcggcgaccgcaagcccggctggtgcctggccgcccccgagggcacgctccgcgtgcgaccgcacatcccgaccgggccgcttcaggcggggcccgaccgtctgctcgccgccatggcgcgctgcgtgcgggcgcagccgcgcagccgcatcctggccgccgataccacgctttaccggatcgacgccatccagcgcacacggttctgccgcttcaccgacgacatctcgctctgggccatgccggtgccgatgccagacggccgcatcgcggcagcaccggtgatcctgtcgcgatcccgcatcggccgctgggacatgggcaccaaccgccgccgggtggaatgctggctggccacgatgctcggcttctgcggcggctgaagatcagcatcggtcatcatcggatcaggccattgaattggccgcaccggcagtcaccatggttggctggggcattcccatcttcgaccggaggccgatcatgcgtcacaacctgccgctctgccgtcgcttcgaccatcccgccggcaccatcgcctgggaccgtttcggagagaccgggccggatctcgtcctcatccacggcaccccgttcaacgcagcggtctgggcaccggtcgccgcagcactcgcaccgcgggcccgggtgcatctgctcgatctggccggctatggccagtcgcgggtgcccgccggatcggatgtctcgctccatgtgcaggaccggatcctggccgactgggtggcccatctgaccctcgacggaccgccgctggtcgtcgcccatgacttcggcggtgcgaccgcgctccgcgcccatctgctccgcgggctggagatggcggggctgatcctggccgatgcggtgatgctccggccctggggctcccccttcgtcacccatgtccgcgaccatgaggcggccttcgccggcctgcccgatcatctgcaccgggcgctggtggcggcctatgtggcggaggccgctcaccggccgatcccggacgacatcctggccgacatcctggatgcctggggagatgccgatggccgccgggccttctatgcccagatcgcgcagatggatccggccgcgaccgacgaggccgtgccgcatctgagccgtctgcgctgcccggcccaagtgctgtgggggctggaggatcgctggctgccggctgcgcaggggcgcgatctggcccgggccatcggctgcggcttcaccggcatcgcgggtgccggccatctggtgcagaccgacgccccggcggtgctggtggcggcgatcctggacaggctcgccgccggctgatgccgtcccgcttcaggcggcgcggcgcggcgcaaaactcgcaggatccgccgccgcccagtccgaggcatagggtgtggcatccggcgcatcgatcagcgcaccgggggtcaggaagggataaagccggtccatcggcacgatctcgttgggggaacgccggtgcagcagatggcgcggttccaggtcggaaggatggtccagcccggccgcggcgaccagttccgccagggcatgcaccgtgcgcgactggaagcggcgcacccgctcggccttgtcctcgaccaccagccctttctgacgatccggatcctgggtcgcaacgccggtcgggcagcgcccggtgtggcacttcaccgactgcacgcagccgatcgagaacatgaaggcccgggcggcgttgcaccagtcggcaccggtcgcaagcgccgcggcgatgtcgaaggcgctgaccatcttgccggcggcgccgatgcgcacatgcggatgcagggccgcaccgaccagggcattgcgcaccagcaccagcccttcgcgcagcggcaggcccagatggtccgagaattcccgcggcgccgcgccggtcccgccttcggcgccgtcgaccacgatgaaatcgagcagaatgccggtgctgcgcatcgccttgacgatggcgaagacctcgtgcggctggccgacacagagcttgatccccaccggcttgccgcccgacagctcccgcagccgggccacgaaatgcatcatgccttcggggtcgtcgaaggcggaatgccgcgctggcgagatgcagtcgacgccttccggcaccttgcgggtggcagcgatttcggccgtcaccttcggcccgggcagcatgccgccatggccgggcttggcgccctggctcagcttgatttcgatcatcttcacctgatcgagccgggcggtctcggcaaagaggtcgggatcgaagcggccatgttcgtcacggcagccgaaataacccgaccccagctcccagaccagatcgccgccatgcatgcggtgataggggctgagcccgccctcgccggtgtcgtgatagaagccgccgcgggcagcgcccaggttcagggcctcgatcgcacgcgcgctgagcgagccgaagctcatggccgagatattaagcacctgggcgtgatagggcttcgtgcattgcggcccgcccaccttcacgcggaagggttccgtcgcgaccgggtggggggcgatggagtgcacgatcgcctcgtagcggggggcgtagacgtcgagctgggtgccgagcggctgggcgtcctcgtcacccttggcgcgctcgtagaccaggctgcgggcaagccggtcatagggacgaccttccagatcgtcttccacgatgtactggcgcagatagggccggagcgcctcgaacgcccagcgcagatgaccgaccaccggataattccggcggatcgcatgccgatcctggccgagatcgacgatgccgagcaccaccagcgggaccagcaccaccagcgcccacaggagctccgcctcgaccgtaacccccaggatcagacacagcagggtggcgagggtgatcaggatgaaggtgccgtgccggatcgcccggtcgagggggatgctgcgctcggccccgccgatttcggtcttcgcggtcatgccggcgcccccgccgccgcgtcatctggaccgaagagcagcacatcgaggccacgcaccagcccggtcaccccagccaccttgcggatcgcgagcagggtcccgtcgacataggccttggcatccttgccggcatcgtgagagatcaccagccgcgcgccggcgacggcgaaatgggcatcgatcgaggcggcatagctgggcaggcgcaatgaatgcacctgaaccccgccgatcgtgccgccgcgcagcgccggatcgcccagcaccttgccgggggccaccggcacggtgccctggggcatctcgggccgcgcaacccgtcccagccgctcggccagttcccgcgcggtacccgacggggcatccggcttggcgggacctgcgatctccaccacctccacatgcgggatataacgggcggcgatcagcgagaagcgggtggcgagcgccgcggtgatggcgaaattgccgctggcaaccacgccgcggccggcggccgtcgccgcggcggcgatccgctcataggccgccgcatccaggccagaggtgccgatcaccacatggacaccccgtgccagcgccgcctcggcatggccggcgacggccgatggatgggtgtagtcgaccagaacgtcgatcccgcctgcggcaaggaccgtttcgacatccgccgcgacctccaccccgggcagggcccccggcaccagttcgtccagcctgcggccggcggcggagcgggcgatgccgccgacgaggtcgagatcggcggcaacggcgaccgcgcgggcgatctcgccgccggtccagccggtgacaccggcgacacagacacggagcggggtggtgacggtcatgcaggcctctccatcggcggctggcggaaactcggctccgagcctgacccgtccgggctatggatgcaagccggtctccggtttcgccgcatcagacgggtggggacccggatcgaccgcaagcgcgccgtttatacgcaccacctgcccgtcatcgtcgaaacccggagccgcggcaccatgcatccgcacgatccggccatcgatgcgcagcaggcggaaatcgagcgccgacaccgtgccgcgccgggcccggcgcaatgcctcccgcacccgcgggcggtcttcggccagcaccatggcctggaattgcggcgcatcgatcgccccgtcgggcgggctgtccagcccgaaggcggagaacagctcgtttgcacaccagacccggggcgcgccgatcggccagctccaggacgcaatgcccgccagcgactggatctcggtcagggatcgcagccggtcatcggcccgacgcagcgccacctcggtttcggtgatgtcgtggatcaggccggtcgagcggccgccatcaggcaaggctccaccgaccacgcgcagatagcgcggcgccccgccacccggcgatggcaccgtcagcaccatgtcgagcgcgctgcggcgccccgcccccagatcagccagcgccgcgagcagcgcctggcgttccggagccgcaatccgttcgaacagatccgccgtgccgatcaccccgatgccaagtgccggcaagccgggcagaacgctgacatggcgcgtgcgcgcgtcatgctgccagacggcagcccgcgcaagttccagcccgcgcatgaccgttgcaccaccctctcgggggcgcgcatccgccgcttccttcccgcgcgggggcgccagcagcagagccgcagctgccccggccagcacgccgatcatcagactggcgcccagattacccaccagacctccccagccggcctccgccggaacgatggtacgggccgcgatcagccgcagggggaagccgtcaacctgccgctccaccagatctgcatcggcagtggccggacgcccgccggtcaccacgatccggccgcccgccgcatcggcaaggctgatcatggtgtcgccgtccggtatcagctgatcggtaatccgccggaaggcggaccggcccagcagcatgaccaccacgccctcgggccgcctgttcgcgccggcttccgccacgtcgatgatcggacggctgagcaccacacggtcccggtcggccgcgatgaacagcccgctcgccatcaaccttgaagccgcttcgggtgggggtgcagtcgcatggtcgtgagcggtgaccgccagcagccccgagggggccaggggcagaacctcccccagctgaatcagaatccggccggcaccatcagttatacgcagggtccccccctcaaggccctgcgtcagctgcggacgaagccgggaggcgaggacgtcctcgtcgcccgtgcggagcaggggcgcaagctccagcgccagacgatcgagcctggccccgacgtcacgcaacagcccggtgatcgcaatctctgccgatgcggcgtcgcggctcagctgtcgcgtggcctccgtcaccgcatcccgccgctcaccctcgacccgaacgagctggatcagcgccagccctattgcggccatcgcgaatgtcagcccccagatccgtcgatccattcgccggacgacctcctgcatcgttgaggtccgtgcatggccctccccgatcacagattagcatcgcagacgtcgacgcgcgacggtcgcatttcgcacgatcacacacgcgcataacgcgacgttcacaatcggaacgcaccggtccgcccgaaacacgaccgcccccggacagtcagtccgggggcggtgcagtcggtcggattcgatgctggtcggatcagcgcgcgttgatcgccacatagtcgcgggcggcggcaccggtatagagctgacggggacggccgatcttctgggtgggatcctcgatcatctccttccactgggcgacccagccgacggtgcgggccaccgcgaacagcacggtgaacaggctggtcgggatgcccatggcccgcaggatgatgcccgaatagaagtcgacgttcgggtagagcttccgctccacgaagtactcgtcctccagcgcgatcttctcgagcttcatggcgatgtcgagcagcggctcgtccttgatgcccagctcgcccagaacctcgtggcaggtctggcgcatgatggtcgcacgcggatcgaagttcttgtagacgcggtgaccgaagcccatcaggcggaacggatcgtccttgtccttggcgcgcttcacgaactcgccgatccggtcggccgagccgatctcttccagcatcttgatcaccgcctcgttggcgccgccatgagcggggccccaaaggcaggcgatgccggccgcgatgcaggcgaagggattggcacccgacgaaccggcgaggcggacggtcgaggtcgaggcgttctgctcgtgatcggcgtgcaggatcaggatgcgatccatggccttggccagaaccgggttcacctcataggtctcgcacggcaccgagaacatcatgtgcaggaagttctcggcatagcccaggtcgttgcgcggatacacgaagggctgaccgacggagtacttgtaggccatcgccgcgatggtcggaaccttggcgatcagacgatgcgaggcgatcatacgatgcgccggatcgttgatgtcggtgctgtcgtgatagaaggccgacattgcgccgaccacgcccaccatcaccgccatcggatgcgcgtcgcgacggaagcccgtgaagaacttcgtcagctgctcgtgcagcatggtgtgacgggtgatattgcgctcgaaggtcgcgtattcgtccttgttcggcagctcaccgttcagcagcagataggcgacttccagaaagttgctctgggtggcgagctggtcgatcgggtagccccgatggagcaactcgcccttgtcgccgtcgatgaaggtgatcttgctctcgcaggacgccgtggccatgaagccggggtcgaaggtgaaatagccggtcttgccgccgagggtgcggatatcgatcaccttgttgcccgcggtgccgccaaagatcggcagctcgtggctctgtccgctgatatcgtcggtgatggtgacggtaccagcacggacggcggtgttctcggtcatgcggtaagactccttgagccgctccgcgcgacaccgcgcggaggcgtcgactgggtataatgtcggcctgaatatagccctcggcaccaaaagcacaatggcaagggtgccggcgcaacggggttgctcggaatttcatggatttgttcacgcgattcaagcgcaatcaatccgcgttcaaattaacctttgcgtttaattcgccacagatttcccgagcgattttttattgaaattcttgcgcgagagtttcaatcggcagacgatccggaacacgctccatgcgtgcataggttccgagggcgcggaggatcagatccacacgcgtctgcatgtcgggcggcgaatccggccggatcagcggttcagccaccgggtcaaaggccgtgttctgcatctcgattgcgatgctgatccgtggtccggcggcgcccacccggacacgccccgaccagtgatagagatcctgccgccagcccaggaccgacccggcagcggcgggcagcgccaggccgatctcctcgggctcctgcggcagccgcccctcggcgatcagggtctcgagcggcgccggcaggctgcgctccacctcgagcggcaccacccgcatgcagccattgtcgagcccggcatcgaccagcggcacccagaagctcagggtcatgtggatgccgcccggaaacacgcttcgtccgatgagatcccgatgccccggccagccgcgggccccctcgaccggcggcacgacccaggcccagagatgcggcagcaccgcgaaccgctcccccagcagatgggcggcaagcggcgccagggcggcctgcagggcccaggcctgatcgaagacatgaatgaagaccggcggccacccggccgttttcagccgcagcaggccacggcggagatcgtcgataagcccggccggcagcaccggcggcagcgcaaaccagccatggtcgtgcagcccgtcggcggcccgggccagatcttcctcacccagccgcgcgggagagaccgcagcctgccccccgatatcgagccagggcaccagccgccgccagcccgccggatcgatgaggcgggggtcggcaagggaggacaacgtcctgcggggcgtcgtcatcgggccatacctgccgagatgcggtcatgggcagcgcgaacatcagccggccagcggctcttgatgaaagagagcacggcccagatctggtcgtcgcgcaaccggtcgcggaaggccggcatgtcgctttcatagcccggcggcgcaaacggaccggggccgagcgccgtcagggcaaagagatgctggtccggatgatgccaggtatggcctgtggcatcgtgcggcggggcgggcaggcgccccgagggcaggcgggttcgccagtcctctgcccctgagaggtccgcaccatggcaggcggcacaggtatcggcatagatcgccgccccctcgcgcaccttgcgggggtcgtcgggatcgagctccgacggcatttcggcaagggccgcataaagcgccgcccgtgcctccgcatcggagcctgaggcatcggggaagctgcggaccacatggccggcggcgcgatattcaaggccgagcagccgccgcagcggcccatcgacttccagcgccacgacagccgcagcacccagccctgccgccagggccaggcccagggcaagcgcccgccgccgccgcgcatgaaggccggggcgggcgggaacgggcggcgcggatctgtggtcgtgacgggccatacctgcagcatcgccgacccgtgcgccgacggcaaggccaccgcagacggggcgtcgatcagtcgcgccggctccagatcaggcggtggacgccatccggtgcctcggccgccaccggcggcgtgaagcacagctcggccagccgcaagcccaggaagttcagggtcagcggcggcgcctctccgcccagatcggcctgggcaaaggcccagagcccggcatgacgggggccggcataatcgtcgtcgagcaccagatcgaggcaggcgaaacagccgccgggatgcagcgcctcttcggccgcctcgatgaccgccgaaatcgccgtcttggcactgcggcccaggccgcgcaggatcagcacgccgtcgagccccaccggccagtcctcgccggccagggcggcaccgaactctgccgcgtcttcggcctgatggctgagatcgagcccttcgccgaagcttcggacgaaaccggcgtcgccgcccagcaccagccagcgccccgccggagccagggccgcggccgcccaggtgccgagggccggatccaggatcggccagtcgagccgcgacggcgctgctggcacaccgccccccagcaccacggcggcagcccgggccacttcgccggcatggtccgccagttgaacgcggccatcctcttcaagctgcaccaggccctgggcgccaagcgccgcaagctgggccagcaggcgatcgaccggcagcccgaccgcggcggccagttcggtcggatccgcccgaccggcggccagccgctcgaaggttccgccccggatcgcttcggccagggcacgggtcgccgcccagcccagtgccgcatccagtccggcggccgcaccgctcatcggtcgtttgggcgcagccgtccctgctgcggccgtcatctcgatcgccgtcatccgtcccccgtcgcggcaagtgatcccgatcccgagagtagacaccacccccttgaaaaacaacctgtgatctattttccagcaggcgaatcgcgccgcattacctgcggggtcatggagtccggcatggcaggggtggcgagatagaagaccacaccccatccgaaaggccgcaccatgaccgccacgatcgacccgcgcatcgaaagcctggtccgcaaactgctgatcgcctcgcctgtcgcccgccatctggggatcacgatcaaccatctggccccagacgacgtacggttgcgcctgcccttcgccatggagaacgtcaccgtcgacaggatcgtccatggcggggtcatcgccaccctggccgatatcgccggtgccacggcatctgcctcaggggtcgacccggcgacggtccgtggaggtgccacgcaaaccctggtcgtcaactatctgcgcccggccgatggctgcgatctggaaaccagcacccgggtgctgtcgcgcagccgcagcggcacggtgacctcggtcgagatccacgaccctgacgggcagctcatcgcgcaggcgaccgtgaccagccggatctggtgacgcgcacgggcttcggtccggggcgcgcgtcggactatactctcgggcgcgtatcaatgcgggccgcgtcgcatcccctgcgccgctcccctccgccgcgaacggacgccctgatgaccgatactccgaccgcctgcctgttctgcgccatcgccgatggccgcctgcccacccatctcgtccatcaggacgaggagatcatggccttcatggacatccagcccatccggcccggccataccctgatcatcccgcgggcgcatcatgcctatttcgaggatctgccgcccgccaccgcggcgcgcatcgtcgatctgggccagcgtctcgcccgcgagatgaagcggatctggcaggtgccgcgggtggccttcgccttcaccggcatcgacgtcgcgcacacccatgcccatgtcttccccatggtcgaggtgaccgacgtgctctcaaagcgtcagatcgccgagcccgacatcaccgtccgacccatgccgcgggcggaacccgccgagcttgccggcatcgccgcacgcctcgccgatgccgtcaggcaggggtaggcctttggcgccgccgccctcggacgggatcgatgccgcggaacgcgcagccgagcggctgggcggctggctgcgcatcgccatttcggccgtgctgctctgttccctggtcgggccgctgctgatcctgcaaccggcgatgatcttttcgggggcggtcagcaccaggctggtcatcgccctcacaacgctgatcgctttcggcctggccggcggggccggggtgctgctggcacggcggggccgctaccggcgctggatggcctgggtcttccccgccgtcgatgccggcctgctctgcgcctcggtcctggccgggctggtgctgaccgccctgcccggcgactacgccctgatgctgactgccgtctggctggcgccggtcatcctggcgatcgcggcactccgcctcagggccggcgcgatcctgatcgccaccgccatgaccgtggcggcgctgggcctgccgatgctggccgacggcacggtcgctcccgatcccgcagcactcgccgacgagatcaacggcatgcatgccatgcccccaaacctcgcacggctggtcatgctggcgctggccggcggcgtgctcgccttcgccgcccggcgcaaccgccggatcgtcgcccgggcggtggacgaggcggcgcgcgccggtcggctcggccgtttcctgccggcccagatcgccgccgatgtcggacagagcggcggcgacccgacggagctgggcggacggcgccggctcgcgatgatcttcgtcgatctgcgcggttccaccacgctcgccgaaagactggacccgcagaccgtgggccggtggatcggcgactatcgcgcccgggtgcgccgggtggtcaccgcccatggcggcctggtcgcaggcttcgtcggcgacggtatcctggtcctgttcggcgcgaccgggcccgaggcgccggatgccggcgcagccgcggccctggccgccgcgcaggaggtggcgtccgatgtcggcatctggacgaaagaggcgctgtcggccgacggaccagccctgccggacccggccgtcgcgattgccgtacatgccggaacggtctattgcggcccggtcggcgacgacgagcggttggactataccgtgctcggagatccggtgaacgtggcggcgcggatcgaaagcatcgcgaaggagcgcgggctgacggtggtggcgagcgacactgtcatcgacctcgccggccgccccgccggatggcggtccatcgggctctgcgaccttcgcggccgcagcaccggcatgacctgtcacacgccaggctagaaccggatcgtcaacggccgccgaaaccgccgcggccggaaccggggccacgcggcgcctcgaagccgcgaccacggcggctcttcagcttctcggccggctcttcgtcggcaggcgccgtctcggccgcggcgagtgccgcggcacgctggctgcgggcgaaagcgtcctcggcggccccatccatcccaacctcttccagcgcccggcgcatatggccgggcacaggtgccaccgcctcgaccggcggctgatcggggtagagcggcagagtgatcgcccgggcgtggagcagcatcggccccagcttcgtgcgcatctcgtcggcgaaggcgtcgcccacgccctcggcatagaccggatcgccgaccagcgggcaacccatatgggccatgtgcacgcggatctggtgggtgcggccggtgcgcggccggcattcgatccaggcccggccaccggcctgacccaggacgcgccaatcggtcaccgccgcctgcccggcgggatccaccaccatcttccatccccgaccgggggtgcgcttggcgagcggcgcatcgacccgcccttccggtgcctcgggcacgccgtcggttactgcccaatagaccttttcgacccgccccccctggaacatccggccgagcctggccagcgcccgccgattgcgccccagcaccaggcagccgctggtgtcgcgatccagccggtgggccagcgacggctgctccttgtagccgaagcgcagcgcgtcgagatacagctccagattgggcccgccgcgcgggccggcatggaccggcagcccggcgggcttgtcgatgatcaccaccagacggtcgcggtggagcacgcgggcgcggatttccgtgggagtcatgggcggcgcgggctccggaagcttggcggcgggacggccccactggtacacctatcccgggccgggcggaacccccatccggcccccgtcattccactgcctctccccgcaggcgggagacttccaggagccgatctcatgaccgacgccaccaaccccgatatccgccgcatcgacaccggtccgcggatgagcgacgcggtcgtctataacggcatggtctggctggccggccaggtcggcacccccggcaagagcgtcgccgagcagaccgccgacgcgctggccgaggtcgacgccctgctggagaaggccggcagcgaccgcagccgcatccttcaggcaatcatctggctggccgacatggctgatttcgccgagatgaacgcggtctgggacaagtgggtcgtgcccggccatacccccgcccgtgccaccggcgaagcgaagctggccgccccggaataccgggtcgaggtgatcgtgaccgcagccgtgaagccctgaccggcccgatgaccacgcgccgccgcccggccgcccggctcttcgtcgtcgacggggacgggcggatcctgctcttccgcttcacctttctctctggtcccacggccggtcagggctgctgggccacgcccggcggcggggtggagccgggcgagagcttcgagcaggcggcggtgcgcgagctctatgaagaggtggggctggtgatcgaccatcccggccccgccgtcttcgagcacgaggtcgaactgcggatgagcgatggcgaggtcgtgctcgccgaggagcgcttcttcctgatccgcctgcccggccgccataccctggttcaggacaactggaccgagctggaacgccgggtactggcggaacaccgctggtggcatccggccgagttgatccatgccgatgcgccggtctatccggccgatatcccggccctgctcagggctgcaggactgacgctctgagcgcccccagttcggcctccagctgttcgtgaaagcgggcggcggcgaattcatagccgccgaagagcagggtgtcgttggcgccggaggcgagcgtcgaccaggtcgattcggccagcgcgtagtcctcacccagcgccgcacgatagatctcgacattgcgcgcccagtggcgggcagccttttcagtgtcgggagccgccggtatcagcgccacctcgcgcagcacgcattgccccggccccgccggctccacccgggtcacctgggcgtgatcgggctggaccaggatcagggtgttggggaagacgaaatagaagatgttgccccagtcacgggtgacgaagttttcggccgccggcggatctgccggatccagccccgccttgaccagatagagccgccggttcaggccgaactcgtcgatgacctgaagattgtcggcgaacatgggcgcgatcgtgtcccgatgggcgatcttgaagtgataggcctcgaacgagccgtcgagcaccagcttccagtcgcaggcaagcggcagatcgcgcggggcatggggaacatggcttgcgaaacccagcgcctccagatcgtcggcgaccccggagagcagcggatcgaccggccgatcggcgaggcccggatcggtcaccacccagatcagcccggcccgctcggccaccgcaagccggaccagcccgcggccggcacggtccagatccggaaagccataggccttgggcagcgctttgagcgcgccgtcggtgccgtaggtccaggcgtgataggggcaggtgaaactgcgccggccggcaccgcagccgtcggccgtcaggcgcacgccccgatggcggcaggcattgatgaaggcattcacccggcccgtctcgtcgcgcaccagcagcaccggcacgcccgagatgtcgcgggcgatccagtcgccgggcttcgtcatctcaccggccgcggcggccacctgcgggaagcgccggatcagccgctgctcccgcgccagccgtgccggatcggcatagcgtgcgaccgggcttgcgaactgcgccgccggcatctcgggccggccggccgcaaggccggcacaggcgcggcgcagcaggtccagccggtcggcaatgtcgtggccgggcaacggatcagccggcagggttcctgcgggggtcagggtcatgggcgcatcctccggagaacaatgccgtccgggccgcggcagcgatcgccgcaacgaagccggcatcctcggccagtacggcatcttccggccgcatctgggcaaaagtgggcctgaccgccagcccataggcgaaggcaccgagcagcagggtcagcggcaccaccgccggcccgggcgccaccagccccgccgcctgccccgccgagatctcgtcgcacatccgcgtgacatagggcttgagcggcagatggcgggcgcggccgacccggtcgacattgtccagcagctcccgcagcaccagccgcgccgccgccggccggtcggccgtccaccgggcctgaaccccgatcatcgccgtcagacgaccgcccggttcgctaccggcggcatcgagtgccgccaccagcagcccgtccgcctctgccgccacccgctccagcaccgccgcgtacagccgcgccttgctggggaaatgatgcagcaacccggcattgcccaggccgcaggcacgggcaagagccgccacgccgataccgtgaaagccatgctcggcgaaggctgcctccgccgcgtcgatcagccgggcgcgggtgtcctcgccgcgttcgcgacgggactgaacagaaggctcgacggtgtcggcgagggcggggctgtgtgtcatagccccatttaactaaccgatcggtcggtctgtaaaggcctatgacagaaagatgctccaggacccgggccgctgatctgcgtactcccgtgctcgccgccagcaggcagcgcaaccgcatcaaggacctccaccggacacgggtaagccgtcaacaccccgtttgcggtgcggaaggtccctggatcgacggctgattttcttgtatgaaccgacgatggtttgaactgcgttgcccatgggatttctgacgtcaaatcgcctgggcggcatatcacttcagccggcaccacgctccggcggctggctcgacggccgtgccatagttctgtcggtcatctggcgtactgacgtaccgatcaggaaaaaggacccttcgacgtatgaagatcgtgatcacggggaaccagggatatgtcggcccgatcgtgggccgtcacctgcgccgcgcctaccccgatgccgttctggtcggctacgacagcgccctcttcgctcatgcctattcgggtgcggttcacgcgcccgagcgcgtgctgaatgcgcagatcttcggcgatgtccgtgacgtgccggcggaggtcttcgaaggggccgatgcggtcgtgcatctcgccgcagtctcgaacgacccgatgggcaacaagttcgagtcggtgaccaccgacatcaatcaggaagccagcatcgcgatcgcggccaaggcccgcgatgccggtgtgaagaattacgtcttcgcgtccagctgcagcgtctatggtttcgcgccgggtggcgcccgcaaggaaaccgatgagctggcgccccagaccgcctatgcccgttccaaggtcggtaccgaaaaggccctggcggcgatggatcgtggcgacatgaccgtcacctgcctgcgctttgccaccgcctgcggcatgtccgatcgcctgcggctggatctcgtgctcaacgatttcgtcgcctgcgcgatcaccaagcgcgagatcacggtcctgtctgacggcagcccctggcgcccgctgatcgacgtccgggacatggcacgtgccatcgactgggccgcgacgcggcaggccgacaacggtggcgccttcctcatcgtgaatgcagggtccgaccagtggaactatcaggtgcgcgatctggccgaagccgtcgcacgccatgttccgggcacctcggtcagcatcaacaaggatgcgcagccggacaagcgttcctacaaggtcgatttctcgctgttccgcagcctggcacccgatcaccagccgcaggtgaccctggaccagtcgatcgagctgctgcgggacggtctggagcgcatgggcttcgcggatgccgatttccgcaactcgccctatatgcgcctcaagatgctcgaaagccacatctcctcgggcgcgctgtcgaacgacctccgctggctcaccaccaacttcgagtgatcgcaccatgatcttccacgagacccccgtcgacggcgtgcgtgtgatcgaaccggaacgccggggcgatgaccgtggtttcttcgcccgtgtctattgcgagcgtgagttcgcagaggcaggccttgtgaaccattacgttcaggtcaacaactcgctttcggccaagaagggcaccctgcgcgggatgcactatcagttggccccctcgtccgaggtcaagctggtccggtgtgtgcgcggcgccctttgggatgcggttcttgacctgcgtccggactccccgaccttcggcaagtggttcggcgccgaactgacggccgagaaccggctgatgatgtacgtgccgcgcggcttcgctcatggcttcgtcacgctgaccgaggataccgaggccttctatctggtgagcgatttctatgcgccccaggaggaacgcggcatccgctggaatgatccgcgcttcggcatcgagtggcccgtggagccgaccgagatctccgcaaaagacgccgcctggccggattatgaccccgagtatcacggggtcgagcgtttcagggggatcaaatgaagatcctcctcaccggggcgagttccttcagcggcatgtggatcgccgagaagcttgccgcagctgggcatgaggtggtggcgccgctgcggtcggcgcccgccgcctatgacgggcttcggggcattcgggcggcacgtgtggccgctgtcgcggaaatcgtgcccggcatctcgttcggtgacgacggcttcatcggtctcgtcaagggccgggacttcgatgtgctcgttcatcacgcggcacgcgtgaccgactatcgtagcctggatttcgacgtgaccggtgccgtggccgacaacacgcaccgtcttcgtcaggtcctcgaggttatgagtggccgcagcctgaaggccgtggtcgcaaccggcagcgtttttgaaaacgatgccggtgccggcaacgagccccgggaagccttctccccctatgggctgtcgaaggcactcacctaccagatgatccgcttctggtgcggtcggctcggtatccggctgggcaagttcatgatcgcgaaccccttcggcccctacgaagaaccgcggttctgcaactacctgctcaagacctgggtgaagggcgatgtggccggtgtgaatacgccgcgctacctgcgcgacaacatccatgtcgatctgatggccctggcgtataccgacttcgtcgaaaccatggcgtcttcgcaggtcgaccggatctacggtcccatgggctatgtcgaaacccagggtgccttcgctgaacggttcgccgcccggatgcgcgagcggctgggccttgcctgcggcctttctctggccgagcagaccgacttcagcgaaccgctggcgcgggtcaacacctgccacatcgatccagcggccctcggctggtcggaaagcctggcctgggacgggcttgctgcctactatcgcgaacagttcggcctcgcagcgaactgatgcacatacgccgcgccgccgacgatgtatcgaacggacgagcccgccgtaccggcgggccatcgaacgggtgagttttcatgtcgcatgatttcgacacgatcatcgtcggcgccggtgtcgtcggcctggccgttgcccggctgatggccgcgaccggccgcagcgtcctggtcgtcgaccgccaggatggcatcggccgggagaccagttcccgcaacagcgaagtcatccacgccggcatctattaccccaagggcagccggaaggcccggttctgtacccgcgggcgccggatgctctacgcctatgccgctgaacgcggcattccgcacgcgaaatgcggcaaactgatcattgcgaccaatgatgacgagaccggcgtcctcgacagcctgcaggagcgggggcgggcgaatgatgtcgagggtctgcatctgatcggtcgcgaagcggtggcgcggctggaacccgacgtcacggccgtggcggcactggtctcacccgaaaccggcgttgtcgacagtcacgctttcatgctcgcccttcagggcgatgcgtcgaatgccggtgccgagttcatcttccatgcccccgtgaccggtggcgccgtgctggatggcggcggctatgcgctgcacatcggcggcatccacgacaccacggtctcctgtcgcgaactgatcgtgtcggcgggcctcggcaccaatcctttccttgaagccgtgtccgggctgtcgcctcgcgcgatccgcccgatgtatttcgccaagggccattatttccggctggccgagcgctcgcccttccagcgattggtttatcccgtgccggtcaaggggggacttggaacccacgtcaccgtcgacctcggcaagcaggcacggtttggtccggacgtgtgctggatcgacggtcttgactaccagttcgacgaaagccgccgggacgcattcttccagtcgatccgccgctggtaccccgcgatccggctggatgccctggtacccgactacaccggcatccgtccgaagctggtcccggcaggccagcccgacggcgattttgaaatcgacggcgtcgaccgccacggacacgaaggcctggtcgtactctacgggatcgaatctcccgggctgacatcctcactcgccatcgcggaagcgactttcggcctgatggagcccgcagcacgcgcagccgagtgatacccgaccgccccccgaccgcggaacgcccccgaccggaacgccccatgtccattgtctccacctaccggtcttcgaccggcgccgtcaccatcaccaccgagggcgcgatcgccacggtgcgctttgaacggccggaccggcgggtgaacccgctttcgcccgccctgctccacgatctggcggatgccgcccgccatctggcccggcgaccggatatctccgtcgccatcctgaccggatccgataccgccttctgcggcggcttcgacctcaaggatgatggcgtcgcagcccttgccgaagcctcggacgaagccctggccgaactcgtcgcccgggcaggcggcgaggcggtcgaggcctggacatcgaccccgccggtcacgatcgcggcggtcgaaggctatgccctgggcggcgggctggtgatggcgctgtcctgcgatttccgggtggcgcgcagcggtgccctcttcggcctgcccgaaatcgaccgcggcatcacgcccggctggggctgcctgccgcggcttgtggcgaccatcggcctgcagccggcccgccggatggcgatcctgggcgaacggctgacggcggagcaggcggcaccgctcggcctcgtcgaccgcatcgccgacggcgcgacccaggccctcgatctcgcccgggccatggcggcggagcttgccgccaagccggcgacaccgctcaggatgaacaagcgcatgctgaatgccagcgccatcgcccctctgaccccggcctcgctggtcgatgtcgaccagttcaccgggtcagcacgtggggcggccttccgcaccgaacgcgcccgcttcgccggcggctgagggggcctggtcgaaccgctactccctgctgtatccttgccgcattcacaacttccaatggttgatgcggcagggagaacccggtgagtcatggtcaaggcggtgttcacgaccagagtgtcgccgagctatgacgacctgcccgagcgctattaccatttcccgcgcagctatctgcgccaggtcgaggctgccctcggcgactggatcgtctattacgaaccccgccggcgttcagccgaccccggcagccgcggcggccggcaggcctatttcgccatcgcccgggtggccgggatcgagcccgacccggtccggcccgatcacttctacgcccggatcgacggctatctcgatctcgaacaccccgtccccttccgggcaggccctggcgacacctatgaacgcggtctgacgcggggcgatggcggcaccagcaagggcgctttcggccgtgcggtgcgaaatctgtcggatgcggaattcgatcgcatcgtcgccgccggcttcggccggctgatcgccccaccggtgaccgtctcgcagacggccgcacccttcgacggtttcggcgaggcaccggccgttttcgacgacgtgctgccctcgccccgcccgatgatcgagcgtctggtcacccgccccttccgcgaccgcgctttcgcggatgtcgtgcgccgcgcctatggccggcgctgcgcaatgaccggcctcgctctcgtcgacgccgacggccggggcgaggcagaagccgcccatatccggccggtcgccgacgacgggccggattcggtgcgcaacggcctggccctgaccggcacgctgcactggatgttcgatcacggtctggtctcggtggacgaggatcacagcctgctgctcgaccagggccgggtgccggacacgatcctgcggatcatccatcccgaccggcgtctggtggtgccggatatcccggatctccggccgcatccggaatttctgcgctatcaccgcagggagatctttcgcggctgatccgcttaacccgagaggccagatcgatccgatagccggcaccgcccccgatcgtgtggtccagggggccggcatgggccgccaaccgggccaggaacagccgggccgcttcctccccctgcagcgcctctcccgtcggccccagccagttcaccagcagacaatatccatccgccggccagagcccggcgatccgggccgcaagccggtcgatttcggccgcactcaggaaatagagcacctcggacagaatgatcaggtcggcggcaagctccggccagccttccggcagctccgcccgcaggaaggccacattcggccggtcggtacagcggcgcgccgcgatctccagcgccaccccagacacatcgatcccgatcacccgatccgcggtggccgaaagcagccgcgtcaattcaccgatcgaacaacccgcctcgatcgcgacccgccagcgccgcgccggcagcgcggccaggctggcgcggtattttccgcgttcataggggcgatcgcggaacccccagggatcggggtcgcaggcgtagagccggtcgaagcgccgctcacgcccggacatgagggccgccgtatacggatccgatgaacagctccggcgtctgcaggaaatgccggcgcgtctccggcgccatcacgaaaccgtccggatcgtcggcgatcagccgggtgacctgcgatctgtgacagcggatggcggcctgtttggcctggcggaagcccctgccgtcgaaccggtaaagccggtccggcggtgcaactgcggtttcggtgaagcgaccccagaccgggaaccgccagaaccgcaccccggggagcgcagccgccacccgggcgccgagtaccgcggtgcggcgatgatcgacatgcggatccccgtcccaggtggtccagagcgcgccgatgcgcgccaggcgggccagggcgaccacctgtccgcaggccctggccaggtccgcaccatcggccggcactccctggtcgggaaagccgaggtcgatgatccggtgacggctgcggccggccaggcagcggagcgctgcccggagttcggcctgccgcaattgcgccagcacggccggcggccagcgtcgcgaggcggggtgggaccgggtgccgtcggtcaccgccaccacgatcaccggcagtccggccgcagccgcggccgcaagagccgcgccacagccgaaggtctcgtcatcgggatggggggccagaaccatcaccggccggccgccggtgagcctgtggagatcgaccatcggcgccgccagggccgcgcgcagcacccggccacgggcaagcggcgtcaccacagtccgccctcgcgcgcggcgcggccagccagcgcccggccggccgcgaccaggcgggcatcgggggccgcctgccggatgaacagcgacaggtcgcggcgcaggcgctccaccggctgatcggtcatatgggcatcggtgccgagggccgcctcggacagtcgcagcacctcgacgcagacgtcttcgaccagctggcgagccagcagcgcatcggtgaccgccgcgtcgatacgggtagcggatgcggaagtgtccgccccggccgcttcaaccgccagcgccaccacctccagccgcgagaccgctgcctgaaccagccccaccgcccgcgcaaggcgggcaagctgaaacggatcgtcaagtcgccgccgcgcgtccagccggcgacgccaggcctcgatcagcgcctgggcaccgcccagatgggccgcgcaataccgccagatcccgccgtcgaaatggggcgggcgctgatagtcgccgggcccgccgagcagcgcgcctggcccggcctcaaggccggtgaagtcgtggcggcccgatgcggtggcccgcatgccggccgcccgccagtcctggcgccggtgccggcgacggtccgcgaccggcagcagcgccagacgcgtggccgtctcctgccccaaccggaaggtcaccactgcctgcgtgaccaggcccagccccgacgcgaagcgtttggccccggtgaaactcagccggtgtggggcatccgcggccgccgaccactcggccgtcagcggcggctgatcatcggccccccagacgccgagcgggcccccggcccgcaccccggccgccatctccgcgatctgcgcccgactgccatgaagcgtcaccagcttcaccgcatcgatatgcccctcgaccagccgcgcgaccggcaggctggcacgccccaggcgaagcagcaggtcgaacgccatccgggtggcctgcgggtcgcggccgaggcccaggccgagaccaccctccgcaggcggcagacaggccgtgaagacccccacctcccgcagccggccgatctcgggccccagatcccagccttcacgatccgcggcagccgcccccgcctcgatggcagccagggcgcgggaaagcggaatgtgggggagcaaggtgtgggagagcgggtccgtcgccatgtctgccgtcatggcatctcctgaaacaggcggtcggcatgttcttcgtcgccctccggccgcagcgcccgacaggccgccaccagccttggcaggccggccgccacatcgctcagccgcatgcgccagcgggcaagatgagggtgctgtgcctcgaccgccgcccagaccggcccgaagccggccgcgcgatctggcagacggccctcgaaaccgctccaccgcagcaacggcgccggatcgatatccgcagccaaaagccggcgcacccgcgcccgcaaggcggcccgcaaccacagcatgcccagcggctcgaaatcctcgtcggccggatgatccccggccaccaggccggcggccagggtatcggccagcccgccggctgcccggccggtcagccggcacgaggtcaccacccgaacggcgggatcgtgacgcaccggcaggccatgggcgcggatccggcgggcaaaggcgcggtcctcggcatgcgatacggcgggcaggccgcccacgcggtcccaggcccgggcggcgacggccaggctggccccgccgacctcgccatgagagggccaggggtcgtgcgggtccgggtccagccgcgccaccagttcagccgcatgccggcgccagcgcgcctgcaagcggtagcgcgcggtgatcgtcggcggcaggcggttgaattcggccggatcgaaagcgatgcgtccgcagaccagggccgcgcccttgccgagagcggcaagattggcccggacccagtcgggatccggtcgggtatcggcatcggtggtgagcagcacgccatcttccccgaccctggcgcgcgccagatcaagcgcctgccgccgggcagccccggcatgggccagatcccgcggcaagcggcacgacaccacgtcaaccggtatgtcggaggccatgggcagatcggaccgggcagcccacgacatcgcacgcgctgccgtgtcgtcgacggaattattgaccagcaccaggatccgcccgcgggccggccaggcacgggaagccgcctgtgcgcaggcctccaggcatccgatgatccgcgcggcctcgtcccgcgcggggatggcaatcacataggcggcatcctgtcgccagggcggaaccgacgacgccccgccatccgcatcctctccatcctgcacaccgcgcaccggcacccctccgtcagccatgaccagggcaccggtgatccgatgccggagacaacaaccggcgacgagcgatttggttcagatgttgggcaggaatggcgtccccggcaggattcgaacctgcgaccccaggattaggaatcctgtgctctatcctgctgagctacggggacaccgggcgcctccgggcgggcgggagcggggctccggcgggccgggacgggcggctgcctttaggtagcacgaaatcccggtggcacgaaagccccgtcggaccaggcggtggcgcgtgatcgtccggggggtcagaagctgcggggatggaggccggcctgcaacatccggcccatgcgatcgccggccgcgaccagggcgcggcgggtgccgggttcgaacgcggaatggccggcatcggcgatcatctccagcatcgccgaggaacccagatggcgggcgagcgcgacagcggtggccggtgggcagatgacgtcatagcggccctggacgatgtgcaccggcagtagccggagccgcgggtcggcatcgatccggccgagcagcggccggtcggccaggaaacagcgatgggcgaagtaatgggcttcaagccgcgacaccgccagcatggcgcgatcttcgtcggcgcggccggcggcggcagcggcgccggccgccagctgcgacaccggcctcagggtcgcacaggccccttcatagcccgaccaggcgcgtgccgccggcaggtggatgcgcggatccgggtccatcagcagcggcagatagcccgccagcggatcaccgcgcgcgctttccggcagatgccccagaaagccatcccgggcttcggggaagaaccgccccatctcgtggaggaaccaggcgacctcgtcatcggtgccgagaaagatgccgcgcaggatcagcccggtcacccgctcgggataggtggtggcataggcaagagccagggtcgagccccaggagccgccgaagaccgcccagcgatcgatccccagatggcggcgcagacgttcgatgtcatcgaccagatgatcggtggtgttggcccgggtctcgccatggggggtcgatcggccgcagccgcgctgatcgaacagaaccgcccgccagatccgcggatcgaagaagcggcgatgggcgggttccgtgccggtgcccggcccgccgtggaggaagaccacgggcacgccatcgggccggccgcaggcttcccaggcgagaacgtgaccatcgcccacatccagacggccacgtgcatcgggttcaatcggcggatggagatcgcggggtgcggcatccatcatcggcgggtctccactggcatcggcggccttccgcaggttcggcgactgtatcgccacccgaagtgtggccgatcccttatggggcacgcaagcgcagccatgagacaaggcgctacgccgcgtcatgtcgcagccttgtcacgcctgcacgggttgcctgatccggccccagccgccatctttgtcacggccggccgcgtcgtcgttacactcgcgtcgcccttccggcccctgccgttcaacatcttccgatccttcacgaggccgagccccatgcccgcagcacccgtgatcgcccccgcatccgaccgcgatccgtatcccgcccgccggtcccgtcggatgcatggcctgcgccggctcatcggtgcggcggtcatcggcgtgatggcggccggctgcgccggcggcccggcgaacagccagggcttcaacctgatcggcgatgagcaggcctccaagatgggggccgaggaacaccccaagctggtgaaggccttcggcggcgaatacaaggacgaaaagctgcagcgctatgtcgaggatatcggctttcgcctgatggcggtcaccgagatgaaggatgagcccttcaccttcaccatcatcgacagcccgatcgtgaacgcctttgccctgcccggcggttatgtccacgtcacccgcggcctgatcgccctcgctcatgacgaggcggagctggccggcgtgatggcgcatgaaatcggtcacgtgaccgcccggcattcggcccagcgcatgagcacgggcatgatcgcccaggtcggcgccgggttgctgggggcggttctgggcagcagcacggtggccaacatcgccaatatgggcgcgcaggtctatctgcagtcctacagccgcgaccaggaattcgaggccgacgaacggggcacgcgctatcttcaggccgccggctacgaccccggtgcgatggcgagctttctgcagcggctcaacgactattcgggctatgaggcgaaactgcgcggccaggacaacccggccgagcagttcaacctgatggcctcgcatccgcgaacccccgaccgggtggcccgcgccgtgcagctggcgggtggcgccacgggcgtgcggccggtggagccccagctggaggccatcgacggcatggtctatggctcgtcgcgcgcgcagggcgtgatcaacggccgcagcttcaagcatcccgaactgcggttcgccttcgaggccccgccctcttacgcgatcatcaacagcgacgagaacatcaccggctacggtccggaaggtgcccgcttcgtcttcgacatggcccgtgcgccgcgcaacatggcattgacggatgtgctggcccgcagcgccgccgagggccagccgcgcctgcagaatgtcgagcgcatcacggtgaacggcatggacggagccaccggtgtcgccagggtgcgggatcgcagcggcacgacgctggaggtccggcccatcatcctgcgcgccgatgccgacacggtttatcgcgttcagctgatcacgccggtcgacgtgctgccgaaggtgcaggaggatctgcggcgcttcacctacagcttccacagattgaccgaagccgaggccaaggcggtgaagccgctgcgcctcgacgtcgtcacggtcaagcgcggcgacacggtcgacagcctggtgaagcgcatggcgctgaacgaggacccggaaggtctgttccgcctgctcaacggcctgaagcccggggagacgcctgagcccggaaccaaggtgcgcttggtcgtccagtaatataggcctgagatcaggatcggggccggagatccacccgccgggtggagaccagtccggtcgcgatcgggccggtgtcgtccacccggccatcggcatcccgcaggaacagctcggcggaggcgacaccgatccggccgccgccatcgatcacccggccggtggctctgagcccggccgccctggcggggcgcagcagcttgaccgtgtagtcgagcgtcatcaacgcctcagacggcccgagcaaagtggcattggccgaggcgccggcgaaatcgaccagcgctcccaggatgccgccctgaaacagcccctgatgctcgcccagttccggccggaagggcagatccagcacgacatggccgggagcgacgtccagaaagtcgaagccgagcaggcgggctgcaggcatggacagcacgaaggcctgcaggcgtgcgcctgcgtcggtggtgcctgcgtcggtggtgccaggggcgatggtatcggacatgggcgacatctccgggatcagccgcgcggcggcgcgacgtggaaggtagcggcagcctgggcgatgaccgcatcatcggccaggatcagcgcccgggcgaaagccagcgtctggccggtccggatcatctcgggccggatctccagccactggccgatgcgccctgcccccatgaagtcgaccgagaggttcacagtcaccagcccgccggactccggccggtggagccagcaggtcagccccatggcattgtcggcaagcgccgagatcagcccgccatgggcgaggccgcgcgaattggtgtgcgcttcggccagatacagacccagatgaaaggccgtttcgctccgcttcgcccagatcggccgccaggggtcggtgaccgggctgcggcggtcgtgaagcatgaagccctcgggcacggaagaggtttcgacaggttcgacctgcattgttcgtctccatcaacccggatgtcgaagtcgcgtcgtctgacccgaagactatcatcgccgcccggacgacgccttcatcaacgcccccaatcgagttttagacgccattgggctgtatctgtcccgtggagtacaaccacatatcgtttcttctgccgcccccaaaaaaagccccggccgaagccggggcatagtgacgttcgccatgcgacagagtgtccacgaagaccggcaggctggctgcacgggctggccttcgcgaacctgatgagagacggggccggtcagccggcgaccgcctcaatccggtggcgctcgccggcctcgcgcatctggcgggtgatcgacgagcggagtttctcgatggcgcgctgctcgatctggcggacgcgctccttgctgatgccgagttcctcgcccagttcctgcagcgtgacggcgtcctcgcgcaggcggcgttcatggatgatgacccgttcccggtcgttcaattcgcgcaaggcccggcgcagccagcgagagcgggtaccggcatcgcgcagttcgaccaccacttcctcggggccagggcgatcatcggccagaaaatcgacccagctgtcgccacccccctcgctgtcgacacctgcatcgagcgactgatcggcagccgaaagccgaccctccatggcctcgacggcggcaacgtcgacccccagctccagggcgatcttcaaccggccctcatggctgatcgggccgttggtgccttcgcccaaccgggcccgcaatcggcgcagattgaagaacagcgacttgtcgcctgcggtggtgccggtgcggacgatcgagtggttgcgcaggatgaagtcctggatcgcggcgcggatccaccacatggcataggtcgaaaagcggacattgcgatcgggatcgaaccggcttgcagccatcatcagcccgacattgccttcctgaaccagatcgcccatgggcagtgcatagttccggaagcgggcagccagggagaccacaaggcgggcataggcgctgaccagacggtgcagggcggcttcatcacccgtctctcgccaggcgcgggccagggccagttcctcctcgcgttcgagcagaggggcccgcatcgactggcggatgtaccgccggtcggcggtctgcgagtcctgggtgtcgaggtacgccatggccgtctcccgtcgtccttgcgccgagtctttgccttgttgcctccggtctacgcggtcaggcgggcaatggatcacccggcctgcaggaaaaacacggggcgggccgattcggatgcagtccggacggatttttttgaccgtcgggcaacgggcacgcaacgggccgcaaaaaaagaaccgcccgggcgcgaaggcccgggcggttcaaaaccggatcgccggtgatctgccggtcaggcagcggcgtcgagcagggtctcgagcttgatcgcggcggtcttcaggtccagctgctcgacggcggcgtattcacgcgccagccggtcgagtgccagctgatacatctgacgctcgctgtaggactgctcggcctgatcgccggtgcgatgcaggtcgcgcaccacctccgcgatcgaggtcggatcgcccgaattgatcttggcttcgtattcctgggcgcggcggctccacatcgcgcgacggacgcgtgcccggcccttcagcgtgtcgagggcggtggtcatctcgaccatcgtcgagagcgcccgcatgccggccttctcggccttgatcaccggcaccttcagcgtcatccgatcgtcgtcgaagcggatcacatagagttcgagcggcatgcccgcgatctcctgtgcctcaaccgcttcgatcttgccgacgccgtgcgccggatagacgaccatgtcgccggtaccgaacctcttcttcgccatggctccgcttccgttctgacgaaccgctcccgcagggaccgccgtgcaagcctctcccgccgcagccatccgaaggcggcccggcagggtcggcggaaaaaccacccctggcgctcacatcgctgtaagcacccgggcatgctgcaacgcggcgatgccgcttcgggaggacgagacggccgggggctcgcgctccgggccgcgggactcattttgccgatgacgatcggggtccggctgccggctccactgaagagaaccatcctcaaccgggctctggagacccgctcagggtctcggactcgtcatcctggtgcaaaaatgaagataacatgacgggcttacgagataaagccccgcgcacatgcgtcgagcgcatgtgcgcggggcctgatccgcatggccggaaccgaccggatgaaagtgtccgcgctccgggaagaacgtccggcgtcagccctgctggccgggcttgtcgctgaagtggttcgcaagcttgtcgggaacaccgttccattcgtcggcatcagccggcgcatcacccttgcggctgatgttcggccacagctcggcatatttgcggttcagttcggcccactgttccaaaccgtcgtcgctgtcgggtttgatcgcctcggcggggcattccggctcgcagacaccgcagtcgatgcactcgtcggggtggatcaccagcatattctcgccctcgtagaaacaatccacggggcacacctcgacgcagtcctgatacttgcacttgatgcagttgtcgacgaccacgtaggccatgattgctgctctcctcggaacacgttcggcggcgtaggacggcatgcggagcggcagtcgtcggacggcgcatcattttacaaccgcgacgtgcgttatcgcagtgcggtcctgtcttctgacgcaaccatactcaatccgcagcgccggaaaagtcctttgtggaagcatttttccggccgatccgcaacagcgaatgtggtcgcatgccggatcaccgtcggattgcgtgccgcccgcaccgcctctcaggccggcgcccccaccgattcagcaagcatcggcgccgccggcgttgccggacgcagatcggtatagagcccccgcgcctcttccgtcggcccccgccgttcggccagccgcgccacctgtaccacccggatccggttcccccacgagaaggtcagaacgtctccgggtttcaccatctgggccgccttcgtgaccggcatccggttgagccggatgagcccgtcggcacacaaccgtgccgcctgggtgcgcgatttgtagaaacgcgcacaccagagccatttgtccagacgctgtcggccggcttcaacgcctgcagtcagggcgaggtcgtcggttggcaggatcgcggcaaagccgacggcatccttgtcggaagaacggtttcgataggggtggtcgatctggtccgtggcgggcctctgggtcatcggctggcacctctgcggatacgtgcggagccttgggacgatggccgcccatcgcgctcccgcgcgggggcggccggggatccggcgccctgaaccagggcgccgagcttggcgaaggggttgccgggatcgacggccggcgccgctgcggccgggggccgggccggcttgcggctgcgatgcggcttgcgggcacgatcgctccgcgccggcagcaccgtcatccgtccatcctcggcggtcctgaccggatggcccagggcggcgagcagggccggtgcctcggcctgcgggcaaccgagcggcgccagcaggccgggctcgaccgcgaaaccgtcgcgtgcctcgcgcagccctgccctgatcccggcatccagccgctcgatcatgtcgacgcgcaccgcgcgcgggccggccgcaagatatcccgcagcggccagggcacggatggtcccggcggcatcgggcagggtgagcgatgttcgcaccccgtcggcggcctcgggcagggagcctccgtagcgcgccgccaggaacggacgccgcatccggatccgcgccggctcgaacagcggcttcagatacagccagcgccggcccagccggacgccgaaccgggcgaggcgctggcgctggtccgcatcgagaccggcaaccagatcggctgccgcctctgccggcgccacgccgccgccttcgaccagccggaaggcgatacctcgcgcagcgcctttgagcgccgccgcctccagccgaagcagcggctcgtcggcctcggcggccctggccgccagcacggcctcgacccgacggaccagatcggtcgtggcctcggacggaagatggtcgcgatgcgacagaaccaccttcggccggccgtcgggctcggcgcccagccggccgagcacagcgccttccacggtgacggccgggctatcccccggctcttcgaccagcgccaccaccgggcccagatcgtcgcgggccgccagccgggcgaaacgcgcctccaggaagcgccggatcgatttgcgcacccggtcgcggaccgggcggatctcgagcagacccgccgcctctccgctcggccggaagtcgaaaccgtccagcctgccgacctcgcggccgtccagctcgacggcgccgtcatgggcgaccaccggctccacggcccgccaggcctcggcctgacggctcgcacgagccatgtcgcgatcgacgaagcgctgggtcagccggtcgtgcagggcgtccgacaaccggtcctcgatccgccgggcctgaagctggaactcccccggatccgccagccagccggggcggttggcgacatagctccaggtgcggatccgggccagccgttcggtcagccggtccagatcgccatcgacccggtcgagccgggccagattctcgccgacccaggcccccggcagccgcccctcgcgctcgggctgggtcaggtgcaggaacagccggcgcagcaggccgacatgggccgcgcccaccgccgcatggaaatcgggcacccggcagacttcccagagcagcttgaccgcctcgtaaccgcgggcgcgggccatcagctcgggctgtcgcgccatatgggcgagcgccagatggtcttccgccggcggagcgggggccagcgcatccagatggggctgcacgtccaggctgcgcagcagcgcctcgacgctgcggaaatcaagctcgcgcgagcgccagaacagccggcgcagcggctggaaatcgtgatcctcgatcgcctcgaccagatcaggcgacaggccgccgatctcggccgtggtgccgaagctgccattgcgcagatggcggccggcccggccggcgatctgggccagttcctgcgccgtcagcggccggagatcgcggccgtcgaatttgcgggtggcggcgaaacagacatggtcgacatccagattgagccccatgccgatcgcatcggtcgccaccaggaagtcaacctcgccctcctggtacatctcgacctgggcattgcgggtgcgggggctgagcgcgcccatcaccaccgcggccccgccgcgctggcggcgcatgatctcggcgatggcatagacgtcggcggccgagaaggcgacgatcgcggtgcgcggcggcaggcgggtcaggctcttggcgccggtatagaccagcttcgacatgcgcggccggctgtcgatctcaatgcccggcagcaggcggcgcatcagcggcgcgatggtctcggcgcccaggaacatggtctcggcaaagccgcgggcatggagcaggcggtcggtgaaaatatgaccgcggtccgggtcggccgcgagctggatctcgtcgacgcaaaggaactcgacgcccagatccagcggcatgctttcgaccgtgcacaggaaatagcgcgcctcgggaggcacgatcttttcctcgccggtgatcagcgcgaccttgtcggcccctttggcccgggccacccggtcatagacctcgcgggccagaagacgcagggggaaacccatcatgcccgtgcgatgcgccagcatccgctccacggcaagatgggtcttccccgtattggtggggcccagcaccgcacgcagccgtgccgacccttcgggcgcaatcgtcatgagagaagaatcgtacggccgcgcctccggttcaagtgcggatctgcgacggaatgaagacggccggatgacggcggccatcccgcggtcccaagggtgcggccacgcccttgatccgtgacgaaccgcacatatatcgggcaggctttcgcgccacccgcgcatgcctgaccgcgtgtggccggctgccgatgccagccgaccttcgcccttccatcattgccctgccgaacggacctgatcccatggctgaagccctcgatactgaagagacccgcgtgttcgatgccgatgtcggccgcatcctcgacatcgtcgcccatgccctctacagcgagcgcgaagtcttcctgcgcgagctgatcgccaacgccgccgatgcctgcgacaagcgccggttcctggcgcagaccgacgaggccctggcggagggcgccggcgacccggcggtgaccctggtgccggatgccggcgcccgcactctcaccgtctccgacaccggcgtcggcatgaaccgcgacgagctgatcgccaatttgggcaccatcgcccgctcaggcacggccgaattcgcgaagaagctctcgggcgatgccgcaaaggacgggagcctgatcggccagttcggcgtcggcttctattcggccttcatggtcgccgacgaggtggtggtggagacccgcaggctgggtgagccgcagggctggcgctggacctcggacggccgcggcggctaccggatcgagccgatcgcccgcgacaccgtcggcaccgacgtgatcctgcgtctcaaggaggatgccgccgaattcctcgacccctggcggctgaaggccgtggtcaagcgctggtccgaccacctcgccctgccgatccggctggacccgcgcaaggccgagggcggcaaggaggatgagggtgtcgagaccatcaacgccgctcaggcgctctggacccggcccaaggccgagatcgagcccgagacctataccgcattctatcgcgacatttcccatgccttcgacgagccctgggcggtgatccacaaccgcaatgaaggcacgatcgaatacaccaacctgctgttcatcccgaccgaacggcccgccgatctctacgagcccgagcgcaagccgcgcctgcgactgcatgtccggcggatgttcatcaccgatgactgcgaagccctgctgccgggctggctgcgcttcctgcgcggcgtggtcgacagcgccgatctgccactgaacgtcagccgcgagatgctgcagaacacgccgctgctgaccaggatccgccagggtctggtgaagcgcgtgctgggcgaactcgaagggcgggcaaagtccgacgccgagggctatgcgcgcttctgggatgccttcggagcggtggtcaaggaaggcctgtacgaggatttcgagaaccgcgaccgccttctgggcctcgcccgcttccggtcgaccgccgtcgacggctggaccagcctcgccgactatgtcgcccgcatgaagcccgagcagaaagcgatctatgtgatggtcggcgacagcgtcgaggcggcgcgtgtcagcccgcagcttgaaggcttcaaggcccgcgggctggaggtgctgctgctcggcgacccgatcgacggcttctggaccatgatcgcgcccgatttcgacggcaagccgatccgcgccgtgggccgcgtcgccgatgacgaactcgcggccttccccaaagtggatgcagacggcaaggcggcgcccgagacgaaggacgaggccgccgaaggtgaggccggcatcgacggtgccgccctcgccgatctgatcggacgggcgctcggcgaccgggtgcgggcggtcaggccctcggcccggctggtcgacagcccggcctgcctcgccgccggcagcgacgggccggacccggcgctggagcggctgctggcgcggtcgggccgcggcggtccggtgcgggcaccgatccttgagatcaaccccgaccatgccctgctgaaagccctgaagggcctggctgccgaggcgggtgaggatgcggcggcccgtgccgccgcgctggccgagccggccgaactgctgctcgatcaggcacggttggccgaaggcgaggcgccggcggatcccgccgcctttgcccgccggctggcccagctgatgacccgcgcctatcgcgcctgatcatccttcggcgcgggggcatccgcgccgccctgatccggggtcgccgatccgtcggcggccccgttttcgtgatccccggccggcttgcgggcaggttcgaccggttccgccggaacgtcgccgttccgcaggatcaccgcttccggaaccaccaccgggtcgacggcaggtgcttgcgtggctgcggccatcatcgcctcgtcgctttccagcggcggctcggcgcccgagatgtcggtcgccatcaccgtcaccaccggcgtggtgcggggcgagaccacggccggggtcttggcgctggccggcacctgcggccggatccgggcacgatagatggcaaaggccgccagcaccgccccggccagcaccgcccaggcgaagagacccgaggggccgaccaggctcatgatgcccgaggccatgatcgggccgatcgccgagccaaggccgccgccaagcaccagcccgccggcggcggcgatcatccgtcccggttcgaccagatcgttcacatgggcggtcgcgaccgggtagagcgcataaccggcaccgccgacgatcaccgcgccgatgaacagcagccagatggctgcgcctgccgggatgatgccggcgagaagccccgagcccgcgagcatgccgtcggccggcgtttcggcctggggcatgctgccggccccggccatcaccaccaggctgccgatcgtcaccatgatcgcagcccccgccagcacgcggcggcgatcgatccggtccgacagccagcccaccggccattgcaggaacagcccgcccaggaagaccgtggcgacgaaagccgacaccccggccgtgtccaggccgatgccgcgcgcgaacaccgcacccataccgccctggatactgccgatgatcagcccgctggagatcacggcggcgagacccagcggcgaaacccgccagagggacaaaaggccaagccggggtgcggcatggatctcgggcgtcaggctgcgggtcagcgccagtggcaccagggccagagacagggccatggcggccagcgcatagagcagcggcatccgcacgtcttccagcgtcagcaggaactgaccgccggcaagtgccaggttgagcgagatgatataggccgagagcaccttgccgcgggtctggttggtgctggccgagttgagccagctttccgcggtcatgaacagtgccgccatgcaatagccggtgacgacacgcagcaatgcccagccgaccagatccagaaagaagccgagcgacaggatcgcgaccgagccgatcgccgcaaaggccgagaaggcccggatgtgcccgacccgcacgatcacccgctgggccgtggcggcaccgatgatccagcccacgaaatgggccgcaccgaccagaccgatggcgatcgtgctgaccccttccacggcgagcctgagacccaccagcgaggagagcatgccgttgcccagctgggcgatggcgatgctgagcagcaccgcggcgactgaggcgagaaccgtactcatcgggcgaaatccggccgtaaacctgcggccgtcctgtcttacggaaaagggcggcaccggcgcggcggcaggggcacgggcatccggtgagatgacacgtgcctagtaaaccatgcggcgcgcagccatgccacccgccggccgccggctgcgggaattgtcgtcgaaacgacacacgccccggcgccagaggcgccggggcgtgtggatctcggcggcgaaagcccgatcaggcctggccgctcgcgatgcggcgcagcacgtagtgcagaatgccgccgttcttgtagtactccagctcgtcgagggtatcgatgcggcagaccagcggcgcctcgaccacctcgccattggcgcgggtgaccttgagggtcagcgcctggcgcggcttcaggtcgttgccgaggccgacgatgtcgaaggtctcggtcccgttgaggccgagcttcgcccggtcccagccctcgccgaagaccagcggcaggatgcccatgccgacgaggttcgaccgatggatacgctcgaagctctcggcgatgacgcccttcacgcccagcagcatggtgcccttcgccgcccagtcgcgcgacgaaccggtgccgtactccttgccggcgaccacgaccagcggggtgccggcatcgatgtagcgcatggccgcatcatagatgctgagctgctcgccggtcgggatgtggcgggtgtacgccgccctcgacgcccgggaccatctcgttgcggatgcggacattcgcgaaggtgccgcgcatcatcacctcgtggttgccgcgacgggcaccgtacgagttgaagtcggcgggggccacgccatgctcggtgagatagcgggcggcggggctgttcttcgcgatgttaccggccggcgagatgtggtcggtggtcacgctgtcgcccagaatggcgagagcgcgggcgccgttgatcggcgcgatctcgtcggacgccaccggcgacatgccatcgaaatagggcggcatcttgacgtaggtcgaggcgtcgtcccattcgtaggtctcgccttccggcgcctgaatggcctgccaggcggcatcgcccgagaacacgtcggcatattcgccgcggaacatctgcgaggtgatgaccgagcggacggtctcgcggatctcggccgaggtcggccagatgtcgcgcaggaagaccgggctgccgtccttgtcgtggccgagcggctccttgtccaggtcgaccagaaccgagccggcgatcgcgtagaccacgaccagcatcgggctggccagatagttcgcgcgcacgtcggggttcacacggccttcgaagttgcggttgcccgacagcaccgaagtcacgaccagatcgctggcattgaccgccgccgagatcggctcggccagcgggccggaattgccgatgcaggtggtgcagccataaccgaccaggttgaagccgagcgcgtcgagcgcatcctgcacgccggcggcgcgcagatattcggtcacgaccttggaccccggagcgagcgaggtcttgacccagggcttcaccgtcaggccgcgctcgaccgccttcttggcgaccagaccggcaccgagcatgacgtccgggttcgaggtgttggtgcagctggtgatcgccgcgatggcgacatggccatgcgccagcttgtaatccgcaccggcaacctcggccacgacgtcggcggcggtgcccttgttcttggtcagggtcggcaggctctcgcggaacgaggccggcacggtcgagagcggcacgcggtcctgcggacgcttcggaccggcgagcgagggctccaccgtcgacatgtcgagttcgagggtatccgtgaacaccggatccggcgagccggcctcgcgccacatgccctgagccttggcataggcctcgaccagcgccacggtctcgtcgtcacggcccgacagacgcagatagttcagcgtctcgccgtcgatcgggaagaagccgcaggtcgcaccatattccggcgccatgttggcgatggtcgcacggtcggtgaggaccatgttgtcgaggccttcgccgtagaactcgacgaacttgccgaccacgcccttcttgcggagcatctgggtgacggtcagcacgaggtcggtggcggtggtgccttccttgagcttgccggtcagcttgaagccgatcacctcggggatgaccatgctgacgggctggcccagcatcgcggcctcggcctcgataccgcccacgccccagcccagaaccgccaggccgttgaccatggtggtgtggctgtcggtgccgaccagcgtatcgggataagcgacggtccggccgtcttcctcggcggtccacacggtcttcgccagatattccaggttcacctggtggcagatgccggttcccgggggcacgacgcggaagttgttgaacgcgccctggccccagcgcaggaacgaataccgttcggcattgcgctccatctcgagatcgacgttctcttcgaacgcggtcggggtgccgaaccggtcgacctgcaccgagtggtcgatcacgaggtcgaccggcgagagcgggttgatgcggttgacgtcgccgccgagctgcttcatcgccgcgcgcatggtggcgaggtccacgaccgccggcacgccggtgaagtcctgcatcagaacgcgggccggacggtaggcgatctcgtgatcgctcttgcggtccttcacccaggcgacgagggccttgacgtcggcgtcggtgacgctgcggccgtcctcgtagcggagcaggttctcaagcagcaccttgagcgagaaggggagctgcgagacaccctcgaggccggcggcctccgccttgggcaggctgaaatagtcatacgccttcccgtcgaccgtcagggtcgaacgggtgctgaagctgtcaaggcggttcgctgtcacgacgacctctcctcacgatggaccttgtcgccttgtcttatcgactgacgggcatcgcgttcgggcgacgggtgacgggcccgcctcgccggcggccgcgtcacctcggaccggggcaggcatcggtcgcaaggaccagaatggcaccggagaggggtcgggtcggacggcggacagacgggagtccgccgcggccatcctgttgcagatatacccgaccccggaagatcccgggtgggtgcaccgcaaacggacgtcgcggcgtcgatgccgcgttcgcgcgccgtgatatcagggatcgcccggaaagtctacgaaaaccgccgccttgcacgatggtcggggggtgggtcaggggccgggcgcggggcaggttcgggccgcgccgcaccgcagtgccgtcaccgtgcacggcgcgtgccgggacggtggagcgccccccgccccggctttccgcccccccgctcatccggcgccccctgtcggtcggacctgatccggccatgcgtgccggtggccgcgcgcgtgatcatcgacagtttgcgtgtgtgatcatccacccttgcacgccgtgtcgcgaaggcccgccagcatcatcccccagtatgataacggcgttattgaaatattgctgggtttgccttcgtaactttggcaaacagacaatcgtcacgccacttgggatttgacccccggggcgacgtggtgatgtaatgtcatgacaaaacggcatgacaaaacaaagaacgaggcgcagccgccgcagcttccgtgaccggtctggtatctggggatgccggggaggaccggccggaacgacggatggacaccgggagccgttgcccgttgcgccccatacagggagacccgaggcccatgggcgaacagaccccgctcctggaggtcaaggacgtatcgttgcgattcggcggcgtgcgcgccctgaccgaggtcagcttccacgtccggcccggcgagctgttctcgatcatcgggccgaacggtgccggcaagacctcaatgctgaactgcgtgtcgggccgctacacgcccaccgagggccgcatcctgttcgaaggccgcgacgtgaccgggctgtcgcccaaccatcgcgccgccctcggcatcggccggaccttccagaatctcgcactcttcggccatatgtccgtgctcgacaatatcatggtcggccggcatcacctgctgaagaacaacgtcttgaccggctcgctctactggctgggcggcgcccgccgcgaagagctggaacaccgccgtgcggtggaagacatcatcgacttcctcgagatcgcccatgtccgccgtgcgacggcggggcagctctcctacggcctgcgcaagcgggtggagctggcacgggcgatcgccctcaggcccaagctgctgctgctcgacgagccgatggccggcatgaacctcgaagaaaaagaggacatggcccggttcatcatcgacctctccgaggaatggggcatgaccatcatcatgatcgaacacgacatgggggtggtcgccgacatttcgcatcggatcatggtgctcgatttcgggcgcaagcttgccgagggctcggccgacgacgtgctcaacgacgagcacgtcaagaaggcctatctcggcgaggatgacgacgaagaggcggtggcgtgatgtcccagcaattccccgatttcacgatccacgacactctgccgaaactgctcgcgcacaatgcggccacctacgggtccgaggtggccctgcgggagaaggaattcggcatctggaacgagttcacctggtccgactacaacgaccgggtgcgagagatggcgctcggcctgatttcgctcggcgtcgcccggggcgaggtcgtggcgatcctgtccaagaaccggcctgaagccctctatggcgagattgcgatccatgccctgggcgggatgagcctcgccatctaccaggacgccatgtcgagcgaggtcgcctatctgctcaactacgccggcgcccatgtggtgctgtgcgaagacgaagagcaggtcgacaagctgctggaactcggcgacgacatcccgacggtgcggaccatcgtctatgccgatccgcgcggcatgcgcaaatacgatgatccgcggctcaaggatctggcagaggtctatgaactcggccgggcactccacggccgggagcccgaccgctatgcacgtgaactcgcggccggcaaaggcgacgacgtcgccatcctctgcaccacatcgggcacgacctcgaaccccaagatggccatgctgcagggggggcgctttctcgagcattgcgcacgctatctgatggtcgaccccaaaggtccgaccgatgattacgtctcggtgctgccgatgccctggatcatggagcagatctacgccgtggcacagccgctgatctgccgcatccgggttaacttcgtcgaagagcccgagacgatgatggccgatctgcgcgagatcggaccgagcttcgtgctgctggccccgcgggtctgggaacagatcgcggccgatgtccgcgcccggatgatggagagcacgcctctcaagaacgcgctttatgatttcggcatgaagcgggcgctgaaggcgctggagcagggacggcgatcgaaactcgctgatttcgtgctgctgcgggcgctgcgcgaccggctgggcttctctaatctgaaatcggccgcgaccggcggtgcggcactcggccccgacaccttcaagttcttccaggccctgggtgtgccgctgcgtcagatctacggccagacggaaaccgctggcgcctacaccgtgcacctggccgacgatgtcgacatgaacacggtcggcaaacccttcccgggcgtcgagatcaggatcgtcgcccccgatgaaaacggcgtgggcgagatcgtcgcccgtcatgacggcctgatggccggctactacaggaacgagaaggcatcggtcgaggatctgcgcgagggctggatgtattccggcgacgccggttacttcgacaagaagggtcatctggtcgtcatcgatcgtatcaaggacatcgccgagaccgcgaaccgggtgcggttctcgccccagttcatcgagaacaagctcaaattctcgagcttcatcggcgaatgcgtggtgctgggcaaccagaagccgttcatctcggccatcctctgcatccgctattcggtggtctccaaatgggccgagcagcgggggatcgcgttcaccacctataccgacctttcggccagggcggatgtctatgatctgctgcgtcaggaggtggagcgggtgaacgagaccctgcccgaggcccagcgcatccggcgcttcctgctgctctataaagagctggacgccgatgacggcgagctgacccgcacccgcaaggtgcggcgcaacgtcatcaacgagcgctacggccggatcatcgacgcgatctacaacggccgcgacgacatcgacatcgacaccaccatcaccttccaggacggcaagcaggcgcggattcagacggtcctgcgcatcgtcgacctgggggcgccggtggtaccgctgcgcaaggcgagctgaccgccacgccccgccaggtttcgggcccgctgcggccccaggtttccgcccggaggggccgcagcgccggccctgcgcaagcgaggagctttccgcgccatgacgtcttcacttttcgtacaacttctggtcaatgggctgatcgtcggcacgctttacggcgtcgtcgcgatgagtttcgtgctgatctacaaggcctcccagatcgtcaatttcgcacagggtgaattcctgctgatcggcgcctgggtgtgctggtggatcatgaccgatctgcagctgcccttcttctggtccttcctcttcaccctcgccttcatggtggtgttcggcatcctgcttcaggtggtggtgctgcgaccgctgatcggtgaaccgatcatctcggtgatcatggtgacgatcgggctctcgatcttcttccaggcgatgatgaagtggatgttcggcgtgttcgtgcagcccttcccgccgatcttcgagaccagttcggtcaccatcctgggcctccaggtccagaccgcctatgtgatgagcctggtgatctcgctgatcgccatgggtctcttcgcctggttcttcaaattctccaagatcggtctcgccatgcgggcgaccgccttcaaccagcaggtcgcccagtcgctgggcgtctcggtgaagcagatgttcgccatctcctgggcgatctcggcggtggtctcggcgctggccggcgtggtggtcggcatcgtcaacggcgtttcggccggcctgtcgctcttcggcttcaaggtgttcccggcggtgatcctgggcgggctcgactcgatcatcggcgcggtagtgggcggcctgatcatcggcgtgctcgagaatatggcggaatatgtcgacggccagttcctgcacatcggcaacctctatgccgtggcccccttctacgtcctgatcatcatcctgatgatcaagccctacgggctcttcggcaccaagaacatcgagcgcgtgtgaggccggaaccatgagcagcatgtccctccgcccctgcggcgactaccggacctcttacgccaaggacacgacgattttcccgacgaaatggtcgcggaatttcgccatcctcggcctcgtcctggcggcgctcttcccgctgatcgccagccagtaccacatgaacctggcgatcacgatcgcgatctacggcatcgccgccctcggcctcaacatcctggtcggcttcaccggccagatctcgctcggccatgccgccttcttcggcttcggtgccttctcgtcagccttcctcaacaacacctacggcgtgccggtggtaatcgccatcccgctcgccgggctcatgaccacggcggtcggcctgatcgtcggcatcccggcagcgcggatcaaaggtctctatctcgcgatcgcgacgctggcgtcgcagttcatcctgcaggacttcttctcgcgggcggacttcttcaccggcggttcggcgggcgcactcgcccagtcgttctcgctgttcggctgggaagcctatggcgagcacaacttctactacgtggcactcgtcttcatggtgatctgcttcctgctggccaccaacatgctgcgctcccgcgacggccgggccttcgtggcggtgcgcgatcactatctctcggccgaggtgatgggcgtcaacctcaccaaataccggctgatgtccttcggtgtcagctcgttctacgccggcatcgcaggcgcgctctatggccactatctgggcttcgtctcggtcgaaagcttcaccatcctgctgtcgatccagttcctgggcatgatcatcatcggcggcctcggctcggtgatgggcacgctgatgggcaccgccttcatggtgctgctgcccgaggttctggaaggcgtcgtctcggccatgaacggggccggactgatcggcgcctcgttcatgaccaatgtcgccttcctcaaggaggctgcgatcggcctggttatcgtcctgttcctgatcttcgaacccgacgggctcgcccatcggtggcggcagatcaaggcctactggaaactctatccgttctcgtactgacccgttgccgtcgcggcgccgaccgcgacggtacccggccccggcgggcccggatctcgcgccccgcgcgtatgcaccctgcccgccccatccgcagccgacaacggccgcgatcgaagacaagaacgaagcattccgcttcttcagggagagacacatgtccaggaagactctgaccggcgcgttcgccgccatcctggtcgccggcgccgcctcagcggcgattgcggccgacgacatcaagatcggcaacctggtcgactacaccggtgcgacctcgacggtcagcaagccgttctcggaaggcaagatcgatgccttcaactggatcaatgcccatggcggcatcaacggcaagcagatcaccgccgataccgtcgactattcctatcaggcaccgcgcgccatcgccgcctataagcgctgggtgtcggaattcggcgctgtggcgatcgcgggctggggcactgccgacaccgaagccctggtcggcttcctggccaaggacgagatgccttactactcgggctcctattccgcccatctgaccgatccgaccggcaagtcgggcgtggtcaaggcgccggctccctacaacttcttctacaacgtgtcttattcggatgcgctgcgcggcatgctgcagtgggccgccgaggactggaagaagcagggcaaggagggcaagcccaaatacgtccatatgggcgacaaccacccctacccgaatgccgcccgcaaggccggtgaggaatacgccaaggagctgggcttcgacgtcctgccggcgatccagtactcgctcgcccccgccgacttcaaggcgcagtgcctgacgctgaaggaatccggtgccaactacgcctatctgggcaacacggccggttccaacatttcactgctgaagagctgcgagaccgtcggcgtcgaagcacagttcatggccaacatctggggcttcgacgagagcgccgccgaggccgccggttccgccgccgacggcgtggtctgggtcgtcggttccgccacctggcaggacgatgccccgggcatgaagctggtgcacgagatcgccggtggcgacggctatcgcccggtccactatgtccgcggcgtctgcacggccttctacatgaaggaagccatggagtgggccgacaagaatggcggcgtcaccgggccgaacatcaagcagggcatgtaccagaagaccgactgggtgccggccggcctggaaggcgtgtgcttcccctccacctggacgcccgaggaccatcgcgggacgatcgacatgtatgtctatcagggtgaggtgaaggacgggaagttcgccatgaaccgcctggccgaaacccggatcgaccgccgccccgagtggctgggctggtgatccgacgggacccgtctgccgcgacacggcggcggacgggtcctcccctcttcccgacccgaccactctttcctgcacgagacctcgcatgtcgatgacccagaccgccacatccggcccccggcccggcaccggcgcccgccccgcggcggaagccgagccgatcctgaccgtcaacaacatcgaggtcgtctacaacgacgtgatcctggtgctgcatggcgtgagcctgaacgtgccccagggtcagatcgtgaccctgctgggggccaacggcgccggcaagtcgaccaccctcaaggccatctcgggcctgctcaagagcgaggatggcgagatcacccgcggcgacgtcacgttcatgggcgagaagatcagcgggctcgaaccccaggaaatcgtcaagcgcggcctgttccaggtgatggaaggccggcgcgtggtcgaggatatgaccgtcgccgagaacctgcgcctgggtgcttatacccgccgggacagcggggtgaaggccgatatcgagatggtctaccactacttcccgcgcctcaaggaacggaccgggctttccggctatctctcgggcggcgaacagcagatgctggcgatcggccgcgccatgatggcgcgccccaagctgatcctgatggacgagccgtcgatgggcctgtcaccgctgctggtgaaagaggtcttctcgatcatcaagcagatcaacgaagaacagggcatgaccattctgctggtcgagcagaatgcccgtcaggccctcaagcacgcctcttacggctacatcatggaaaacggcaagatcgtgctcgacggcagccgtgacgacctgatgggcaacgaggacgtgaaagaattttacctcggcacgggtggcggcgagcgcaagtcgttcaagtcgatcaagtcgttcaagcgccgcaagcgctggctctgatctccggccacttctcccgcaaccagacaccgacgggcgcccgccgcccccgcatccggtacaggacgatgaccgacagcatccattacgacgaccgtgagaccatggatcccgagcggcgggaggcgggactgttcgcacggctgccggcgcagatcgctctcgccaaggccaaggcgcctgccatggcccggcttctggccgaggtggacgccccggcgatccgggatcgcaccgccctcgccacgctgcccgtgctgcgcaaatccgaactgaccgcccgtcaggccgcagaaccgccgttcggtgggctcaatgccgagggaccgggcgaacttgcccatctgttcatgtctccggggccgatttacgacccgcagggctcggggcctgatcccttccgcttcgcccgcgcctgctgggcggcgggtttccggcccggcgacgtggtgcacaacacgctcgcctaccacttcacccccggcggctggatgttcgacaccggcgcccgtgccgtcggctgcgcagtgatcccggccggtggtggcaacacggaacagcagctggcggccatcgcccagctgaagcccaccgccttcaccggcatgccctccttcctgaagctgctgctggagcggcaggaagaggccggacaggctgccaccatcaccaaggcgctggtgaccggtgaagccctcacccagacactgcgtcaggaactggggcggcgcggggtcaccgtgggtcaggtttacggcacggcggatctgggccagatcgcctatgagggcccgacctcggaaggcatgatcctggacgaggatctgattgtggagatcgtccgccccggcacgggggatccggtgcccgagggcgagatcggcgaggtggtcgtcaccaccttcagcggcacctatccgctgatccgcttcgcaaccggagacctgtcggccttcatggccggcaccagcccctgcggacgtaccggcatgcgcctgcgcggctggctgggccgggccgatcagaccaccaagatccgcggcatgttcgtccatcccgggcaggtcgcccaggcgctgaaggccgtgggcggcatctcgcgcgcccggctggtggtcaccaaccccgagggccgggacacggcggtcctgcgctgcgaggtgccggaggccggtgccgatgacctcgccggccggctggccgacgccttccgcacggcagccaacctccgggccgaggtggaactggtgaccccgggtgccctccccggcgacggcaaggtcatcgaagatgcccggatctatgattgagtgagccttcctttccatcctcccgcagcccatctcgcggggccggcccagggccgtgccccgctttttttgagcggatggatgaagggcggctcaccctccaggatcattccccggtgtcgcgccgccagtcttcataggcgtcgaggttctcctgcttcgtcgcaggatagaggccgatgatcgtgtctcccgctttcacccgctccagcacgaaatcctcgtagctctccatggcggagcactccgccgccagctcgtcggcaagatgggccgggatcaccatcacgccatcggcatcgccgaccagtacgtcgccggggaagaccgcgacatcgccgcaggcgatcggcccgtcgatctcgatcgcctcgtgcaaggtgaggttggtgggcgccgagggacgggcgtgataggccggcatctccagccggccgatcccttcggcatcgcgaaagccgccatcggtgacgatgccggcgcagccgcgcatctggagccgggtgaccaggatcgagccggccgaggcggcgcgggcatccttacgggcgtcgatcaccagcacatggcccggcgggcaggtttccaccgccacacgctgcttgtgctccggatcgcggaagaccgtgatcgggttgcgatcctcccgcgccgggatgtagcggagcgtgaaggccgggccgaccatgctccgccctttccaggccaccggcacggcaccctggatgaactgattgcgcaggccgcgcttgaacagcgcggtcgcgagcgaggcggtcgaaacgcgggcgagcttcgcgcgcgtctcgtccttcagcgggtgtccggtcatctggcggcctgccttcaatagatcacgggttcgtcgacgggcgccccgaaggacgtctccagatagtcgaaatcgcagcccttatccgcctgctggatgtggttggtgaacatccagccccagccccggtggaagcgcggcggcggcggggtccaggcggcccggcgccgggcgatctcttcgtcatcgaccagcatgtccagccgacggccgggcacgtcgaggcgcacgatatcgccggtctgcaacagggccagcggcccgccgacataggattcgggcgccacatgcagcacgcaggcgccgaaggacgtgcccgacatccgcgcatccgacagccggaccatgtcgcgacagccctgtttcagcagcgccttgggcatcggaatcatgccccattcgggcatgcccggtccgcccttggggccggcattgcgcagcaccagcacggcatcgggggtgatgtcccaatcctcgtcgtccagcttttccttcagctcgggatagctgtcgaagactatggccggcccttcatggaccaggaatctgggatcgcaggccaccggcttgatcaccgcaccatcgggggcgaggttgcccttcagcaccgcgagcgacccctcgttgtagatggggttgtcgaccgtgcggatgacgtcgtcgttccagacctcggcaccgtcgatcccctcgcccagcgtgcgcccggtcacggtcagacagtcgcggtgcaaccggtcgcccagccgcgccatcagcgcccgcaggccgcccgcatagaagaaatcctccatcagataggtggatccggccgggcggatattggcgatcaccggggtcacccggcttttggcatccaggtcgtcgagggtgagatcgaccccggcccgccgggccatggcgatcagatgcaccaccgcattggtcgagcagccggtggccatggcgacggtcaccgcattgtcgaaggccgccgcggtcaggatcctggccggggtcagatcctcccagatcatgcctacgatccgccgcccgcagtcggccgacatgcggatgtggttggaatcggcggccggaatggacgaggctcccggcagcgtcaacccaagcgcctcggcgatcgccgtcatggtcgacgccgtgcccatggtcatgcaatggccgtaagagcgcgcgatgccccgctccatgcccttccactgcgcctcggtgatggtgccggcgcggcgttcgtcccagtatttgaatgcatccgaaccggagcccagggtgcgcccttcccaattgccgcgcagcatcggcccggccggcagatagatcgcaggcaggccggccgagatcgcgcccatcaccaggccgggggtggtcttgtcgcagccgcccatcagcaccacgccgtcgaccgggtgggagcggatcagctcctcggtctccatcgccagcatgttgcgatagagcatcgtcgtcggcttgacgtaattctcgctgaccgacagggccggcagctcgatcgggaagccgccggcctgaaacacgccgcgcttcacgtcgtcgacgcgctgcctgaaatgctgatggcagggattgatgtcggaccaggtgttcaggatcgccaccaccggcttgcctgcccagtcctgctcgtcatagcccatctgcagggttcgggagcggtgcccgaagccgcggaaattgtcgggcgcgaaccagcgcgccgagcgcagctcgtcataggtcctggtcatgggggtcatccggtaaaggcgaaaatcagccaggtgagggcagcggcggcgaggccgccggcaatttccggccagttgccgaaatcgaagccgtcggccgcctcttccgcggcaaaatcggcggcggtcaccgcctcgtcctgatcctggatcgggtcgtcgggtcgcatcgatgcctcctcattccaccagcgagggcagccagagggcgatgtcggggaaggccagcaccagcagcagaccaatcgcctgcagggcgatgaacggcatcaccgcggcaaagatctcctgcagctcgacatccttgggcgccaccgatttcagaaagaaacaggccggaccgaagggcggcgacaggtagtagatctggatgttcatcgcgaacagcacgccgaaccagaccgggtcgtagcccagatcctggaccacgggggcgaagatcggcacggtgatgaacaggatagcgatccattcaagaaaggtgcccagcaccatcacgatcgccatcatcaccacgatcacccagatcggcgcgatgtcgagcgaggtgagcatgccgcgcaggaagtcgccgccgccgatccggttgtagatgccgatcagcgacaccgcccccagcaccagccagatgatcgaaccgaccgtcagtgccgtgcgccgcatggcgtcgcgggccatggtccaggacagctcgccccgcaccgcggcgaccacgagcgatccgaccgcaccgatcgccgccgcctcggtcaccgtggcgacgccgctgtagatgacccccagcaccgccatgatcagcacggccggcaggatggcgccgttcagaaaacgcagccgctgcacgaagggcaggccggtttcggggatgtcgtagatcggcgccagcgacgggttgagccgcacccgcaccagcacataggcgatgaacagcgaggcgagcagcagccccggcacggccgaggccgcgaacagcttcgtgatcgagacctgggcggccaggccgtagacgatcagcaccaccgagggcgggatcagggtcgccagcgcgccggccgcacagatgatgccgatcgacatcttgcggtcatagccgagacgcagcatctgcggcagggcgatcagccccagcatcacgatttcgccgcccatgatgccgctcatcgcggccaggacaacggccactacggtggtctgtacggcgaccgagccgcggaaacgcccgcccaggatcgccatgctttcgaacagcgtatgcgcgatccccgatcgttccagcacattggccatgaacacgaagaagggcaccgcgatcagttcgtatttgtgcaggacctcggtgacattggccgaaacgatgaagaagccggcacgctcgccgaaatagagcactgccgtcaccagcgacaccgtaagcgtggtgacgccgagcggaatgccgatcgccatcagggccagcaggcccaggacgatcaggatggtgatgatctcaatgcccaccgccgtcttccttctcggtcccctggaaccagcggatcaggttggcgaagagctgcgcgacatagagcacgcaccccgccagcagcacgaccttgaggtagctgggctggatggagttgagcgccgtgccggaatattccggccgcgcgatcacgcgcatcgccgggctccagatcgccaggatcaggccggttacggcgccgatcgacaccaggatctggatcaggcggaaacggcgccagagcttcgggccgaccaggatttcgagcatggtgatcgagatgtggcggttgcgctcggtgacatagccgaccgagagcacccaggccgtggcacagagcgccatggtcacctcgatcgaccagcttgtggggtgatcgaagccgtagcgcatcaccacctccagggccgagagggcgatgcaggcgaagagcagcgacgcacaggcctggccggtgaagacgctcacccggtccatggccgcggcgcagcaggcgaagaaccgtctcatcgggcctcccgctgacggaacccactccaggccggtcgcggcaccgccagggcgacaccgcgaccggccggcgatcacttcagcaggccgatctgcttcatgtaggcgaggttggcgtccagggcctccttggcgagcggacccttggcggcgaacttctcccattcgatgcgggcgacgtcgcgcagcctgtcgcgatcggcctgggcccagtcgatgacctcgaccttgccggcggcggcatccttcgcggccagcgccgcatcctgttcggcgaccacccgggtcagatcggccatagccatgtagaaccagtcgcgcagcgccttccggtcggcctcggaaaggtcttcccatttctcgcgattgaacgagagctgcatcgacggcatcgaatggatgccgggatagagcggatagcgcgcgacgtcgttcagcccggtgctggcattgttgacataggccgaggcgtcggcggcatcgacgatgcccttttcaagcgcaccatagacttccgagaacggaatggagaccgggcttgcgccggccgcctggaacacggccgaggccagcccctcgggcgcccggatcttcttgcccttcaggtcgtcgaaggtccggatcggcacccgcgccggcagggcctcgcggctgtaaggcgcgcagccgaccagatgcgcctcgccgtcggaaacctcgtccagcgccttctgccagaccgcttcgccggggccgttttcgcagaaaccggccatctgctgcggcgtgtcgtagcccgagatcagatcgcccaggatggcgaaggcgggctccagccccgaaaaatagttgaccgaggtccagtcgccatcgatcacgcccagcccgacggcatggggcgtctccttggccggcaccacagatccgttgggcgtgagggcgatttccacccggccgccggtcatctcggcgatcttcggcaaccagtgttcggtgaggtactgagtcgagaagtcgccggcattgaacgacgtctggacggtataggtcgcggccgtggccggtgccacgaaggcgcaggccaccaggcccgcgagggccgtgatcgtcgggcgcattccatatcctccctgggcatcgagggtttgatcacctcgttgacaaaagcactaatatattagttgccctgacgcaacatctgatatggtccgggaagagagtgcttcagggagcccgccgcccatgtcccccaggcgatccgtcctgcccgacttcaccgacatcgccacgctggccgatctggaccggcggccgttggcgtcgcagggcatctatgccgcactcaggcgccggatcatcgacctggagctgaagccgggggccctgctgtcgcgcacccagctggccgaggaatatgccgtcagccagacgccggtgcgggacgccttcctcaggctggagcgggagaagctggtcgagatcttcccccagtcgcgcacggtggttgccaagatcgatatcgcccatgcccgcgagacccagttcctgcggctcgcgatcgaaatcgaggtcgccaaaaccatcgcccgccaccagataccggcagacttgacggcctatgcccgtcgcctgctgcatctgcagggccaggccttcgccgatggggatatcgagcggttctccatcctggaccggcatttccatctggcgctctacgacgccgtcggccatcccgatctctggtacatgatcgccgaacgctccggccatatcgaccggcttcgcgcgctgaacctggtcgatccgggcaaggcccagggcattctggactatcacggccgcatcctggaccggatcgatgcgggcgataccgccggcgtggaagaggcggtgcgcggccatctttcaggcacgctcagcgccgtcgcccggatcatggagcgccatcccgactatttctgagggcatgtccgcccgcgtcaggaccagtcaggaccagtagtcgatcccggtatagaccagcacacccgcgccgatcgccgccagcacggcaccggcgccgcgcttgatgcgcatcggccagcgcggcgcgagtttgcggccggcatgggcagcgccccaggcaagacccgcccaccacaatgcaccacccgccgcaatgccgcccagaagcgggatcttgtcttcggcgaagcggccgagggtcgcgaacagggcaaggaaggccgcaaccgccgtcgggttgacgatggtaagtgcgaaagtggcgatacagccggaacaggcggccatcacccggttgcggccgtgataggtcgggttgggcaaggcggtgatctggccgccgtcgcggctgagcgcaccggtcgcggtcaccagccccatgatcagcagcagcaggccagcgaacagctgcaagggccgctcgaaggcatagatctgctcgatccagccgagccccgccacggcgatgccggcatagaccagatcggccagcacgacgcccaggccggtcacgaagcccacccgccagccgcggtccaggctgcgcccgatcaccatcaccgccgccggccccaccggggccgcgaccaccagaccgatgccgatgcccgcgaggaagctggacaggatcatgcgccgatcgtccgctccgccatctgtcctcctgtcgtctttgccatctggatcggatcccggccttttcgcaaagcgccctttggtctatgcattgtggcgccccgaaggcaagcccggaagccgtcgaccgaggccgtttcatgaggatcgcgtgaccacggacccgctggatgagaccccagaccggctgacgctgcaagagctggcatgcttccgcggcgaccggccgatcttcatcggcctggatgcggagctggaggccggccatgcgctggtcgtcaccggccgcaacggcgccggcaaatcgacgctgttgcgcatcctggcgggcttcgtgcgcgccgatgcggggcaggtgctctggaacggcgtcgatcgcgaggatcacgacatcccctggcgggaacggctccactatctgggccatcgcgacggcatcgccgccgaactcgcagccggcgccgatctcaggcactgggcagcgatcctgggcgtgccacggccgctgcgggcggcacgggtggccgaagcgctggaggccctcgacatcccgcatctggccgagctgccggtgcgggtcctttcggccggccagcgccggcgcctggccctcgcccgcctgctgctcgcccggcgtccgctctgggtgctggacgaacccaccaccgcgctcgaccgcgacggtcaggcgctggtcgcccggctgatcggcgatcatctcgaccagggcggcatggtcgtcaccgccacccatctggccctcggcctggacgaccgggtcgtgccgctcgatatcgaggaggcggcgccatgagcctggccggcaccttcagcgccatcctgatccgcgatctggcccgcaccgccggccggtccggagatgtcgtggccgtgctcgccttcttcgtggtggcggccaccctcttcccactgggtgtgggccccggcccgcaggtgctggcgcggatcgcctcgggtgtggtctgggcatcggcgctgcttgccgtgctgctctcgctcgaccggctgttcgatgccgaccgcaatgacggggcgctcgaaggtctggccctctcccccgcgccgctcgcgatcgtggtgctggccaagaccgcggcccactggctgaccacgggcctgccgctgatcctgatggcaccgctggtcgcgatcatgctgcaggcggagctgcggctggtccccgccctgatggcctcgctcgccctcggcacgccggcgctgtcgctgatcggcgcaatcggtgcggccctcaccctgggcgcccggcggggggcggcgctgatgccgctgctgctgctgccgctctatgttccggtgctgatcttcggggtcggcgcggtcgaagcggcggcgaacggtctgcccatggggccgcatctgatgctgctcgccgcgggctcggtgcttgccctcgccctggcgccgctggccgcggctgccgggttgcgcgcggggctggactgatcggggcctgcgcgcgacacttgggcgttccggaccgcgtccgatggtcgcgcaggcccggcaaggcttgacgcccggccgccaggcgtgcacctcctcgcgggtgcgggttccggaacccgtgttccatctgttccctcagccggcggggtcccgtccgcgatgcatcgctacgccaatcccaccctctatggccgcatcgtcgaccgcgtccgccgccggccgggctggcggggctggcgctgattctggtcgggctctatctcggcctgttcgtggcgccgcccgactatcagcagggcgaaagcttccgaatcatgtatgtccatgtgccggcggcgtggatggcgatgttctcctatgccggcctggcggtgtcgagtgcggtctacctgatctggcgccatggcgtggccgacgtcaccgccaaggcgatcgcgccggcgggggccgccttcaccgccatcgcgctggtcacaggctcgctctggggtcagccgatgtggggcacctggtgggtctgggacgcgcggctgacctcggtgctgctgctgttcttcctgtatctgggctacatggtgctgcgggacgccttcgatgcgcccgaacgcggtgccaaggcggcggccatcctggcggtggtgggtgtggtcaacctgccgatcatcaagttttcggtcgactggtggaacacgctgcaccagccggcgacgatctcgaagctcgacgcgccctcgatccatccgtccatgctctggccgctgctggcgatggcgctgggcttcacgctgatcttcgtggcgatcgtctgcctgcgcgcgcggacggaacttctggaacgccgggcgcgcagcctggagatgcaggcggcgctcggccgcgccgagtgaccggaagaggcaaatgaccggaacaggccgggccgccgcggatttttgtcacgcaacttccgcgacatagcggcgcaagcctgccgcagcactggacgcgggccccggcctgacactatctgttgcgcaagatcgcgccgggcctgccggacgacgatcattgttgaggacatgacggcggtgaacgacctcgaaaccttcctggcgatgggcggctatgccgcctatgtgtggccctccttcggcttcgcccttgtggtgctggcgggggtgtggctgcaggcccgcgtggcgctgcgccgcgccgaggcccgcctggcccggctcgaggcgctggggctggaccggcgcgcacgccgccgccgccccgccccttccgcaccgggcaccgccgcccgcaccgacggagccaccgacgatgccgcccgcgcctgaagcttccgccgccggacgcggcaccgccgcccgcacgcctgccccacgacgcttcaaccgcaagcgtcgccggatgtatgcgctgggcggcatcctgctgctggtcgccgtggcggtcgccctggttctgggcgccttccgcgacaatctgctgttcttctacagcccgagcgacattcaggcgaagcaggtggaacccggtacccggcttcgggtcggcggcctggtcgaggccggcagcgtgatccgaggccccggtaccaatgtcgccttcaccgtctcggacggtgccaagaccctggtcatccattacgacggcctgctgccggatctgttccgcgaaggccagggcatcgtcgccgaaggccggctggagcccgatggcacggtcacggccgaacaggttctggccaagcatgacgagacctatatgccgcccgaggtggtcgacgccatgaaacgtgccggcacctggcacggcgaaggtacgcccgagggcagccatcagaagcttctgaagaccggcagcggggatcccagctgatgatcgccgaactcggccactacctcctggtcctggcgctcgccatggccatcgtccaggcggtggtgccgctgatcggggccgcgcgcggcgatgcggcgctgatggccgccggtcgcggggccgcgatggcccagatgctgtcgatcctgggggccttcgccgcgctgaccaccgccttcatccagagcgatttttcggtgctgctggtcgcggccaattcccacaccgccaagccgctgctctacaagatcaccggcgtctggggcaatcacgagggctcgctgctgctctgggccacgatcctggccctctatggcggcgcggtggcgctgttcggccgcaatctgccgccctcgcttcgggcgcgggtgctcgcggtccagggcatgatcgcgatcggcttcctgctgttcatgctgctgacctccaaccccttcgaccggctgatgccgccgccggcagaggggcgcgacctcaacccgctgctccaggaccccggcctcgccttccatccgcccttcctctatctcggctatgtcggcttctcgatcgcgttcgccttcgcgatcgcagccctcatcgaaggcaaggtcgatgccgcctgggcgcgctgggtcaggccctggacgctggcggcctgggtgttcctgacgatcggcatcgcgctcggctcgtggtgggcctattacgagctcggctggggcggctggtggttctgggacccggtcgaaaacgcctcgctgatgccctggctggccggcaccgcccttctgcattccgcgatcgtggtcgagaagcgcgacacgctgaaatcctggaccatcctgctcgcgatcctgaccttctcgctcagcctgctcggcaccttcctggtccgctcgggcgtcatcacctcggtccacgccttcgcgagcgacccgacccgcggcgtcttcgtgctcggcttcatgtgcgtggtggtgggcggcggtctcaccctctatgcctggcgggcgccgacgctgaagcccggcgggctgttcgccccggtcagccgcgaaagcgggctggtggtcaacaacctgctgctgtcggctctggccgccaccgtgctgatcggcacgctctatccgctgttcctggatgccttcgccggcgccaaggtcaccgtgggcccacccttcttcgatgccacggtcgtgccactcgcggtgccgctgctgatcgtggccggcatgggcccgtcgctggcctggaagcgtggcgatctgggggccgtgctccagcggctgcgcttcgccatggtcgcggccctgcttgccgcggcggccgggttcttcgtcggcggcatttcggtcgatggtgcgctcggcgcgctcggcctgatgctcggcgtctggctggtggccgccagcctggccgatgtcgcagagcgcatccagatcgcgaagggtgcgggcaccgcctggcgccgggcacgtaacctgccgcgtgcagcctggggcacggcggtcgcccatctgggcgtcggcattctggtactcgggatcaccggtgcgtcgatctggcaggcagagaagaccgtaacactcgcccccggtgaccgggccgaaatcggcagccgggtggttgaattccgtggcgtcacccagcagccggggccgaattaccgcagcaccatcggcgatctgcgtctgatgtcgggcgacgggcccggcgcacgggcggtggcgaagctcagccccgagatccgcttctatcccgcccagggcaccacaaccaccgaggccgccatccgcaccaatggcgtcgctgacgtctatgtggcgctcgccggcgccgaacccgtggacgggaagtggagtttccggctctaccacaacccgctgacgccctggatctggggcggcgcgctggtcatggcactcggcggcatgatatcgctgagcgaccggcgcctcagggtcggggcgccgcgccgcgcccggaccccgcagaccaccggctccctgccccccgcccccgccgagtgagtggccgcgccgatgctgaagcgtctgatctacgtcctgccggtgctggtgttcctggcactggccggggtgtttctcaccgggctcgacctcgacccccgggccgtgccctcgggccggatcgacaaaccggtcccggccttcgcgctcgggccgatcgagggtcgggagcaggggctcgccgcggcagatctggctgacggccggccggtgctggtcaatttcttcgcgtcctggtgtgtcccctgcctggccgaacacccgctgctgatgaagatggcccgcgaagaaggcgtgcgcatcgtcgggatcaactacaaggaccggcccgaggatgcccgccgctggctggatcgccatggtgatccctatacccgcatcggtgccgatatcgacggccggaccggcatcgagttcggcatttcgggcgtgccggaaaccttcgtggtcgacggccggggccgcatcctggcccagcatatcggcgtgctgaccgaagaggcgctggaagaccgcatccgtccgctgctgaaggaggcggccgaatgacccgcgcggcttgcctcgcgatcgccgccctgctggtcgtctccgccccgcaggtgctggcccagcagaccgacgccccggcacagcgttcgccccaggaaatgccggcccccggcagcgtggcccccggcccgctcgcccagcccgaggttccgctggccgacccggccgaagagcaacgggcgcgcgagatctcgaaggaactgcgctgcctggtctgccagaaccagtcgatcgaggacagcaatgccgaactggcccgcgacctgcgtcaggtggtgcgcgagcaggtggcggccggccgcagccgcgacgacattctgaccttcatggtcgaccgctatggcgactggattctgatgcggccgccggtcaagtcgaccacctatctgctttggggcgccccggcgctggccctgctgatcggggctgcgatcgcgatcggcttcatccgccgccagcgccgcgcctatgccgcccgcgccgccgaggatggcttcgcccgcccgctcgacgacgacgaggcctggcgcctggcccggctgctcgacgaaaccggtcccgccccatccggcacggacgaagtcttcgatccggcgccggacacgacccgggcagccggcgcggatgacggcgcccccgatgcctccggatccgacgaagacgacacgccgcccaaggacggacgcccccagacatgaccggtctctggttctgggcggtcatcgccctggtcaccctgcttgccctgaccgtgctgctgctgccggtgctgaaaggtcgcgcccgcgaacgcggggccgcccggctgggggacatcgcgatctaccgccatcagctggccgaggtcgataccgaactcgcccagggccggctgacggccgaggaggcgacggccgcgcggctcgagatccagcgccggctgcttgcggccgatgccgcccgcggggcggaaccgcatcacgcgccctcgggccgcaaggaacgacgccgggccaaccgcctggcggcgatcctgatcctgctggtgccgatgatcgccgtcggcgtctatctgcatctgggccagcccggcctgcccgaccatccggcggcggaacggccgctcgcccaggcgagtgatgccgatctggcgaagctggccgaagagcttgcgaccaaacttgaaggcgccgacagcgaggacccccgtggctggaccctgctcggccgcgcgctgagcagcctggggcgccatgacgaggccgcccgcgccttcgcccgggcgctggccctggcccccgatgacgtcgacctgctgaccagtgccgccgccgccgaggtgatcgcccgcggcgggcaggtggacgagcatgcccgggtgctgttcgaccgtgccgtcgcccgcgatcccggcaatgccgcagcccgctattatctgggccttgccgacgcccaggccggccggatcgccgaggcgctggaacgctgggtggcgcttgccgccgacacccccgccgacgccccgtggcgggctgagctggaacgtcagatccgccgcgccgccggcgatctgggccggccggtcgcaagcctcatccccgaaagctggcgcaacccgggcgaggccgcagaggcacccggcggcatggccgtgccgcccgcccaggccgaaatgatccgcggcatggttcaggggttggcctcgcgcctggaaaacgcgcccgaggatcccgacggctggctgcgtctcgcccgctcctataccgttctcggtgatcctgccgcggcacgcgcggcccttgcccgcggcgccgaagccaatccgcgggtgatggacctgcagctcgccctgatgcaggcacgggtcgaggttccggacgacggcgacctcgacccgcggatcatcaccgctgcccgggccgcccgcgaccgggcgctggcgctggcgcccgaacacgacatggcgctctggctggggggcgaggtccatgcccgcgacggcgaactggatcaggcccgcgccctgtggcaccgcctgctggacgtgttgcccaaggattcgcccgaccggcgtcaggtagaggcgcggatcacagcactcgacgacaccaccggcgacgtgccgccccctgccgagtgatcggtgccactgccggtttcctccgggccgcccgcccgtcataatcccgtctcagagacaggcctcgtccgaaggggcggcggggggcggcgaaaccagaacggccggcggcggccatgaagggggcacatgacgacgacacgctgggcgctggaggtggagcgcctgcacaagcgcttcggtgatctggaggtggtgaagggggtctctctccaggcggccgaaggcgatgtgatctcgatcatcggcagcagcggatcgggcaaaagcaccttcctgcgctgcatcaacatgctggaaatgcccgatcagggcgtcgtccgtgtcgatggcgaggagatccggctgaagccggcacgtggcggcggcatggagccggccgatccacgccagctggaccgcatccgcgcccggctgggcatggtgttccagagcttcaatctctggccgcatctgacggtgctcgagaatgtgaccgaggcgccggtccatgtgctcggccgcccccgcgacgaggcctccgagaccgcccgtcgcctgctcgagaaggtcggcatcggcgacaagaccgggcactatcctgcggaactttcaggcgggcagcagcagcgcgcggccatcgcccgggcgctggccatggatccccgcgtgatgttgttcgacgagccgacctcggcactcgatcccgaactggtcggcgaagtattgcgtgtcattcgcagtcttgccgaagaaggccggacgatgttgatcgtcacgcatgagatgggttttgcgcgggaggtgtcttcgcgggtcgcattcttcgatcagggggtcatcgccgaagacggtccgcctgaacaggtcttcgaaaatccagtcaacgaccgttgtcgtcagtttcttgcaagccggctgcgataattctggagcgccggatacacatagttaactctcgtgttatatcttgtgtacaggtcgtgactgatcaggcgtatcgcttcatgatctgcccgaaatcagttgcgcaagaaacataacgaacgcatggagcaaagctgatggcatcctgcactgagggcggcagcaacgatcgtgatctggaattgttccacttcgcgtttcggtttctcgtcgaggaacctgatcgcattctggccgagcggggcttgaaccggtcgcaccatcggattctgtatttcgtggggcatggcggccccgacatgacgctgaccgacctgctggacaagctcagggtgtcgcgtcaggcgctgcatcggccgatgcgccagctgctggatcaggggctggttctgctgacgccggtgccgtcgaaccgacggatgctgaatgtgcggctcagcgacgaaggcgcgaagctcgaagcccggctgtcggccctgcagaccggctatctcgataaggccttcgcggccgtcggccccggtgctgcggaagcctggcggcaggtgatggaggttctggcggccgacccgacccggcttggccagatcgatcgtcccacgatgcgggttgccggtcgcgcccatcacgagcatggggccacggcccacgcatcctgacgtttcacaggccttgcccgcgttttgtcgttgaaccggcccctgcggcccggctttactagatcttagcaacaccgcatccgtcagcggcgggcccccagggttcggccgccggttcgggggagccggtgggccgcgcctgaaggccggtcccgggcggtgcagagggtcgagtatcgtcgagggagatcgacacgtgggcattttccgtatcctgagcgccgccgtcatcggactggggctggccaccggcagcgctgccgcggccgacaagatccgcatcgcgaccgagggtgcctatcccccgttcaacttcgtgaacgagcagggcaagctcgacggcttcgacgtcgacatcgccaatgctctttgcgcgaagatgaaggccgactgcgagatcgtcgcccaggattgggacggcatcattccgggcctgctcgccaacaaatacgatgcgatcatcgcggcgatgtcgatcaccgaggatcgcaagcagtcggtggatttctccagcaagtacgccctgtcggccggccagttcgtggcgccgaaggacaagacctatgacgacacctcgcccaaggcactggccggcaaggtgatcgccgtccagcggtcgacgacccacgtcacctatctggaagacaactacaaggacagtgatatccggctctacgacacccaggaccaggccaatctggacatggtgtcgggccgcgccgacctcacgcttgccgatcagccgatcctgggtgactggcttaagaccagcgacggccagggcttccacttcgtgggcaagccggttgccgatccgaagtggtacggcgaaggcatcggcgttgcggtccgcaagggcgataccgcgcttgtgacgaagttcaacgaggcgatcgccgcgatccgcgccgacggcaccttcaagcagatcaacgacaagtggttcaacttcgacatctacggcgagtgaccgtctgcccggcccatggccggggcctgtcgaccggaaccgtcggatggccggggcagcgatgtcccggccttcgcggttcgatggtatcggcctgacgccgggccgatgcaccgctttcagggaacggtcccgcttcgatgttcgacttcaagggctatggcggcctgctgatcgagggggcggccatcacgctcgccctgatcccgccttcgctggcgctggggctggtgctgggccttgccggcgctctcgccaaatccagccggtcgcgggttctgcgcggcatcggccagacctacaccaccgtcatccgcggcattcccgagctgctggtggtgctgttcgtgttcttcgccctgccggtgatcgtgaacaacgccctcaccgccgccggcgcccagacccaggtttcggtcagccccttcgtcgccggtgtggtggcgttgggactcgcctatggcgcctatgcgaccgaggtgttccgcggcgcgcttgcagccctgcccaagggccagatcgaagccgcccgggcgctgggcatgagcccacgcctgaccttccggcggatcgtcctgccgcaggtctggcggctggccctgccgggcctcggcaatctgctgctggtgatgatgaaggatacctccctggtgtcggtggtggccctcgacgagctgatgcgcaaggcccatgtcgccgccggcgccacgcgggagcccttcaccttcttcttcgccgcggcaatcatctatctgttcttcaccctgatcgcggagatcggcatcgcccgtatggaacgctgggccgcccgcggcaccggccggcgcgccgcaccggtgcccgcccccggcgcgagggcctgagcaatgcgatgggaagtcatcttcgacaattgggagcggctggccggcggtctgggaaccaccttccagctcgtcgccctggcgctcatcatcggggcggccctcgccctggtggtcgccatggcgcgcatctcgcagaacccgctgctcgcctgggccggtcgcggctacatcttcttcttccgcggcacgccgctgctggtgcagctgttcctgatctattacggcctgtcgcagtttccggcgatccgcagcagttttctgtggccgatcctgcgggagccctattggtgcgcgatcatcgccttcgcgctcaacaccagcggctataccgcagaaatcctgcgcggcgccatccaggccgtgccccgcggccagatcgaggcggcccaggcgctgggcatgagccgggcgctcaccttccgccggatcatcctgccgatcgcgatccgctacggctttccggcctatagcaacgaggtgatcctgatgatcaaggcgagtgcactcgccagcaccatcaccatcctcgacctgatgggggtcacccgcaccctgatctcgcggaccttcgccgtgactgaactgttcctggccgccggcgtgatctatctcgtcatcaccctgctgctgacccgcgtcttcgcccgtgtggaggcccggctcaaccgccacatggcccgccgctgaccccgatctgccccatctgccgccggccgctgcccgatctggcggcggccaccgaccggcaccactgggtgccggtctcggaaggcgggcgcgaacaggccgtactgcaccggatctgccatcgcatgatccaccgcctgttcgacgagaagcgcctggcccgcgacctgaacaccgccgaggcgctgcgggccgcgcccgagatgcagggcttcctgcgctggatcgcgaagcggccgccggagctggtcgactggcccgaactgccgggccgccacggccgcagccgacgccggcgctgacatcggtatccgagacatattgcgctgcatgtccgcccacgagtcgcgcaatcctgcgccgatctgatcaccgagcgcgaaatttttgtgcaatgcagaatttcgccatgggcatctatttcaattagacgtttgaccgagatgaaaatccgtcgctaagcttccgggacaaatggccggcgtgtttcgcgcccggccaccggagggccgggaagacgtgcgcgcgccacgcagccgccaccacccgaggcctgccgggtacaccctgggagggatgcgcgcgatggagctgtttgcccaacaggtcatgaatggtctggtcttgggcagtgtctacagccttgtggcccttggcgtgacactgatctacggaacgatggagatcccgaacttcgcccacgggcatctctatatgctgggcgcctatgttacctttgccgccgtcaccgggctggacctgcactactggatcggcatggtgctggcggtggccgctctcgccgtggtcggcatcctggtcgaaaggctggccttccggccactgcgtcacgccccccatgtgaacatgatgattgccgccgtggggttgatgctgttcctcgaggccttcgcgcagctggtctggggagcggatttccgccggctgccctcgccctatggcgcggtcgtcgatctctggggcaccacggtcaccgaacagaagctgattctgatcgtcgccggcatggggctgatggcggtgctgttcctgttcctgaagcgcaccgccctcggtgctgcgatcgaagcggtgtcgcaggaccgggtgggcgcgcagttggtcggcatcgatcccgagcggatctcgatgatcaccttcgcgctctccgccggcctcgccgcggctgctgcggcactgatcgcacccatcaacctgatctcgccctccatggggctggtcgtgggcctcaaggccttcgtgatcgtggtgatcggcggcatgggcagtgttgccggcgccatcgtctgcggctatggcctcgccctcgccgaaagcctgggcggtacctatctcgcgaccgactatcaggatctgatcgccttcgcgatcctggcgctcgtgctgaccgttcgtccctccggcctgttcgcgaagggggcctgaggtcatgacacgtcccgatccccgcccgccggtcaaccctgcccgccggctggtcagccgggtctggctcggcctgttcctggtggccgtgctggccctgcccctggtcgtcaccaacccctatcacatgcaggtggtgctcaccggcttcatcttcgccatcggcgcctacgggctcaacatcgcgctcggctataccgggctgctctcgctcggccatgccggtttcttcggcatcggcgcctatgccgtggccctgctgaccaccgatctcggctggcccttctggccgtcgctggtggtcgccattctggtcaccgggtcgatcggcttcgtggtcggcagcatctgcctgcgtgccaagggccactacctcgccatcttcaccctcgccgtcggcatgatcatctatcaggtgctcgacaagtgggagagcctgaccaacggcccgatcggcgtggtcggcattccgggccccagcccgatcgggccgatcaccttcgacgacttcacctcgcgctattatctgaccgcgggcttcctgctgctcgccatgctctgcgcctggcggatcaagtcgtcgcttttcggccgcaccctgctcgcggtgcggatgagcgagccgctcgcctcggcatccggcatcgacgtgatgtcggccaagcggctggccttcaccatggcctgcatctatgccggtgtggcgggggggctttattccagcttcatcggcttcctcggccccgacatcgcctcggtcgacatcaccttcaacatgctgctctacgtgctgctgggcgggatcgcctcgatctcggggccgctgatcggcacgctgctggtctacaccctcacccagttcctccaggccttccagcagtaccagatgctggccttcggcccggcgctgatcgcactggtgatcttcatgccctatggcatcgccggcgccgccagtctgatcctgcaccgcctgatgcccgaccggccgcgcccacgcagcgccgcccccgtccgcggccagaccggggagaccgtccgtccatgaccgccatcctggaagcccgcggcctcaccaaggccttcggcggcctcgttgcggtgggtgatgtggattttgccgtcgaggaaggcggcatcaccggcatcatcggccccaacggcgccggcaagtcgaccttcttcaacctgatcagcctgttctaccgatcgacgtcgggcaccatcaccttccgcggcgaggacgtcacccggctgcgcacccacgacatgccgccgcgcggcatggcccgcacctttcagaccacgcatctcttcgccgaggcgagcgtgctcgagaatgtgatcgtgggctatcgccaccgcacccgggcaggtctgctcgatgccctcatcgcaagcccgcgcgagcgccgcgagatcgccgaggcccgcaggcgggcgatggaggcgctggatttcgtcggccttgccgatgtcgcccaccgcccggccgggctgatcagccaggaacagcagaagcgcgccgcgattgcgctcggcctggtcggcggcccccggctgctgctgctcgacgagcccgccgccggcatcaatccggaagagaccgatgatctgggccggctgatccggcgcatcgccgaggccggggtcaccgtctgcctgatcgagcacaagatgaagatggtgatggggctctgcgaccggatcatggtgctgcatcacggccgcaagatcgccgagggcacgcccgaccagatccgcaccgacgatgcggtgatcaccgcctatctggggagcgacgcccatgctcacgcttgacggggtttcggtccagtacggcgccttccgggtgctgcaagacatctcgatcacggtgggtcagggggagctggtggtgctgctcggcgccaacggcgccggcaaaagcacactgttccgcacgatcagcgggctgcaccgtatcacccgcggccggatcgtcttcgacggcgacgacatttccaaggcggcgccggcgaagatcgtgggccggggcatcgcccactgccccgaaggccggcggctgttccccgatctgtcggtcgccaagaacctgatgctcggcgcctatacctgccgcggcgaccaggccgccgtcgcccgcaccctcgcccgggtccacgagttgttcccgattctggtggagaaggccgaccagccggccggctcgttgtcgggcgggcagcagcagatggtggcgatcggccgcgccctgatgggccgaccgcgcctgctgatgctcgacgaaccgacgctgggcctggcaccgctggtggtccgccaggtgctggacgcggcggccgagatctgccgcagcggcaccacggtgctgcttgccgaacagaacgcccatgccgctctcgccatcgccgaccgcggctatgtgatcgagaccggccgcatcaccaccgagggcacgcgcgaggcgctgatgtccgacgacgaggtccgccgcgcctatgtcggcgcctgacgcagacaggacgacgacgctcgaattgcaccagggatcggcaaacccggcacggaaccgggacagtcaagggaggcaagatgtcatgaagatggtcatcgacgagatccggaagacgacccgccgccgggttctgatcgcggcggccgtggcggcggtgatggcgctgcccggcgccacgctgttcgccggcagcgcagccgaggccgccgacagcgccgtgatcggctattccggcccgctgtcgggcggtgcggcgctctatggccgcaacgcgctccgcggcctggagatggcggccgacgatgtgaacgcggccggcggcatggatatcggcggtcagaaggtgaagctggaaatccagtctctggacgaccgctacctgcccaacgagacggcggtgaacgcccagcgcctggtctatcagaacggcgcgcggatcgtgttcatcccccattcgggcggcatcctggcggcgcagggcttcaacaccaaggggccgcagaagttcatcatcggcgcctataccagcgagcccgcgatcctgaagcagggcaacccgctgcagatgatgatcccgccgcgctacaatgctctgttcaagccctatgccgaggcggcgatgagccggttcggtaagcggctgggcatgatccccggcacccacgcctatgccaaggaatggaccaagggcttcagcgccacctggaaggagatgggcggcgaggtgctgacggacaacgccgtcgactatcgcaccaccaccgacttctcgggcgcggtcgccaaggcgctgtcggaaaagcccgatgtgctgttcatcggcggcccgtcgcagccgaccgcgctgatcgtgcaggcggcacgcgaacagggcttcaagggcggcttcgtgatcatggatcaggccaagcccgaggagatggacaacatcgtccccatcgagatgatgaacggcctggtcggcaatctgccgctcgaatactatccttcgaagaacgcgccggccttcatcaagaaataccaggagaagtatggcgccaacgaggaagcggtggcggaaatcggcctgaactatacggcgctgatggttttcgtgcgggcgatggaacttgccggtaccaccgaggatccggagaagatcatgggcgcgctggccgaagcctccaaaaccctgccggccgaccgcaacccctatgagctgaccggcgtcgacgccgaaaacaacatggccagcgccttccagatgacggtggtcgagaacggcaaatacgtgccgctgccgttcaagtaggccggcaacaccccttatatccgcacgcaaagcccggccgtcggccccgacggtcgggctttccgtcctcagcccggttttttccgtcctcagccccggccgcgataaggcggcacgccctgatccgggatccagagatcggccggcaccggccccgtggcgtagaacacgtcgatcggaatgccgccgcgcggataccagtagccaccgatccgcagccactccggcgcaagcagttccgccagacgcttgccgatgcccaccgtgcaggcctcgtggaagtcgccatggttgcggaaggcgtgcagatagagcttcagcgacttgctctcgaccagccagtcgcccggcacatagtcgatcaccagatgcgcgaaatccggctggccggtgatggggcagagcgaggtgaattccgggcagacgaagcgcaccgcatagcgcgtacccggatgcgggttcgccacccgttccagcaccgcctgatccggagaggccggcaggtcggtgctccgtcccagctgttccagcccggcatagatggtttcggacggtccggtcacggaagcccccaatacgaacggcccaaaaacgaaaggtcagaaacacgaaaggccggcagatgccggccttttcgcaacgttcatgcgggaattggtggagccgaagggagtcgaaccctcgacctctagagtgcgattctagcgctctcccaactgagctacggccccgcacccgccccgccggaagcccgtcgggcaccggtggtgaacggcgcggatattggcgtgagggcgggatgctgtcaagcgcctctctcagagaatcgtcacaatcgactggccgcccgcgacggctgcgctatactccgccccgacccgtcagaacgccgcatcggacatgcggcagcccgagtacgagggagccccgcatggcgtcgcttctccaaggcctgctcttcctgttcaatgccgcgatcgagatctacacctggatcctgatcgcgagtgtcatcctgagctggctggtggcgttcaacgtcgtcaacaccaacaatcaggtcgtctacgcgatcggcagcttcattcaccggatcaccgaaccggtgctgcgcccgatccgcaacttcctgcccagcctcggcgggctggacctgtcgccgctgatcctgctgctgctgctgaacttccttaagatcgtggtcaatggctggctcgcgccttatgcctacgggatgatgtactgatccgatgagcgacgatatgaccggcatggcggctcctgcggtcgaacgcgaggggccggccaatgtctcgatcttcgtgaaggtgcagcccaaggcgcgcaaggccgcgatagaacctgcccgcgatgacggccatggccggatgcggctgcaggtgaaggtgaccgccgccccagaggacggcaaggccaatgccgcggtcgagcggctggtcgccgaggcgctcggcatcgcccgcaaccgggttcgcgtcgtccagggcgtgaccgatcgggccaagcggctgggcatcgagggcgagggtttcgccgatgccgaagacatcgccgcccgcgcccgcggccttggcgcctgagcccgacctcggtaaccgagcccgacctcggtatctgagcccgactcccgaaggagacacatcccatggcttcagctgaactcatcgacggcaaggccgtcgctgcggatctgcggtccgccaccgcggcccgcgtcggcggcctctatgcccgccatggcatccgccccggcctcgccgtggtgctggtcggcgaagatccggcgagccaggtctatgtccgcaacaagcatcgccagaccgaagcggccggcatgcgcagccttgaacacaagctgccggccgacacctccgaagcggccctgctcgacctggtggcgcagctgaacgccgacccggaggtcgacggcatcctggtccagctgccgctgccccgccagatcgatgcccagaaggtgatcgaggcgatcgatccggccaaggatgtcgacggcttccatccggtcaatgccggccgtctggccaccggtcagccggccctggtgccctgcaccccgctcggctgcctgatgctgctcgaccggaccctgggccagaacatggccggccggcatgccgtggtgatcggccgctccaacatcgtcggcaagccgatgggccagttgctgctcggccgcgactgcaccgtcaccatcgcgcattcgcgcaccaaggatctgcccgaaatggtgcgcaccgccgatatcgtggtcgccgccgtcggccggcctgagatggtgcgcggcttctggatcaagccgggtgcgaccgtgatcgatgtcggcatcaaccgcctgccgccggcgaccgaaggcggcaaggaccgcctggtcggcgacgtcgccttcgacgaggccaaggcggtggcggcgcatatcacgcccgtgccgggcggcgtcggccccatgaccatcgcctgcctgctctcgaacacgctgcaggccgcctgcgcccgccgcggcatcgacatgacccagctctgagcggaacatcaggggaggggagcgacggtcgatgctctatgtcctctgcctcccgcgtttcgctgccgccgatgcagaccggatcgatgccttccgccgccgccacgaaccggcacgggccaccctggtgcccccgcacctgacactggtcttcggtgcggccatggcctgtcggccggcccttgaaaccgccctggctgccgttgcggccacggaaccggccttcgatctgaccctgggcgatccgcacacccatctggacgacagacggcgcgaatacgccttctatctgcgcgcactcgacggcacggggcctctcgcccgccttcacgccgccctgcatgacggctcgggcctgccgacccgccgcccggacacccccttcgatccgcatctgaccctgaccggcgccccggaagcggagccggtcacggcagccgccgcggctttcgccgccgacgcctggccgttgccggtgcggggccatgtggatgcggtagagatcgttcagctgctggagggacgtcttgaccgcctgacgcgcgtccccctggccggaagtgtcctcttggccgaaaagggcgcaaccggcgaggcatgccctcaggacgtacggtcatagaacaggatcctgcccgccggcaggatctgattcatgagatcaaagtcgcggatgtttctggtcaggacggtatacccctgctccagcgcctggagataaatggcggcgtcgttgaacgcggcgacttcctgtcctttcggaagccgccccaggcggaacagcagaccggccagaattccggcttccagcagaacgccagaggtcggcgcatcaagacggtggcctggaatcgcgtcgacgacctggctcagctctcgaaggacgtcggcgctgccgggatgatcaggggtcaggcgcccgaaattgtgacagagttcccccacggcaatggcactgtgctggatctggcgggtctccagaagcgcatcaagtgcaggactggccgatccttccagcatgtcgacatagaccgacgtgtcgagcagcaagggcggcccaagcctctgagcccgatcggcaaagggcaggtccgtgcgggcacggcgggtgagcgtgccggaccacgtctcgggccggaggcggcgcaatgaacgggcgaggccgacgcgcaaaagggtcagccttccagagtgcccttgggaacccgcccccgccgggccagaagctgccggccgaaatcatcctccagcgcaaccttgctcagggcgtaaagaagcaactcgctggtgcttgcggcaccgctgcgggccctggccgccgcaaggagcttcgatggcacacgcccgcccaccgccgtatcgcgggcgccgagcagcccttctgcgtcagcggcctcgaaggcgagcttccggcgggctcgcgcgagatcctcgtccggttcgacggctgcctgcacggtttccggcgccatggcatatccctcctgcgggtggctggaccggtgaattgtcttacaaattttgtattccgttgaacatccgtcaagtccccactgcccccggccagacaaaagcccggcccgcaatcgcgggccgggctttgtcgtcagaaccgatccgggctgcggatcagcgcacgatgacgttcttgaacgcccagggctcgttccggtccagatcctcggggaagagggtctcgcggtcctcaagcggggtccagttggtccaatagccggccatggtgccgagatagggggtcgagatttcgaggatgcggcgctcgtcgatctcttcgggctcgaccacgccggcattcgggttctcgatcgcccagatcatcgccgccagcaccgacaccgtcacctgcaggctggtggcgttgttgtgcgggaccagctcgcgggcctcgtcgatggtcagctgtgagccgtaccagtagctgcccttggccggaccgttgaccagcacgcccagttcgtcgacgccgccgggctgggtctcgtccatcaggatgcggacgcggggctgcagctcccagttcttgccggcgaattcgtgcagcgacagcacggcctcgtcgcaggggtgataggcgtaatggcaggtcggccgatagaccacctcgccggcctcgtcgcgcagcgtgtaatagtcggcggtggagatcgactcgttatgggtgatcagccagccgtggatcgggccttcgctcgggacccaggtgcgcacgcgggtgccggcacccggacgcatcagatagatcgccgcgtcgcagccgaactcgtggcggcggccctccggcggcagctccggctcgtgcgtgccccagccgagttccgacggctggcagccctcgcccacgaagccgttcaccgaccaggtgttgacgaactcgccgcgctccttgggcggcaggcccttctgtgtgtcgcgctcggcgatatggacgaccttcacgcccagatcccgggccagcgccgcccagccttcgcggctctcgggccgcgtcgcatccatgccgctcgccttggcgatgtccagcagcgccgccttcaggaagtgcgacaccaggcccggattggcgccatgggcgatgaccgcggtcggcccggcacccagctcgcgcttcacgtcgagcgcgctctcgcgcagggcatagttgctgcgctgcgagggcgagagatcggggtcggtatagccgcccggccagggctcgacgcaggtgtcgacgtaaagcgcacccagctcgcggcacttgcggatcagggcgacgctcgacacctcgaccgagacgttgcacaggaaatcgccctggcccagccgctgctccagctcggccgcatagttctcgcgggtcagcgccatcttcaggaaggtgacgccgtattcctccgcgacggccttgccggcatcgtcgggcgagatgatcgtgatccggtccggggtgatgtcgatatggcgcaggatcagcggcaggacaccctgtccgatgctgccgaagccgagcatcagcaggcggccgggaagtgcggcgtgcttggtcatgatgcgaaatgcactccttgggagacgccggcggcgccggccgtccgtccgtccgcggatgcggacggtcagctctctatggaacggcgacgcgcgcggcttgtccaccgcgcgcgtcacagatttcaaggctttgtcatcaagcgatgcgggcgggaccggttcacgaaaccggcgccgcccccgccgggtccgctcagcggcgatcgccgcggcgggcaccgagacgcagacgcagggcgttcagcttgatgaagccctgggcatcgcgctggtcgtagacctggtcggcttcgaaggtcgcaaaggcctcgtcatagaggctcttcggcgacttgcggccgacgacgatcacattgcccttgaacagcttcagccggacggtgccggtgacgttctcctggctccggtcgatcagcgcctgcagcatctcgcgctcgggcgagaaccagaagccgttatagatcagctccgcatagcggggcatcagctcgtccttgaggtgcgaggcaccgcggtcgagggtcaggctctccatcgcgcgatgcgcgaccagcaggatggtgccgcccggggtctcgtagacgccgcgcgacttcatgcccacgaagcggttttcgaccagatcgagccggccgatgccgttggcgccgcccagatcgttcaggcgggtcagcagggccgcaggcgtcagcgcctcgccgtcgatcgcgaccgcatcgccccgctcgaacgagatctcgacataggtcggctcgtccggggccgcggcgggcgagaccgagcgggtgaacatctcctcgtccggctcgacccagggatcttccagggcgcggccttcatacgagatgtgcagcagattggcgtcggtcgaatacggtgcctcgccgcgcttgcccttggcgatcgggatctgatgcttctcggcatagtcgatcagtttggtgcgggagttgagatcccattcgcgccagggcgcgaccaccttgatgccgggctcgagcgcgtaatagccaagctcgaaacggacctgatcattgcccttgccggtggcgccatgggcgaccgcatcggcgccgacctgacgggcgatctcgatctggcgcttggcgatcagcggccgggcgatcgaggtgccgagcagatagacgccctcgtaaagggcattggcgcggaacatcgggaagacgtaatcgcgcacgaactcctcgcgcagatcctcgacgaagatctcggaggcgcccatcatctcggccttcgcgcgcgccggctccaactcctcgccctggccgagatcggcggtgaaggtgacgacctcgcagccgtaattctcctgcagccagcgcaggatgatcgaggtgtcgagaccgccggaataggcgaggacgactttcttgacgtcgcggctcatgatctgaagcccccgggaacgacaggatgtgggcggaaggtgcgggcatcgcggcgccaggaaccatacggacggccgcaagcgcgccgcccaggcccccgaggggccgcggatcggcgcagtatagtgcaaacgcgcgcggcggcaaccggtgcaggtcgccccgtgtttctggcggacggatatgctcccggtcagttcgcgatcaacgtgaacgcagcccaggtctcctcgggcacgccggcgagacgcccctccagcacatcgagtttggttgccctgaaggcggtctcgtagctttcgcccgccgcaagatggtcgtagaaccgggccatgaaccgggcggcgccgcgatcggagacaggccagcgggcaagcaggctgcgtcggacaccagcggtcgccagcgccgaggggaggcctgccagaccttcggcatagctgcggtcgccctccgccgtgtcgcaggccgacaggaccaccagatcgatgccgtccagcggccaggtcgcaagttctgcggccgtcagccgaccatcatctccgtcgcccgccgcaagcaggaccccggcacggtcgagcggatcatccgctcccgggtgcaagggttcgaagaagccatgcgtcgcgaaatgcaggacccgttgcccggcggccgcccgacggacagcgccggcacgggcatcctgtccgcgcagcacgacgggcggtatgcccccggcccgggcggtggcggcgatgccgtcgatttcggccgcggtgaagggcagcggcgatgccgtcccgccgtaatccacatcgcccaccagaagcacaccgttgcgatcggtatcctgaggcatgtcatggtccccgccggccagcgcccggccgctgcgggcgatgcgaagatccaggccggcgatcaaaggccaccccgcctgatcgaccagcacgtcgaacggcaccagggtgagcagcccgtccggcaccaccgtcaggcggtcgaccccatcgagttcggacatcaccggccggatcagctggtcatagagccggcggcgggtgtcctcttctgcggccgcaccagaatccgccatcagctccgacaccgccgccaccggcccaaggtcgaaaagccggatctctcccccggcccggccgagcatgaccaggatgcgctcctccacccggtccggtgccatgcgcatcggcacggtcatatagtcgagcacggcatcgcccggccggaaggccgagaggatctccccataatcgagcgcctgttgcgcctgtaggcggcgcagacccgagacccggtcggcgagggcggcctcggccagatcgagccggcgttcgatggcctgacggtcggcaccggggcgcaggctctgtgccgtcagattccggatctcggccacgagtgcccgatccgccgccgggagttccgcagccgcccggtcgagaagggcgcgctccaacgagcccggagccttccagttcagcatcacccgggcgaccagtgcgattgcccgggggtccgaacgtccggcggcatatccgtaggacaggatgtcgcccagagtttcgcgggtggtcgcggcgacctgctcaatcaccgcctgatccgaggtcgaggcatattcgcgccgcgcccagagccgcaacctttcctccagccggctataagccggggtagcctcggcggtcttcagcgcacgttccgcccgcgcgacattggtcgccatcgaaattgccaccggatgcagcgggccgaaatgccgctcggccaggtcgagcgacagccggtgcaggcgcagctcggccgcaggctcgccccggcgttcggcgatgccggccagacggttggccagatacaccgcatcggcatcgaccgtcccggcggtcagctgcgcttcaagcgccgcgagatcgcccgggtccccggacggcgccgccccggtcaggaccgcgatcatgtcgcgctcccgggcaatgcgacgcgtctcgggatgatccgggccgcgtgtgcgtgccagcgtctcgacgacctgatcatacagccccgccgcctcttccgcccggtcgagcccgatgagatccagggcgagattgcgggcactgatcagcgttgcaccatgggcaggcccaagattcgcgcgccgccagtcgagggccgcccggtcgagcggctcggcctcgtcatggcggccgagatcgcgcagcaccgccgccagattgttggcctgacgcatggtctcgtccgaggggccgagcgcctggccggcgcgtgtccaggcctcgcgcagatgcggcagggcggcggcaggccgcccggccatgccgtaggtctggcccagggcgccgatcgccacaatcgtgtcttcggcgtccgggccttccagacgttcgaacatctcggccgcgatgcgcccctcggcaatcgccgcgtcgtaatcgcgccggtcgcgatgcagggcggccaggttgaaatgggtgatcgcaaggggcacgctctcgccggcgccggccatcaccgccaccagccggtcgaaaaccggcacggcgctgtcgggatgaccggtgttctgaagtgcgatcgccgtgttgttcaggatcggcggcagacgctcggggtccacctcggccagccggtcgaaggcggcatcgcgcagcgcccgcgcctccgtggtctctccggcctgttccagcatgatggagagtgtcagccgcgccgcaagcgtcgccgtcgcatccgcccccagcaccccggtcctgagcgccaccagctcgcgcgacagctcgaccgcctcggcccggcgccctcgtgcatcggcagtgccgatcgcctcttccagcgccgcgtcacgccggcccggatcctccgccgcacccgtcggccatgacaggaacagcagcccgttgatcacgagagcacccgccaggcgacgtgacagcggaacgagacgacggatcatctgacaggcacttccggaagctcaggacaggtcattcaagcccgcagcgccgcatccggaacagcgacctttccgtgacccgtcggcgatccgcccccactatggggtcacttcgatcgccaccagtgtgaccgcgccgtcgagcccgtcgaccggcgcagccccaagtcgccggaggccgacgcccggccccacccgccagccagtcgcttccgcggcatcgaccaccgccgcctcggccagggccgcgacaccggccttgcgggtgtgcttctcgatcttggccgccaggttgaccggggcgccgatcacggtcagttccagccggctttcatcgccgaccgcaccgaagaccacccggcctccggcaatgccgatgccgatcgccaccgcatccagcccacccagccggcgggcctcgttccagcgggccaccgcatccagcaccgcggtggccgccgccatcgcccgggcgccatgggccggatcgggcgcgacggcgccgaaggtcgccatgatgccgtcgcccaggaatttgtcgatggcaccgccctcggcctggatcaccggcaccagccgggcctggtattctgccagcaggctcatcagcgcatccggcgccagccgctcgctcatccgggtaaagccgcggatatcgatcatcatgatcgtcgcctcgcgctcggcccccgaacccggggtcatcgccagcccggtctcggcgatgcgccgggcgacgtcgggcgcgaagaaccgggcgagcgaggcccgggccgcaccctcttcttcggcacgcaccagcagggcccgcgcccgggcgaggcccgccgccagcaccaccgtcaccaccaggatgaccacgatcttgtcgatctcggcgccgatcagaaccagcggcccgctcatataggcgacatagtcgcgggtgatcacccccatgccgcccccctcccagagggcgtagaacagcagcgccagccagccgcctgccgcggccatccccgccagcagcacatagcgcggctcgaagcgcaggcagcgcagggcgatgaagatgaacacatagatgaaggtcggcgccttcagatagaaggcggccggctggtggtactggatgtggaagctccagatcagcccgatcagcagcgccatgtcggccaccaccgacagggccagataccagcccggcagcggccccagataggcgagcttcagccggatgacggtgaagacggtatagatgcccagcgcccagggcaccggcatgaacatgaggtccgagcccccggccttggggctgaccagataaagcgtgccgaagagcaggatgatgccgacctgcgcccagccgaccagacgttcggccccggcctcggcctcggcgatcgccatctgcaaccgcgccggcatgttgcccggcggccggcgtacccatccgaacctcatccctcgccccccgcgcagccttgtcgcgctccgagcttagggcgagccggtttcggggccaagggtgagaccgtccccgtcgacagcgaccacgtttcggccgcatcatgtggcgccgccccgatcaggagataccgcccccatgtatcgtctgcacatcgccaacaagcactattcatcctggtcgctccgcccctgggtgctgatgcggacgctgaacatccccttcgaagaggtgctcacccccttcgacggcgcgatgaactggcaccgcttccgggccttctctcccaccggcaccgttccctgcctggaagccggcgacatcgtggtctgggaatcgctcgccatcgtcgaattcctggccgaacgtcatgccggcgtctggccggccgatccggccgcccgtgcctgggcgcgcgccgccgcagctgaaatgcatgccggcttctccaccctgcgcaaccgctgccccatggcggtgggggtgcgggtcaggcttcgtgaccatcccccggcgctcgcccgcgacctggcccggctggcggaactctgggccgagggtctccgccgcttcggcggtcccttcctcgccggcaaccggttcaccgccgtcgatgccttcttcgccccggtggccttccgcatccaaagctatggcctggttccgggcggtgtggccgacgtctacgcccgtcacctgctcgcccagccggccatggccgactggtatgccgcaggcctggccgaaccctggcgcgatgccgcacacgaggccgatatcgccgcgaccggcaccgtgctcaccgacctccgcgcgcccctgaaaggttgagccggatggccgtcgagatcccctatgtccgcgagatgagcttcgactacggccgcctggaagaggtggcgccgggcctgcgccggatcgtcgcccgcaatccctcggccttcacctattacggcaccggcacctatgtggtcggccggggccgggtggcggttatcgatccggggccgcgcatcgccgcccatgtcgatgccctgctcgatgggctgggggacgagacggtcagccatatcctggtgacccacacccataccgaccactcccctgccgccgccctgctgaaggccgcgaccggcgcccgaagctggggattcggcccccatggcgccgggcgcgacgacggtggagcgcgggtcgaagaaggcggcgacctggatttcgatcccgaccatcgcctggccgacggcgacatcgtgcagggcgacggctggacgatcgaggcggtgcacacccccggtcatacctccaaccacctctgcttcgcctggaaagaggccgggatcctgttttcgggcgaccatgtcatgggctggtcgaccagcgtgattgccccgcccgacggcgagatgggcagctatctgcacagcctgaccaggctgctcgaccggcccgaaacggtctactggccgacccacggtccggcgatcaccgatgcccatgcccatgtccgggccttcatcgcccaccgcgccgaacgcgagacccagatcctggaccggctggcgccaggccctgccggcatcatggggatggtgcgggagatctatgccgcggtcgacccccggctgcatccggcggccgcccgttcggtgctggcccatctgctgcatatgcatgaccgcggtctggtgaccgcggagggcgcgccggggctggaagcgatctggcggcgggtctgaggggtcaccgcccccgatagacgtagctctccaccggccgtggcggcggcgccacccggtggtgatgcggcgagcggtggcagaccggatcggtggcggcggcatcgccggtcagcgccagggcctggcaccggcagccgccgaaatcgaccgaacgacggtcgcaggatcggcagggttccggcatccaggccgtgccgcggaagcgccggaaggcgggagactccgcccagatccggtcgagcgcatggtcgcgcaccgaccagaatgtcagccccggaatggtttcggcggcgtggcagggcagcgcccggcccgacggcgtcagattgatcacccgccgcccccagccgcccatacagggcttgggcgtatcggcgaactggtcgggaacgacatggtcgacggcgatgccggccccgggcgccagccgctccaccagccggacggcgtccagcgccgcctgccggtcgggcaaaagcgccgcccggttcaccgctgcccagccgtgatattgggcatgggcgatctccacccgcccggcccccatctcgcgggccagcgcgatcatctccgccagccggggcaggttggcccggtggaccacaagattgacggtcagcggcaggccggccgccaccacatcggccgcgacccgccgcttggtccgggccgcgccctgccggccggcgatccggtcggccgacggatcgtcggcatcctggatcgagagctgaacatggtcgagcccggccgccgccagcgcgtcgatccgcgcggcggccagccccagccccgaggtgatgagattggtgtagagcccggcgcgggcggcatgggccaccagatcgaccagatcgggccgcgccgccggctcgccgcccgaaagatgcagctgcaggacgcccagggctgccgcctgatcgaagacccggcaccaggtggcggtgtcgagttcatcggaacggtgttcgagcatcaaaggattggagcaatagggacaggcgagcgggcagcggtgggtcagctcggcaagcaggcccagaggaggctgaaggtcttcgatcatgccagcaccaccagccggcgccgggccagatcggcgatcagccgccggatgtcggcctccaccagggcccgatcggcaccaaagcgggtggccagatccgcggccatggccgcgatggtcacctcgccggtgcaggccttcagcaccgccagcgccgtaggattggcctcgatcacactttcgggcgccagaagaacgacccggtcgcgcaccggatcgtgccgcagccgcaccccccgggccagaagcggacgggcctcgggagcgggcagatccgcgccgctcatgtccagacgccctcgtcatcaggcgtccaggcaccgggaggcaattgccccgtgacatagccgtgccagagcgcatcgagctgcgcccagagcacgccggtcttgaagatcaatgcctcgaccaccgcccgctgggtttccacggtggtggcatggcggcggacatggtcgagggcgaagatcacgtcgcgctccgcctggggcggccgggcggtgaaataggcgagcgcccggtcgtcgacgaagtcgtaatgggcgagcatgccgctcacccgttcgccgatcaccctgggcgaaaagagctcggtcaacgacgaggcaatcgcatcgagcagcggccgggtggcgcagaactgcacataggcctcgactgcaaaatgcgtcgccggcagggcggcccgccctgagaccaccaatgcccggttcagccccagcgcatcggtgagatgcagccagcgggcgataccgccctcgccctccgcctcgccgtcatgatcgatgatccgctgccgccaggcccggcgcagcgccggatcctccatccgggccaggatggtggcgtccttgcgcgggatcgccgcctgataaagataccggttcagcgcccaggcctggacctcggcgcgcgtgcagccgccgccatgcaggcggcgatggaagggatggcggtcgtgatatcgccgccgccccacctcgcgcagcaccgcctccagcccgtcaggcgtcagcggggcatcgatccggggtagcgggtcgttcacagcacgatctccattccgtcatgggcgacctcccagcccgccgcctcgaccaggcggcgttcgggcccgccctcgatcaggatcgggttggtgttgttgatgtggacatagacccgtcggccggcgcggatatcggcaaggccggccagcgagccccggggcccgtcgatcgccagatgccccatgcgcccggccgtcttcggcgacaggccgagccgcggcatctcgtcgtcggtgaaggtcgtgccgtcgaagaccagcacatccgccccccgcacacgcgccagcaccgcgggcgtgaccgcggcgcaattgggcaggcacacggcccgccggccgccggcttcgaacaggaaacccagcacccggccgtcttcgatcgtcgtctccgccggatcgaccgtgccgccttccatatagagcgggaccttgcccggggcggggaaggccgtcatcgtcagcccgcccgccagatcgaccggccggttgaggggcagcggctgccgcgccacgatatcctcggccagcacgtcgaagatccggttggcggccaggatgtccagcgtggcctgggccgcatgcagacggaagggctgtcgctcgcgcaggctcagcagaccggccgtatggtcgacatcgccattggcgagcaccacctcggcaatcgggctgtgccgggccccctctgccggatgaagggccggcgtcgccaggatctgggtccgaagatcgggtgaggcgttgagcagcacccaggaccggccgtcatcgcccgagagcgccaggctcgactgcgtgcgcggctgcacccgccggtcacccgcccaggcgagcgcacagaccgggcagcggcagttccattgcgggaagccgccacccgccgcggcaccgagcacgaggatccgcacccgccgtcagccttctgcgccggtggtctccgcgtcggtcgcgtcttccggggtgatgaaatcggccggcatgtagccgttgatctccatgccgatccgggtctcgacgatctggggtgtggtccagttcatgatgcaggatctccgcgatgaggtgggtggcccacccgactccatatggagccgccatgcgccgtcgacacccccaacctgcggaaagccgggcgggttcccagaagccgttcccggaagccgccctcaatgcagggcgagcgccgccgccattgcctcgcgctcggccgcgtccatcacctcgggctcgggggccgccacggtctcgcgactcttgcgggcgcgctcgctggccgatttcagctggccgcaggcggccagaatgtcgcggccacggggcgtgcgcaccggcgaggaatagccctgatcgttcagataggtcgcgaaattgcggatctgggtccaggacgagcattcgaaggtggagcccggccaggggttgaacgggatcagattgaccttggccggaatgccgtcgagcagccggaccagttcgcgggcatcggccaggctgtcgttcacgcccttcagcatgacgtattcgaaggtgatccgccgggcattgctggcggccggataggtccggcaggcctccatcagctcggcgatcgggtatttccggttgatcggcaccagcacgtcgcggacatcgtcggtcaccgcatgcagcgacaccgccagattgacccccagctcctcgccgcagcgctgcatcatcggcaccacgcccgaggtggagagggtgatccggcgccgcgacagcgccacgccctcgccgtccatcacgatgcgcatcgccttggcgaccgcatcgaaattgtacagcggctctcccatgcccatcaggacgatgttcgagatcagccggttggcatcggtcggcgtcggccattcgcccagccggtcgcgggcgaccagcatctgggcggtgatctcggccgccgacaggttgcgcacccaggtctgggtgccggtatggcagaacttgcaggtcagggtgcagcccacctgcgacgagacgcaaagcgcgccgcggccgtcatcggggatgtgcaccgtttccacctcgcggccgtcggcgaaacgcagcagccacttggccgtgccgtcgctcgacagctggtcggtggtgatctcgggccggccgatgacgaaatgctcggccagcttcgcccggaatgccttcggcacattggtcatgtcgtcgaagtcgcgggcgccgcggaaatacatccagtgccagagctgcttggcccggaacggcttctcgcccagggccgccatctcggcttccagttcctggcggtccagcccgatcagcgtgcgccggccgttgccgggcaccagcgtgaccggggcggtggtctgcgcgatcttttcggccgcacccgggcgccggagcgccgcggtggcggtggtgccctcgggcaccggctggacgacgatggtcatggaaaggtctgccagggttggaggtgtcggacagcggcagccgggatcagctgccgcaggcgggcgtcagctgccgcatttggcgatttcgctcatgccggcggtaacgccactcaggctgtaagtgtcggtggtggagacgctgccctcgcgggcggtgcccttcacgaccatgttggcgccggcacgcatggcatccagaagcttgcggtcggtgtcggcatcgcgggcccaggcggtttcgccgtcggtgaacagcgagaagttgttgccgccgatggtcacggccacctcgctgccgggcttgtaggcgtagcctgcgaagacgctgacctcggtgaccatccggccgccgctgttgcggcggttgaccatcacccgggcatcgccgcggcccttcacctcgccctggcgctgcttgggcgcgctcgcgatccagcaggacacggccttgcccgagccggacttgaacgccgtccagtcgccgaaggtaccaagcaggctgatttcctgcgcctgggccggcgcaacgccggtcgcgggcagggcgacaagacccacggccgccacgacggcggccatggcaagacggcggaaggcggaagcggacggacggttcatcggatcaccggaggttggtgggtccaccgaagcggggcaggggaaaaggcagtgcgacgcgggggcggccccgatacatctcgccgaagccgccggccggacccggaaagactggtcccgacggggccggatttcaagcacgggtccggatgttgccacggatcgggagggccgcctcccttgatcggccggccgggcccggccatatttgcagcggacccccggccacgggggttatcgcacaggcccataaacgttttcaaggatgcggcacatggcctacgacacccgcagggcatacgacgcgggggcggcgtcgagggcggtggccttcgatgccgggctgcgcacctatatgctcggcatctacaactatatggcctcggcgctggcgctgacgggcatcgtcgccattgcggtggcaagctcgccggatgtctatatggcgatcatgggcaccggcttccgctgggtcgccattctggcaccgctgggcttcgtgctggcgctgtcggccggcatcaaccggttcagcaagaccacgacccagatcctctactggctctacgcggcctcggtggggctgtcgctgtcgaccatcttcatggtctataccggctccagcatcgcgcggaccttcttcgtgaccgcagcggccttcggcggcctcagcctctacggctataccaccaagcgctcgctgtcgggcctcggctccttcctgatcatggggctgatcggcatcatcctcgccagcctggtgaacctgttcatcggctccaccatgctgcaattcgtggtctcggtggcgggcgtgctgatcttcgccggcctcaccgcctacgacacccagcagctgaagcagatgtatgcggcgaatatggatgacgagaccgcaggcaagctcaaggtgatgggcgcgctccggctctatctcgacttcctgaacctgttcatgctgctgctgcagttcatgggcagccagcgcaactgacgctcgggatcgctgatccgtgctatgatcgggcccgcctctcctcgaggcgggctcttcttctgtctgcccccagcaccgccgcacccggtacccgatgaccctcacccatcgcgagcgtttccgcatccggatcttcctggtgatcctggcgatcggcctaatcgacggcttcctttacagcttcaactatggcgccgatctgcacacccagctgcgaggcatcaccaccggcctgctggtcgtggtcccgatcggcctctgggagacctggctgtcgacggcggcgatcggccggttcgtgcgacgccagcgcgccgccgtcaccgtgctgatcagcagcgggatctatctcacctcgatcctgttcggtcttcataccggtgcggtgctgttcgacgatgccgacaaggccaaaggccttctgggcgtcatttcggacgaaagcttcgccttcgccatcgcgatctcgctgctgatgaacctgatcttccagatccggcgcattctgggcccggatgtgatggttcagttcctgaccgggcgctatcaccacccgcgcgaagaggagcgcgtgatcctcttccttgacatccgcgggtccaccgccatcgccgagcagatcggggcgctgcgcttcctcgatttcctgaaccgcttctatgccgatctctcggaaccgatcctggaaaccggcggccagatctatcgctatgtcggcgacgagatcatcgtcacctggcccatggagcgcgccgcgcgcaatgcgggctgcttccgtctgctccagctcgccgaggccgtcatcgcccagtatgcggcccattacgagcgcacctacggcacggtcccggcctggcgcgcggctctccattgcggccgggtcgccgtgggcgaactgggcgacatccgccaggaaatcgtgctcatcggcgatgcggtgaacgtgaccgcccggctggtcgatcatgcccgtgcgaccggcgaagcggccgtggcgagcgccgacctggtccggcgcctgcagatcccgtccccgacgcccatgcgccgcctgggcaccatcgatatccgcggccggcgggaaccgctggaggtctacgggctgggggcgctgccgccgaacagatccggcatggcagccgcaggggccgcctccgcgaccgacaggcccggcgccacggccgcatccagcaggccgagcgccgccgcggccgatgtggccgggtccagccagcccatcgcctgaccggcgtcatcgatcagcgccggcatgcgcggatggatatgggcaatggcggggacggcgggccgggtgatgaccgtaaaggccggattgccggcggcatcccggccatagagtcccgccatcgtcagcaggccgccatcgctgcggccgatcctgacccggccgcggccgcggccctcggtccaggccgtggccggcaccaggcagcgccggcccagatgcggccggaagctcggcgcctcggccaggcgttcgatccgggcattgaacagcgggctgccatcccagggcgccggccatccccagggcaccagcccgaccgccgcttcgcccgcggcatcgatcagcagcaccggtgcccggtcggtcggccggaaggcctgcaggcccaggacggcgtcgagcgtgccgggcaggcgcggcaaccggcccagcaggcgggaaagcaccgcggccagatcccccgcattcaccgtcagttcatagcgcgagcacatgggtctcggtcccttccgccggatctgccggtcaggctaggcggcgccccgcatcaccgcaagcccgtccgcccctcgacttggcagcccctcgacttgggcccggcctgctccataatcttcgggatgacagccgacctgcttccgccaccggcgctcgatacccagagcccgaccaccgccgcccggccctcgcgtcggcggcgttggggcggcttcgccgtcaagctggcggtcaccgtcgcagcgctggtcgtcgccctgccggatgccgacggccgtgccgtcgccaaccggctggcggcggcggagcccggctggatcgcgcttgcgatcgccatcgtgctggtgcagaccatcgtctcggcccatcgctggcggcgggccgcccgtgccaccggcatccggctgcgcacccgcacggcgcttcgggcgctgctggtcgccaacgggctgggccaggcgctgcctgcttcgatcggcaccgatgcggccaggctcgccctgatccgccgcccggaccggccgatgacggcgctggtctcgggtgtcgtgctcgaccgggccgcggggttgacggggctcgcgatcgcggcggcggccgccctcgcccttctgccccggatcggcgttcatgccgaagccgcccccgaactgggtctgctgccggttgcggctgcggtgatcggcctcgccccggtgctggcggcggccctgcttgcccggcgccggcccagccggcaggcaggtacctacgcccccacccgcagggcccgactggctgcaggggcggggcggatcctcgacgatctcgcccggctggggcggcgcccccgcctcgcctggcagctgctggcgccgacgctcgtcgtccacgccctcaccggcctcgccttctgggcggtggcccgggcactgggtctggatctcgacccgctggccggcatcgctctcggcatcctgctcgccacggccgccaccctgccgatcgccattgccggctggggtgtgcgcgaaggggccgccgtcgctctgctgccgcttgccggcctgtctgcggccgatgcctttgccgtctcgatcgccttcgggttgatgctgcttgccgccggcatcgccggattggcggcctggttgcttccggcgggcgactgacctgcgtgccgcccgtctggcgccgcgggcgatttcctgctatagccccggccattcgcctgttggcgtatcccaagcccttgatgcatcgaacggaggcccctcggatggcacccgccggcaaccgcatttcgcgcgccctgatctcggtgtccgacaagaccggtctggtcgatttcgcccgtttcctggtggaaagcggcgtcgagatcgtctccaccggcggctcggccaagctgctgcgcgaggccggcctgccggtcctcgacgtcgccgacatgaccggcttccccgagatgctggacggccgggtgaagaccctgcatcccaaggtccatggcggcattctgggccgccgcgacctggaaagccatcgcgaggccatggccgcgcacggcatcggcaatatcgatctggtggtcgtgaacctctaccccttcgaggcgaccgtcgcttcgggtgcgggctgggatgacgtgatcgagaacatcgacatcggcggcccggccctgatccgtgccgcggccaagaaccatgattcggtgacggtcgtggtcgatgccgccgactatgcggcggtgacggccgagatgcaggccaatggcggggccaccaccctccatctgcgccgggcacttgccggccgcgcctatcgccgcacggccgcctacgacaccgccatcggcagctggttcgcggggcaggccgaagacaccctgcccgagcggctgacggtcggcggcgcccgtggccaggtgctgcgctatggcgagaacccgcatcagcaggccgccttctacgtcaccggcgaaaagcgccccggggtcacgtcctctgcccagcttcagggcaaggagctgtcctacaacaacctgaacgacacggacgccgcctatgaactcgtcgccgagttcgaccgtccggcggtggcgatcatcaagcacgccaacccctgcggcgtcgccgagggggccgacctcaagtccgcctacgaggcggcgctggcctgcgacccggtgtcggccttcggcggcatcgtcgcggtcaaccggccgctggacgaggcggtggcgatcgagatcgcgaagatcttcaccgaagtgatcatcgcccctgaggtgaccgaggccgcccgcaaggtgttcgcggccaagaagaacctgcgcgtgctggaagccggcgccctgcccgacccggcggctcccggcctcgccgtgcgctcgatcgccggcggcctgctggtccagacccgcgattccggccgcatcgcccgcgccgacctgaaggtggtgacgaagcgtgccccgaccgaacaggaactcgacgacctgctgatggccttccgggtctgcaagcacgtgaagtcgaacgcgatcgtctatgtgaagaacggcgccaccgtcggcatcggtgccggccagatgagccgtgtcgacagcgcccgtatcgccgcccgcaaatccgaggatgccgcccaggcgctgggccgcaccggccggctgaccgagggctcggtcgtcgcctccgacgccttcttccccttcgccgacggcctgctggcggcggccgccgcgggtgccaccgcggtgatccagccgggcggttcggtgcgcgacgaagaggtgatcaaggccgccgacgagcacgggctggccatggtcttcaccggcatgcgacacttccggcactgaccggacggggcagacctgcccgatcgacggccccggcccttcaagaccggggccgttcatcttcagggaacaagatgggaagatcatccatgcctggccggcagatcaccctcatcgccctgctgggcatcggatcgacaggcgccctcgccgcgacaccggtcgatctcgacctttatgtcggcgcctatccctgggaagaagtgacgacggccggcggccgccatctgccgccgctccttaccctgaagacggtgcgggcggcgatccgcgcggccgctccggccggcaccgatgtcgtccgccgggcgctcgatcccgacggtccgcgcacacccgtctatcggctgaaggaccggatccattcctggggctgcgagacccacaattgcggcgccaacaactgggtggtcatcctggcccccgacgcctcggcggccgagatctgccatcaggatgccggtcaggtgttctggtacgggaacggcaccggccgcgagatgcccgagggctttgcgtgcccggacaaacccgacgagcccgaggcggcggcgaactgaccggctcaggcgccgaacagcctgtgatcccagaaaaccggatggtgcaggccggccgtgatcgtccggaactgtggatgggccggattgatcaggatgttgtggtcgagccgcgcgaccacactgggcacgatcagcaccgcactccgccgttcgcggctccaggcttcgccaaagcgacggctgatgacgggtggcatggcatcccagccgggccaggcctcgggcgcgaacatctcgtagctggtgccggcgggaatggtgatttcgatgaaatgctggttcggcggcagcctgccgctgccatggaccagcttttcaagcagggctgtggaatagtgctccgaggcatagatcaccgggctgccgcgggtattccatcgcccgggagcgatggtcgatccggtggcgtcgaagatcggccaggttccatccggatccccgatccgccaggcacggagcgttcggtcaaggatctgcgccgtcacgcagcactgccgtatttgagccgccccagaatgtcgatcaccagttcggcgccgaactcgctgcgcagcaccacatccaccgggagttcgtcttccagcatcggatgcgggcgaaacaggaagtcgcgcgccgccgcctcgtcccgccagacatcgacggccgcgctccacaccttggccagccgtgccacccgggtcccctgctcaggcgacagcacccgcgacgccttgcggcgttcataggtcgccttcggcaccagacggtatttgaaccgggcgtcatcgggcgcgaccaaccgcaccacgcgctcgagtgtgtcgaggggcagcccctcctcgatccgggcgatcagggcgaagccggagccgatggcgggcgtcgtcggcagccccagaacctctgcaacctcggtcatgctggtcatgggatgatccttctcatacgagactcaagatggtctcgcatgagaaggacatcaagtgcggcgacgcgccgatcagccgccggccagtgccgtcaatcgccgggccgcgacgatcagcatcgccagcgtcacgtcgggtgccgacagcacttcgtcgaccgccgccgcagcgcggcccagggctgccgcttccgcctcggcccagacatcgacatcgcccgccgcatcgcgggtgaagatcgactgggtggcccgacgctggacgccgtagaggtcgtcgatgacgctgctgaccgccagccgctcccaggggtcgtcgaccacgatggtgcgggcggcgtggcgcagggcatgcaggtgaagccgggggtcgacggcataatagaccggcgccaccttctccaccggcaggtccaggttctcggacagggcggtgagatcgaagaccgagaccagcgagcccagctgtgacaggcagaccgccgccccctcttcaagcccgcccgaggtcagccttgcggcatcagcaccgatggcctcggccacctcggtcggcagcacctggggaagcacggcctgaagggccgccgccgtcggctggaagcggccgatcacctcgcccaccgtggccgcccggccgccccgcaccagcagccagcgcatggcctgggtcaggcgccgcgatacccggtcgagcgcatcgagccgccgatcggccggcatcgtcgcctcggccgcatccagcgccgaccagagcgccggcaggcccaggacgtcgcgggcgacgacataggcacgcaggatctcggccggtccctggccggtctcgtcggccagttcgcgggcaagacagggcccgccgcgattgaccatctcgttgaccagatgggtcgccaggatttcggaccggagcggatgggccgcgatatgctcggggaagcgcgcccggatcggccgcgggaaataggccgccagatcaccggccagcgccggatcatccagcagcggatcttccgccacctgatgggtcagctcgatcttggcataggcgagcagcaccgccagttcgggacgggtcaaccccagcccctcgcgcgcgcgccgggcgagttcggcctcgtccggcaggcgttcgagcgcccgatcgagccgcccggcccgctccagcccgtgcagcagccggacatgacggtccagccggcgcccggcctcgcggctttccaccgacaaggcctggttctgcagctcgttattggcaaggaccagggccgccacttcttcggtcatcccggccagcagcagatcccgctgcttgcgggtcatgtcgccggcttcgagcacgcggccgagcaggatcttgatgttgacctcgtggtcggagcagtcgacgccgccggaattgtcgatggcatcggtgttgatccgcccgccattcagcgcgaactcgatccgcgccgcctgggtgaagcccagattggcgccctcgcccaccaccctggcccgcagctccgcggcggtgatgcgcagcgcgtcgttgctgcggtcgccggcatcggcgtcacgctcctgcgaggcgcgcacgaaagtgccgatgccgccgaaccagagcaggtcgacctcggccttcagcatcgcccggatcagggccgagggcgtgatgcgggtttcggctatgccgagcagggcccggatctcgggcgtggtctcgacggtcttagccgcccggtcatagatccgcccgccgggcgacagcaccgccgggtcgtaatcggtccagcccgagcgctgggcggcgaagagccgggcccgttcggcgaaactccgcgccggatcggggttggggtccaggaaaatgtgcagatggttgaaggcgccgaccagcttcaccgaatccgagcgcagcagcccgttgccgaagacgtcgccgcccatgtcgccgacgcccataacggtcaccgggtcccgctgcacgtcgatgccggcctcgcggaagtgccgccggaccgaaacccaggcaccgcgcgcggtgatcgccatcttcttgtggtcataaccggcggatccgcccgaggcgaaagcgtcgcccagccagaagccgcgttcctcggcaatgccgttggcgatgtccgagaaagtcgccgtgcccttgtcggctgcgacgaccagatacggatcgtcgccatcccgccggtgcacgccccgcggcggcaccggctcacccgccttcagatcgtcggtgatgtccagcatgccgccgacgaaggcgcgatagcagccgaccacctcggcctgcagttcgggccgggtcgcgggcgggcgcttgacgatgaagccacccttggcgccggtcggcacgatcaccgcattcttgaccatctgcgccttcatcaggcccaggatctcggtgcggaaatcctccagccggtcggaccagcggatgccgccacgggcgacacggccgccgcgcagatgcacagcctccacccggggcgaatagacgaagatctcgcggaacggccggggcggcggcaggtcgggcaggctctgcccgtccagcttgatcgccagcaccggccggcggccgccatctgcctcgcgcagataggcattggtgcgcagcactgccagcaccacgtcgcggtaccggctgagaatccggtcctcgtccacattggtaacggcatccagcccctgggcgaaggcctcgaccagccggtcagcctccgcctcggccgcggcggaggcctccgccgtctcgtggcgggcaggatcgagcctggcatggaagagctgcacgatcagccgggcaagctcgccatgacgggcaagcgtctgctcaaccgtgttctgggcaaagggcaggccgatctggcgcatatagcgatagagcgcccgcaggatcaccacctcatcggcggtgacgccggcgcgcagcaccaaggcattgaaccggtcgttttcgacctcgccccgccagacgcgggcgagcgtgtcttccagcaagggccccagccgcgccggatcgaccgcgccgccctgctggtcgaccaggccgaaatcgtgcagccaggcccggatgccgccggcttccgcgtcctcgatcgcatagggctgctcgtcgatcacccggaagcccagattctcgatcatcggcagcacgtccgacagcgcgatcggcccgccgggccggccgagcttcaggcgcagcgccaccgaggcgccaccgccgacgggggtatagaaggcaatcgagatcgcctgcggatcgccggccagcgcctcgagccgcagcagatcggccaccgcctgttcggggccgaaacgctcggcatacagcgccggcaggccgcggccggcgccgcgcaagagggccaggccccgctcttcgcccaccgcatcgatcagcgcctcgcgcagttcgtcggcccagccgcgcaccatgcgggccagccgggcttccagcgccgccgcatcgacctgcgccggctcggcctcggggtcgaccatcagcacgaaacgcagccgcaccagcggcgcctcggacagctgcacctcggccagatcggcggtttcctcggcgagcgtgccatgggtcgccgcttccagttccgcgagcacacgccgccgcagccggctgtcgaaggcgtcgcgcggcacatagaccagcgcgctccagaaccggccgaagacatcgcggcgcaggaacagccggagacgctggcgcagctgcagcttcaggatgccgatcgcggtctcatagagatcgtcggtgccgatctggagcagttcgtcgcgcggataggtctccagcacgttgagcagcgacttggcgtcgtggctgccgggcgcaaaacctgcccgctctatgatgccgcgcaccttgcggcggatcagcggaatggcgcgggggttgctgtgataggcggcagaggtgaacaggcccaggaacaggcgctcgccctcgacccggccatcggggccgtagatcttgacgccgatatagtccatcggcaccgcgcgatgcaccgtcgcacggaaacgcgacttggtgatcgtcaccggctcgtcgccgaagctctcgtcgccgtggagcgtgaagccggcaaggccgcggggccgttcgcgaccgtcatcgccgccggtcccttccatcacgcccagggtgcgcagcacctccacccggcgctgtccctggccgtcggcttccgagaagcggcagtcctggaaacccaggaaggtgaaattgtcgtcgcggatccagcgcaggaaggcggcatgctcgctgcgcagatcctcagacagaaccgcatcgggcaggctctcgacatcggcgatggcgcggtcgatctcgtcgcgcatcgcctgccagccggtgacggccgccgccacatcgtccagcacctcgaccagccggcgcctgacctgatccagcgccgccgcgtcggggcgtcgggtgacctcgatcagcatgaagctctcaggtaccgcccggccgcccggacccgccgcttcgtcaccggcaccgcccaggcccagatagcggccatcggcatcccggcggacggtcaggatcggatggatcaggccatgcagggccagccccatctggttcagcgccgccaccgtgctgtcgaccaggaagggccggtcgtcggtggtgaccatcaccacgctgttgcggctctgccagccatggcggtcgatgtcgggattgaagacgtcgaccagggtctcgcccgccgcccgcctgcgggcgaaggccagatggccgagtgcggcgcccgccaggcgccgtggcccgcccgccggcagctcgtcgagccccgcggcgtaataggccttcacgaactccatcgcctctcgggcgtcttcgggtgcgaagcgcgcctcgatcagcgctgcgatcgcgtccatcggcacggctccggtgtcttggacaccagcctgacttgcctccggcatgtttcctccccttcgggctcttgctggaacgacgtcccgtcatgggacgtcgacggcccgggtaagggtggtatcgaacgccgttcgacgcaagcgccgacccgtgacggatcagcagcaaggccgtgaattttccacgagagtggacaaggcgcaccgctcagcgccggagcacgagcagattgccgcacaggatcacccccgcccccgccagcatggccggtgtgagcagcagcccttcgaacccccaggagagcgccagggccaccaccggtaccagggtcatggcataggcggcccgcccggggccgacacgccgcaccagatcgaaatagatcaggaagttgaggcacgaggccggcagggccagataggcgaggctcagcccatagcgccacgaccagtcgaaggcgaagggtgccccctgaagcaaagcgaccgtcagggcggtgatgccgccgatcagcccgccccaggcgatggccgcctcgggtgccagccctcgcgcctgatgtcgggcgccgatcaccgtgccgagcgccgccgcaacggcagataccgctgcccaggccagcccttccagcgcccgcggcccctcgcccagccgggcgagatcgggggcgaagaccagggcgacgccaccgatcccgagcgccagcccggccagatgacggcgggtcagcgaggtgcccagcagcgcccggccgatcaacccggcgaagaccgacgaggtggagagcaccagcgccgccgggccgctggggatcaggcggacggcactgtagaaggcgacgaaggccagaccgtaaaaggcgacgccctgcagcaccgtccatcgccagtccgtcgccgtcagcctgagccggacgccgcggatatgcgcccagcccatcatcagcagccccgccgcgaccatgcgccagcccaccgacaccaccgccggtacgggccccgcctgaaaggcggtggcaagcgccccgccccccagagcagggcggtggagatgaacagaagcgcggtaacgcccatgagcccggaacccttgcgggaatacgatccggaaattctatcccgaagcgtgcactgcgtgccagagcttccgcgagacgcgttcgccgacagccttcgcgatgattatccggtcacacccacagaagccgccagacacgggacaaaagaaaacgggctgatcgtcaccgatcagcccgtttcatctgcgtttccgcaatctctggagcgggagaagggattcgaaccctcgaccccaaccttggcaaggttgtgctctacccctgagctactcccgcccgctccgtcaggcagcgtcgctgccgtctgtgtgcgggataatattcacggcggcggctggcgcaagaggtttttttcagtttgacgacgattttcagaccggagcgtcgaggggcaccggatgcagcgacggtcgcgcgttgagggcatcgcgatcgaagccggcgatgtgcttataatcgccgatgattccgttgagttccgccgccggcagcaccttttcgaccgccttgaacccgtccggcgcccgctcctcgaccagctgcatcaccttctcgggcccgttggcacggttggcgagcacgatgcgcgcggtggcaggcagccgctccgcctcgtaggcggcaagcgccgcatcgacatcgcccatggtcgccagccgccagaccagggtgcgggcatccagaatcgcctgcgacgcgccattggatccgatcggatacatggggtgggcggcatcgcccatcagcgtcacccggccatgggtccaggcctccagcggatcgcgatcgaccatggggaattcgaacacccggatcgcggcccgaatgatcgccggcacgtccagccagccgaaattccagctctcaaaggccggcaggaattcctccagcacgccgggccggttccagtcctcgcgctccagcttgcgctcgggcaggttcagttcggcgatccagttgatcagcgacgccccgcgcgccgcgatgtcgggatcgatcggatagcagacgaatttctgatcctggtggccggccatgaccatgctgcggccgtccagatagggcggggcctcgctgacgccgcgccagaggatgcggccattccatttgggcaggccctcgtccggatggaactgcgcccgcaccgccgaatggatgccgtcggcggcgatgatgagatcggcggtgtcgtggccgagcgaggcaccggtggtgcgcgagaccagatcgatccgcgcccggccgtcggcctgggtggcgacgcgggcggcggcatgatcggtcagcacccggtcggtacccagccgggcccgcgccgcatcgaacagcagcatctgcaggcgaccgcgatggatcgagtactggggccagttatacccggcgtcgcggccgcgcgcctcgcgccagatctcctgccccagcttgttggtatagatcagcgtcgaggtggcgacgccggtgcgggcaagctcgtcggccaggcccagttcggtcagctcgcggaccgcatggggcagcaggttgatccccacccccagcggccggatctcgggcaccgcttcgtaaaccacggtctcgatccccgcggcatgcaggctgagcgcggccgtcagcccgccgatgccggcgcctgcaatgatgaccttcatcggatcctctcctcccatcccgcaccctgggcaccggctcggagccgggtgcattgcgtgtttcgggtcaggatatatccggagaatgtacgatgtcattacaatccgaattgacgatcatccgctctacgaactaatctgaggaaaccggcagaaaaccggtttatggtggccgatgcaccgcccgggatcagaacgagaccagcccgggccggatcatcgggagacaggaatgacacgcggacggcggacgacctccagcgtcctgccgcggccggccggccgcggtgacgctttcgagcaatggccggaggacgttgagttcggggtgctgcgcgagctgatgggctatgcgctgcgccgggcccagatcgccatctacgaggatttcttcgccaccgtcgcggatctggacatcacgccgccgatgttctcgtcgatggtgctgatccggaacaatcccggcctcagccagagccggctcggccgggtggtgggcattgcccgatcaggcaccatggccctggtcgaccggctggaacgcgccggctatgtcgaacgccgccccacccccggcgaccggcgggtcaaccagctggccctcaccccgcatggcgaggaggtgctcgacgagctgatccggcggatccgcgcccatgacgaccgggtctcggcgcggctcagcgaggcggagaaggtcacgctccgcgatctgctcgcgaggttctgaatacgcgatctgctcgcgaggttttgaatacgcgagctgctcgcgcggcttgagacaacatcaggcggcatccgcagacaggggtgccggagacgagcggggcgacaagatcccgccgcccagggaggagaggcgccccatgtcgagggcagacccggccccgcacagcgtgcagggccgcggtgagaaggcgtcgcggtccggcggccccttccgcaccggtttcggccccgtcggggtcctgtgccgtctggtcgccatggccggcgggctgatgctggtcgcgatcgccgcgatgtcggtgatcagcatcatcggccgctggtttgccggcaccagcatcggcgggctggaattcgggcccgtgccgggcgatttcgaactggtcgagacgggcaccgccatcgcggtcttctgcttcctgccccaggcccagctcgcccgcgcccatgtcacggtcgatctcttcaccatgcgcgccggcccagctctgcgccgggcgctgggcgtcgtcgccgatcttctgttcgcggccaccaccgccctgctcgcctggcggctgaccatcggccttgaagagcgcctgacctatggcgaaaccaccatgatcctgggcctgccgcaatggtgggtctatgtgccgggggtggccttcatggccctgaccgccctcgcctgcctgaccacgctcaccgccacgctgcgcggtgcggtgccgccgaccgaggccgaggctgccgccgcagaggccggaacggccagcgaggagagccggcgatgagcgataccaccatcggccttctcggcattgccggcctgctcgtcgccatggcgctgcgcgtgccggtggggctcgccatgctggtggccggcattctgggcagcatggcggttgcaggccccatgggcatcatggccgggctcaccaccctgccggtggagcagttctccaaccacgcgctctcgatcgtgccgctcttcctgctgatgggcgcctttgcaggccgcgccggcctctcgcagctgctgttcgatgccgcccgcgactggctgggccatcgccgcggcggcctcgccatggccgcgatcggcgcctgcgccgccttcggctcgatctgcggctcgtctctcgccaccgccgcgaccatgacccgggtcgccctgcccgaaatgcgccgccacggctatcacgacgggctggcgaccggcgttctggcggccggcggtacgctcggcatccttatcccgccctcggtggtgctggtgatctatgcggtgctgaccgggcagaacatcgaccggatgttcattgcggccctggtgccgggcgtgctcgccgctctcggctatatggcggcgatccgggtgcaggtgatgctgaaccccgacgccgccccggccgttccccggatcggctggtcggaacgtctccgcggcctcgcccgcacctggccggtcttcgtgatcttcgtgacggtgatcggcggcatctatgccggcgtcttcacaccgaccgaaggggcggcggtgggggccgcggccaccgggctgttcgcgctggtccgtggcgggctccgccgcggtgccttcaccgaggtggtgatggagaccgcttcgggcaccgcgatgatcttcatgatcgtgctgggggccgccgccttcaacggcttcctggcgctcaccggccttccgatgcaggcggccgagacgatcggcgggctcgacgtgccgccgatcgtggtgctggcggcgatcctggcgctctatctggcgctcggctgcatcatggacagcctgtcgatgatcctgctgaccgtgccgatcttctacccgctgatcatggcgctggatttcggcctgccgcccgcagaagccgccatctggttcggcattctggccctggtggtggtggaggtcggcatgatcacgccgccggtcgggctgaatgtcttcgtgatcaacgccatgtcgggcggcacgccgatgcgtgacaccttcgcaggcgtgatcccgttcctcgtctccgacgtgctgcgcatcctggcgctggtggcctttccgggcatcacgcttggcctgatgcgcctgctctactgatcttcaggaaaggtccgccgcccatgaccaccggctttcccgccaccccgcccgtcctgtccccggtcgccctgatcgaggccgagatcggcaccccgcaggaactgggcgcactggccgatggccagcgccggatcatcccgatcctgggaggacgggtctcgggcgcccggctggccgggcgggtgctgccgggcggggccgactggcagaccgtgcggcccgacgggctggccgagatcgaggcccgctacaccctggccctgaccgaggtcgacggcgcggccgtggatgcgctggtcgacatccgtaatcccggcatgcgccacggccccgccgaggtgctggcccgggtggcggcgggcgaggatgtcgacccctcgctctattacttccggaccaccccacgcttcaccaccggccatccggccctcggctggatgaaccggaccctgttcgtggcccgcggccgccggctggcggcgcgggtcgaaatcgaggtcttcgcggtcggctgaccgcatcaaccaggcatgtcgcccgcccagaagcggcagccagcccacatcaggcagatcagggaggagaaaccgatgacggatatcgcaaccggctggcggcggctggccacacggatggcggcgggcgtggcgggcctggtggtggccgcaggcatggccggccaggcggccgcagccgaggtgacgctgcgcctgcaccacttcttcccgcccacctcggcggtccattcgaagtatttcgcggactggaagcagcgggtggagagccagtccggcgggcggatcgaggtcaagatctacccggccatgcagctgggcggcaccccgccctcgctgttcgatcaggcgcgcaccgggcaggccgacatcatctggacggtggtcggctacacccccgaccgcttccccgaggccgaagtcttcgacctgcccttcctgccgcgctcggccgagatcaccagccaggccgcgcatgaattcgccatgaagcacctcaccagccgcttcgaaggcgtgaaggtgatcgcagcccacacccacagccccgggctgatccacacccgcgatcgcgaggtccgcacgcccgaagacatgaaggggctgaagctgcgcgggccgtcgcggctgatcaattccttcatcgaggcgctgggcgccgagccggtcggcatgcccgtgccccagacggccgaggcgctgtcgcgcggcgtgatcgacggcacggttctgcccatggaagggctggatgcgctgcgcctgcaggaactggtccaccgccacatggtgttcgcgggcgagaatgcgctctacaccaccatgatgctggtggcgatgaaccaggcgaaatatgacggcctgcccgccgacctgaagaaggtcatcgacgacaatgccggcatcgccgaggcccgcgcgatcggccgcgtgatggatcaggccgatgcgccggtggtagccgcgatcgaaaagtccacgaccaaccggatcatcgcgctgacgtccgcagaaaccgaccgcttccgcgccgtcggtgccgaggtcgaaaaggcctgggccgagcggatgaccgcccgcggcatcgacggcccggcgctgatcgaggaagccaaggcgctggtggcgaagtacgcagcccagccctgacggggtcccggtcgcgggatccggacttgcaggcggggcggagaagcggcgatgatccgcgtcttcgccccgcctgatgtcgttcaaagaccaccggatccgtcatgcccgccacccgcgccgacctcttcgcccgtctcgatgcccttggcatcgcgcacgagacctatgaccatgcgccggttttcaccgtcgaagaggcggaggccgagaccggccatgtgccggggctgcacgtcaagaacctgtttctgaaggacaagcgcggcgatctctggctggccaccgtcgccgccgaccggcgggtggatctgaaacatctgcaggcgctgctcggcgccggccgcttctcgttcggcaagcccgatctgctgatggaggtactgggcgtcaccccgggctccgtcacgcctttcgcgctgatcaacgatcccgatcgccgggtggtctttgcgctcgaccgccgggtggccgaggcggagcggatcaacgcccatcccctgttcaacgacgcctcgaccgtggtgacgggcgcggggttaaaacgcttcgtgtcgagcttcggccacgacgtacggatcgtcgatctcgacaccccggcctgagcgacgcaccgacctcagcgacgcaccggccggatcgcgtccgaggcgtaatccggcaggggcgccccttgctggagacgcgcgccgtgccatctttcatgctacaagcgggaggccgcggccggccttccgggcgcggcagagtttcgccatcgcgcttcgaaaaaagaacgggaccgttgccatgcagaccatcatcggcggcgccgggggcaccgccccggcggatgtgatcaaggacaccgacaccgcgcatttcatggccgacgtcatcgagacctcgcgtgaaacgccggtcatcgtcgatttctgggcgccctggtgcggcccctgcaagcagctgacccccgtgctcgaaaaggtggtcctggccgccaagggcaaggtgcggctggtcaagatgaacatcgacgagaacccggaactggcgcagcagatgcgcatccagtcgattccggcggtctatgccttcgtgggcggccggccgatcgacgggttcatgggcgccctgcccgaaagccagatccgccagttcgtcgacaaccttctccgcgccggcggcgacgacgaaacccggatgatcgacgaggcactggcccaggcggccgagctgctggaggccggcgatgtgcgcatggccggcggtctttacacccaggttctgcaggccgatccgtcgcgcaccgaggccctggccgggctctcccaggtctatgtgaagatgggtgacctggagaaggcgcgcgaggtactggcccacgcgccggaagagatggcgaaggacccccatctggtccgcgcccgcaccgccatcgacctggccgagaaggcggccggtgccggagagaccgcggcgctggaagccaggctcgccaccgatccggccgatcatgccacccgcatggaactcgccatggcgctctatgccgcaggcgatgccaaggccgcgatcgaccagctgctggagatcgtccgccgcgaccgcgagtggaacgagaatgccgcccgcactcagctgttcgagatcttcgatgcgctgggccccaaggatccggtggcccagagcggccgccgcaagctgacctcgatcctgttcgcctgatccgccgacacgatccgccggatcccggacggggcggtgggcgaccggcgcgcccccgccttccggatcctgcgcccgcaacccgccggccgaccgagcagagcccgaagctgccatgatccgtgcccacgacgtcctgccgccagtgctgccggtcttcccgctcggcggcgtcatcctgctgcccggggggcggctgccgctgaacatcttcgagccgcgctatctggcgatgatcgacgacgcgctgggcagccaccggctgatcggcatggtccagccggtccgcgccgggctcggcaccaatctgggcctcgtctccggtgcgcccgaaatctacggcgtcggctgtgcgggccggatcagcagtttccaggaaagcggcgacggccgctatctgatcacgctgaccggggtcgcccgcttccgcgtggccgaggaactggccgtcaccacgccctatcgccaggtccgcaccgattttgccgccttcgaggccgatcgtggcgaaccgccgccggccgggctggaccgcgccctgctgaccgaccggctgaagcgctatttcgccctgcaggggctgtctgccgactggcaggcgatcgatcaggcctcggaccaggcgctgatcacctcgctcgccatgatctgccccttctcggaggcagagaagcaagccctgctcgaggcaccctccctgccggaacgcgccgccttgatcctcgacatgatggagatggcgttgcataccggagaggacgacgacgacgcgccgcgtcactgaccgcaaggatatatatcccatgtccgacacccccaccgtgccgcccgcctgcgtcgatccgcgcctgctggagattctggtctgcccgctgacccgcgagccgctgcgctatgacgccgccgcccaggagctgatcagcgatgcggcgaagcttgcctatccgatccgcgacggcatcccgatcatgctggtcgacgaagcccgctcgctcgacgacgcggccggagcctgatccgatggccggcgcccatgaacacgagcatgtccatgcccccgcaccggccgccccctggccggtcgagatccgcctgaagcggtcggcgcgggttctggaggtcaccttcgacgacggcaaccatgtccggctgggggcggagtacctgcgcgtggaaagcccctcggctgaagtgcagggccacggccccgggcagaagaaggtgccggccggcaagcgcaatgtggcgatcgtcgacgttcagccggtcggcaactacgccgtgcggctcgtcttcgacgacggccattccaccggcatctatggctggggctatctggcggaactcgcgcgtgagcacgaccggcgctgggaaagctatctcgacgcccttgccgccgccggccagacgcgggactgagcagagccggggctgaacagggggccgacaaaaaaaagtggccgccgcgacggggcatgtcgcgacggccaggcttcgggtgatcgggcccgagctttcttaattctgaaatctgcggcgttgcggttccggctggtctcagcgggcaacccggcggcgacgcgggttgcggctgccggttcccgtgccggtaccggggccgcgataggtgcggccgcgccgcggcgcatcggccgtagcacgcaggccggcaggatagggggccggcgcagccatgcggggcgctgcggagccggagtgggcgtggttgcgcggggggcgaaccatggtcatgggggcattccttgaacatcggcccgacaggatgcacccacccggtccgccatgttgtcagttcgggtgatgattaccagcggtagcaaagcacggccagcccccgatcatggggggcgccctgaaaatgcggccggggacatgcgatcttcccgcaggatgcgtctcagggcatgcgtccctgaaccagggccggcaggcggcccagttcgcccatcgcatggcgcatggccagtttcttcaccggccccagccggttcaccgccgcaagccccagatcgcgtgccaggcgtaccggcgccacatcgttggaaaacagccggttcagcccgtcggtcgccgccaccagcgccatggtgtcggtgcggcgccagcgttcatatgccgcaagcacatccggggcgccgacatcgccgcccaggcgccgcgcctgcaccatcacctcgaccagggccgccacgtcgcggatgcccagattgaagccctgccccgcgatcggatggatggcatgggcggcatcgcccaccagcgccaggcgccggtcgacgaagcgccgcgccagggtcagtgccagcggataggcgaagcgcggaccttccagccggagctgccccagaaaatcgccgaagcgggcccgcagctcttccagatatcgcagatcgtccagcgcctggatgcgggcggcatcctcgtgccgttcggtccacacgatcgacgagcgattgccggccagcggcaggatcgcaaaggggcccggcgtcaggaaacgttcatgggccacaccttcatgcgggtattcatgggccacggtgcagaccaggccggtctggccatagccccattcggtgaccgcgatcccggcctcgtcgcgcagccgtgaccggcggccgtcggccgccaccaccagcggcgcacgcagcacccggccatccgccagggtaacggtcgcccgcgcgccctgccggtcgaccgagaccacgcctgccggggccaccacggtcagccgatcggcaagtgccgcggcacgctgcgccagggcagcccgcatgtggcggttctcgaccagccagcccagcggttcttcccccacctgggcatggtcgaaatgcagatgcatcaagctgggcccgtcggttacccggatatgttcgatcgcgccggtttccgccaccagcggccagacaccgatcgcggccagcacctgcttcgacccatgggcgatggcactggcccggccgtcgaacccgcgatcgagctgcgccgtgggatcttcgcgatcgacgacgatcacgtcgaggccggctgctgcggcggcaacgcccagcgtcataccgaccagcccgccgcccacgatcaccaggtcgcccgccaccatctccatcggcctccgctccgccacgcctgctcggtgatgccgggccggtgagcccggccctgccgcgcaagatcggcccgccggttccgaaagtccagccatgcccgccaattcggtggcgtgaccaggaattgcccaccatcgggtgatctgcacaaaaaacagacaatatgattcgctgcccccgcgtcgcggcgtgcccgatcccgccggattgcccgtccatcgcgcattgcagcgcggaatcccgccaatgacacgaaattggcacgggtcttgaagtgtcacgcccggaccgccggcgcccagggtgccggccgccaggacatcaaggctgcgggggaaaggaacagggcgccatgaagctgatctctgcgatcatcaagcccttcaagctgcaagccgttcgcgaggcgctgaccgatctgggcatccagggcctgaccgtcaccgaggtgaagggatatgggcggcagaagggtcagaccgaaatctatcgcggcgcggagtacgaagtgaatttcgtgccgaagctgaagatcgagatcgccctcaacgacgatctgctggaagcagcggtcgaggcgatccagaccaatgcccagaccggcaagatcggcgacggcaagattttcgtgttcgacctcgaacgtgtggtgcgcatccgcacgggcgaaaccgacaaggacgctctctgagccaacgggaaggagacccaccagagatggcgctgacggccaccaacttccggcgtgccgcccttgcggcgatcgctctcaccctcgttgcggcaccggcgcgggccgaagtcgaccccgaggttcagtatatcctcaacaccttctcgttcatcatcaacggcgccctggtcatgtggatggccgcgggcttcgcgatgctcgaatccggcctggcccggacgaagaacgtcgccaccatcctgctcaagaacatctcgctcttcgccgtggccggcatcaccttctacctcgtcggctacaacctgatgtacatgaacgtcgacggcggctggatcggcagcctggccatctggtcgcagagcgacgccacgggcgacgccatcgtctacgaggccggcacctatgcctcggcgtcggactggttcttccagatggtcttcgtcgccaccgctgcgtcggtcgtgtcgggcaccgtcgcggaacgcagcaagctctggtcgttcctgctcttcgtcgtgctgctgaccaccatcagctatccgatcaccggctcgtgggtctggggcggcggctggctgtccgagatgggcttcgtcgatttcgccggctccaccctggtgcatgcggtcggcggctgggcggccctggtcggcgccatcatcatcggcccgcgcatcggcaagtacagccgtgacggccgggtgaacccgatgcccggctccaacctggcgctggccaccctcggcaccttcgtcctctggctcggctggttcggcttcaacggcggctcgatgctggcgctcggcaccggcgcggatgccaccggcatggccaatgtcgtggccaacaccagcatggcggctgccggcggcatcgtcgccgcgatgatcctctcgcagctcctctacaagaaggtcgacctcaccctggcgctgaacggcgcgctggccggcctggtctcgatcaccgccggccccgacaccccctccgtcggcggggcgatcctgatcggtgcggtcggcggcgtcctcgccagcctgacggtgccgctgctcgacaagctgaagatcgacgacgtggtcggtgccatcccggtgcatctcgtcggcggcatctggggcacgatcgccgtgccgatcaccaatgccgatgccagcttcggcacccagatcgtcggcatcgtcgcgatcggcgccttcaccgcggtgttctcggccgtcgcctggctgctgatcaagttcaccgtcggtgtccgggtctcggaagaggtcgaacatggcgggctggacaaggcggagctgggcctcgaagcctaccccgagttcggccgcgggtcgcagaccctctgacgccaccactcatcgcacacccggctgccccggcagccggtcctgcctgcgacgccccggccttctggtgaaggccggggcgtccgctcttgcggcagagcggtcaggcgccgtaaggtgccccggcacccccgcggcccgcacccaggacgcccccggccaacgcccgggtggcacgaccgacggacggcggtttcggaacgacttcaatcctctggcgtcatccatgctcaatccccggctcgccgcgctcaccgactacccgttccggcgcctggacgcgctgatcgccggcgccgagccgccggacgggatcacccggctgatgatgtcgctgggggagccgcagggtggcgccccggccctgattgccgagatcgtggcggcagaggcggcgggtttcgggaagtatccggccgtggccggcacgccggatctgcgccgggcgatcgccgcctgggccacccgccgctacggcctgcccgacggctttctcgaccccgaaacctcggtcctggccgcggccggcacccgcgaggcgctgttcgctacccttcaggcggtgacacccgaggtgaaggacggcgtgcgcccggtggtgctgatgcccaaccccttctaccaggtctatgccggcggggcggtgatggcgggggccgagccggtcttcgtgccggcgaccgcagagaccggcttccagccggatctggcggcggtctcgcccgatctctggcggcgcgcctcggccgccatcgtctgctcccccgccaacccgcagggcacggtgctgagcgaggcggcgatgctggatctgatccgcctggcgcgtgcgcatgacgcggtgctgatcgccgatgaatgctattccgaaatctgggtcgaaaccccgcccccgggcctgctggaagtggcggcgaaacatgggctgggcctcgacaatctgctggtcatgaattcgctgtccaagcgctcgggcgcgccggggttgcgcgccggcttcatcgccggcgatccgaagctgatcgccggcctgctgcgcatgcgcacctattcgaccggcttcctgtcgccgccgctgatggccgccgccaccgcactctgggccgacgaggcccatgtcgagatcaaccgcacccgctatcgagcctcgatggccgcggccgagcggatcctgggcccggccttcggctggaccatgccggccggcggcttcttcgcctgggccgatgtgggcgatggcgaggcggccgcgcgccggctgtgggccgaggccggtgtcaaggtcctgcccggcgcctatctttcccgcgagggcgatccggcccatggcttcgcccccgacaatcccggcgcccgctatgtccgcatcgcgctggtccacgcaccggatgtcgtcgaggaggggctgacccgcatcgcccgcaccctcgccggctgaccgccgccgccttccgccaccgtcccgctccctcgtggacatcccgtcttccagacacgatcagccgagacccatggccgcacgctcgaccggaaccgatcggacgacccgcttcctgcccgccggggctgccggccttgcccagcgcctgacccgcgccgccggcgggctggtcctggcggtgatcgcgatctgcctgatcctggccctggcgagctatgaccagaacgatccgtcgctgaaccacacggcggaattccccatcgtcgccaatgtgatgggcatggccggcgcctattttgccgacatgtccctgcaggcgctgggtctgggggcggtgatcctgccgatggtgatgctcggctggtcatggcggctgatgcgcggccgcggcctgccgatgctgtggctgaacctgaccgtgctgcccgtcgccctggtcgcgaccgcgggccttgcggccgcctttggccggccggaaggctggccgctggaaagcgggctcggcggggtggtgggcatgctgctctatgcccggctcaccgccgtcaccggcgtcggcccctatctcgtcatcaccctggggctggcgctcggcggcatgctggcggcggccggcatggggctgggcgactggcgcagcatcggccggggcatcggctccgccggcggcctggccggccggggcggcagccggctggccggcctgttgcggcggcgccatgctgcggcagacgacacaccagaggcccgcgggcgccccgcgcgcggtcaggccgcccgccggaccgccgagccgcggttcgacgacgatgcagcaccggtcgccgccccgccccggcgccgtgccccagaacccgccgaggccccggccgccggcggtccgcggatcggcgcgccccggcgcaatgtcgaggcggccgccgccgaggcccgccgccgcaacccgctcaacctggacgaggcgtccaactaccggctgccggccctggatctgctggcgctggcgccgcgcggcggcaccggcagccaggatcccgggcttctggccgaacaggcccgggcgctggaaggcgtgctcgacgatttcggcgtcaagggccgcatcgtcgaggtccgccccggcccggtggtcacgctgttcgagctggaaccggcgcccggcatcaaatcgtcgcgcgtgatcagcctggccgacgacatcgcccgctcgatgagcgcgatatcggcccgcgtcgcggtcattccggggcgcaacgccatcggtatcgagctgcccaacccgaagcgcgagatggtcttcctccgcgagctgctggcgagcgaggcctacgaggtcaccgcctcgcggctggcgctggcgctcggcaaggatatcggcggcgcgccggtgatcgccgatcttgcccgcatgccccatcttctggtcgccggcaccaccggctcgggcaagtcggtcgcgatcaacaccatgatcctgtcgctgctctaccggctgtcgcccgaccagtgcaagttcatcatgatcgaccccaaaatgctggagctgtcggtctatgagggcatcccgcatctgctggcaccggtggtgaccgagccgggcaaggcggtggtggcgctgaaatgggcggtgcgcgagatggaaggccgctaccgtgccatgtcgaacctgggcgtgcgcaatatcggcggctacaacaagcgcgtcgccgaggcccgcgacgccggcgagatcctgacccgcaccgttcagaccggcttcgaccccgaaaccggcaagccgatcttcgaggaacagaccctcgagaccgagcccatgccttatatcgtggtcgtggtcgacgagatggccgatctgatgctggtggccggcaaggacatcgaagcggcgatccagcgcctggcccagatggcccgtgccgccggcatccatctgatcatggccacccagcgcccctcggtcgacgtgatcaccggcacgatcaaggccaatttccccacccgcatctctttccaggtcaccagcaagatcgacagtcgcaccattctgggcgagcagggtgccgagcagctgctgggccagggcgacatgctgcacatggaaggcggcggacggatcacccgcgtccacggccccttcgtctcggatgaagaggtggagaaggtggtccgggctcttaaagaacagggtgcgcccacctacatcgaagcggtgaccgacgatccggagcttgcctccggcagcaccgccgacatcatacagggtggtggggccggaggcggcggtggcgaggacgatctctacgatcaagcccttgccgtcgtgcttcgcgagcgccgggcctcgaccagcttcatccagcgccacctgcagatcggctacaaccgggcggcgcggctgatcgagcgcatggagaacgaaggcgtcgtcagccgcgccgatcgcaccggccgccgggaggtactgctcggcgagccccgcgacgactgagcgccgatacgaggagtttccccccatgtcccttcgcctgtcaggcacccttcgccgtgccgctttcgctgcgggtgccctcgcggtgatcgccacggccctgcccgaggccgccctcgcgcagcagaagccggctgccgctcctgcgaaggcacccaatgtcgccgcggctgaagcccgacgcgacatggaccgcgccgaagcctatctgaacggcttccggcgtatgaaggcgcatttcacccaggtcgcagccgatggctcgacctcggaaggcaccttctacctgtcccggccgggccggctgagggtcgattacgatccgccggtcgatcagcttctggtcgccaacggatcgcaactgatccattacgaccgcaagctcgatcagccctcctacatcccgctcagccagacgcccgccgggctgctgacccgcgagactttcgatttcgatgatccgctgctcgaattcgccggctacgagcgcgatgccaatgcctttgcgatcacgcttcgcgacgccaagaacccggatctgggctcgctcgccctggtcttcaccgacaacccggtgcaactgcgccagtgggtggtgaccgatccgcagcgcggcgtcacccgggtgacgctcagcgatgtgaagctggatccgacgctggacagcgacctcttcgtcttcaatcgcttcgccccgaagaagtgacgaggcccgggaagtgatggtcctgtgaccgaggccggctccgcggtcgacagccgtgcgatctggcggatcgccgggccgatgatcctgtccaacctgtcggtcgcggccttaggcgccgtcgataccggcgtcgccggccatctgggctcggcgggcagcctggccgccgcggcgatcggcggccagctgctgtcgtatttcgtctggtgctgcggcttcctgcgcatgggcaccaccgggctttccgccggcgcggccggccggggcgaccgcccggaaggtgccgccgtactgggccgcgggctggcgctggcactcgggctctccgctctgctcggcctgggacttaccgtcaccctgccctggctgctcgccctgttcggcccggcgcccgcggtcagggacctggcggccggctatgtcctgatccgcctggccggcctgccggccgccctggccgtgctggtgctggtcggctggttcgtcggccggggagaggcagggttgccgctcgccatgatcctggcgactaatctggtcaatgccgggctcgacctgttgctggccctgaatctgggcctcggcctcgacgggctggcgatcgcgagtgccgtggcggactggaccggctgtctgatcggccttgcggccgcgcttcgcaccctgacccgcgagcgcacgccccgccccggcagacgggccctgggcgactggccggccatcgcccgcatggcccggatcaatggcgacatcttcgtccgcaccctgctgctgatcggcggcttcgccctgttcatgagcctggccggccggctcggcaccacccagcttgccgccaccgccctgctgctcaccttcttcagcatggcctcgcaggggctggacgggatggcctatgcggccgaatctcttgccggacgcgcccttgccgccggcgatctggcgggcttcgaccgggccgtgcgcatgaccgggatctggaccgcggcgctgggcgtgctggcggctctggtcttcgccctcgccggcccgctgctgatccaaaccctcaccgatctcgacgaggtccggcgggtggccggcgatcttctgccctatgtcgtcgccctgccgcttatcgcctgggcctgcttctggctggacggggtgttcatcggcgtcacctggtcgggcgccatgcgcgatgcaatgctcatcgccttcgcgatacatcttggaccggcgctggttctgcccgatatgatgggggcggacgggttgtggatcgccttcctcggcctgttcgcggcgcgtggcctggcgatggccggctggtatctggcccgtcggcgtcgcctctcgccccagcctcaacgatccagcatctgagcacgccacctcgcggcctgtcgcagcggccgcaccagccatcggagccgatcgccttgtcgagcgcgcccatctcctccggccgccggccggtcatcgccgtcaccgcctgcatcaagctggtcgagggcagcccctcccatgcggcgggcatgaaatacgtcgaagccgcggcggatggtgccggcggcatgccgctgatcgtgccggcgctgggctccggcatcgacatcgatcaggtgctggatctggtcgacggcgtgctggtcacgggcagcacctcgaacgtcgcgcccgagatctatggcggcccggcgccccggcccggcaacaagggcgatccggcgcgcgatgccaccaccctgccgctgatccgcgccgcgatcgagcgcgacatgccgctgctcgccatctgccgcggccatcaggaactgaacgtcgccctgggcggcagcctgcaccagcatgtccacgaagtgccgggcatgatggatcatcgcgacgatgccagcctgccctgggaagagcgcttcggccatgcccatccggtgatgcccgaagccggcggcctgctcgcccggatccagggcggtgtcgcccccttcctggtcaactccctgcaccaccaggcgatcgaccggctggccccggggctgcgcgtcgaagcccgggccgaggacggtctggtcgaggcgatttcgatccccggccgccgcttcgtcctgggcgtgcagtggcatcccgaggccctgtggcggatcgatcccgcccatgacgccatcctcaaggcgttcggagaggccgcccgcgcatgggctgcccgcgccgaagccgccgcctgaccccctgccggataccctgcctcatgccccgcctgcccgacgatttcgacgacgacgacgaccgtttcgaccccgatcacccgctggcggatcagccggcactggcggcggtcgcccgcttcgcccgcatgctcgagaccatcccctggttctcgcgcgtcggcgaccggctggacgccgacgaccgggctgcggccgaagactacctgtcggcgctgggcttccccggcgccgcggtggtcccggtcggcgactggtacgaggcggcggactgcgccgaggcactggacatgcactccctgtcctgggaggaggaggagcatctccgcgcggtcgcccatgaaaccgcgctcgagatcaccgatgaagaggcgctcgacgtggcgctctctcatgtcgcccatcaggccgcctctctggtcggcccggccgccgtgctgtcgatgcgggtcggcggtctggacgacgaggcgctggcccgggctgccgccggccatgcggttcaggcctgccatcaggcggccctggtcctggcggcggggctgggggccgagcatcccttcgcgctcaaattccggctctacgaacgggggcgctggccggtctcgatcacgggagaaagcttcaatctgttctgaatttatagatctgcgtatgccgattgccggaaggtggcatggcggagatcgccgtgtcactggcgccagttcgcgccatcggttcaaatggtggggtcgggcctgaattcgaaacatccaaccacgggtccgaccagccgaaaggggtccggcccgtatggatgcaatcatcgattttctcaacaccctgctctggagctatgtgctgatctacggcctgctgggggtgggcatctacttcaccctccgcctgcgcttcgtccagatcctgcattttcccgagatgatccgggcggtgatcggctcaggggataacgaccgctcgggcatctcgcccttccaggcgctgtgcaccagccttgcctctcgcgtcggtaccggcaatctggccggtgtggccgtggcgctgtatctgggcgggccgggcgcgatcttctggatgtgggtggtggcggcgatcggcatggccaccgcctatgccgaaagcagcctcgcccagctctacaaggttcgcgacggtcatcgccagtatcgcggcggcccggccttctacatggccaagggactgaaggcgccctgggcgggctggctgttctcgatcttcctgatcctgaccttcggcctggtgttcaatgcggtgcaggcgaattccatcgccgaggccggcgaggcggccttcggcctgggtaagatctggatcggcctcgccatcgccgtgctgaccgcgatcgtcatcttcggcggcatccgccagatcgcccgggtggcggagctggtggtgccgttcatggcggtgatctatctggccgtggcactctatgtcatcgtggtcaacatcagcgaagtgccggccgcgatcggcatgatcctgcgcagcgccttcggtatcgagcaggcggccggcggcatcgtcggcggcatggcggccgccatgctcaacggcgtgaagcggggcctgttctcgaacgaggccggcatgggctcggcgccgaacatcgccgccgccgcaacacccgatccgcaccacccctcctcgcagggcttcgtgcagtcgctgggcgtgttcatcgacaccctgctgatctgcaccgcgaccgcgatcatgatcctgctgtccgaccggctggtgcccggctcgggcgtcaccggcacccagctcacccaggaagcgctgaccgcccatatcggcgatgccggtgcctggttcgtggcggtggcgatctttttcttcgccttcacctcgatcatcggcaactacgcctatgccgagaacgccctggtcttcgtgaaggccgacagcgccatcggcatcaccatcctgcgctgcggcactctcgccatggtgctctggggcagctatgagagcgtctcgaccgtgttcaacgcggccgatacttccatgggcctgatggccgtgatcaatctggtcgccatcgtcctgctttcgggcacggtcgcgaagctcacccgcgactatctggaacagcgtcgtggcggccagatcccggtcttccacgccgccgattatcccgaactcgcaggcgagatcgacgaggacatctggagccgctgatcgggcggagacgggtgatcgggcggacatggggcaaaggaaaggccggcttccttcggggaagccggcccttctgccgtcggatctgtcaggccaggaacccggatcaggccggggcgtgcgcccggatgaaggcggcgatgcgcggcttcacctgttcgcgccagcggcggccgttgaagatgccgtagtggccgacgcccgcctgctcgtaatgggcgtgcatgtgctccggcaacctgtcgcacagcttgtgcgacgcccgggtctgaccgatgcccgagatgtcgtccaactcgccttcgaccgtcatcaccgcggtccgggtgatggccgaggggtcgaccagcttgccatgcacgaccatctcgcgcttgggcagcagatggcgctggaacacacggtcgatggtctcgatgtagtattccgccggcaggtccatgaccgacagatattcgtcgtagaacgaccggtgcgactcggcgctgtcaccgtcgccgcggaccagatgctcgtagagcttcacatgggcgccgatatggcgctccaggttcatggtcatgaagccggtcagctgcacgaaacccggatagacccggcgcatcacgcccggatagatgcccggcaccgagtggatgacattgtcttcgaaccacttcagcggccgggtcatggccagctggttgacctgggtcgggctctcgcgggtgtcgatcgggccgcccatcagggtcatggtggcgggcgcgcacggatcgtcggccgcattcatcagcgacactgccgccatcaccggcaccgacggctgacagaccgccatcacattggtgccggggcccagcagatgcaggaattcgatgacgtattcgacataatcgtcgaaatggaagggcccgtcgaagaccggcaccatccgggcatcgacccagtcggtgatgtagacgtcgtggtcgggcagcagggcctcgaccgtgccacgcagcagcgtggcgtaatgccctgacagcggcgccaccagcagcagcttcgggtcgttcagaccctcggtatcgcggcggaaatgcagcagtttgcagaaggtgagatcgtggacgatctcctcgacgaccggcacggtgcggccgtcgatgatggtgtggtcaagcccgaaggcgggtttctcgtagcggtcggtgacgcgctcgatcacctcggccgcggccgcaaccatgcgaccatagggcgagtacgacatcggattgaacggcgaactgtggatgcgctgcgcggccttcgccatcagacggatgggcgtcacggtcgcggcatgcagttcgtggagctggtaaagcatgacccctcacgcgctgtccggcggaactggggaagccgccggctgcggcggcatcgtccacctccctcgtggccgatgccgtctgtcactgtcgatctttgatacggccggcaccattcgcgggcgccggctcggtcggtcgaggctggttcggtcttcggtccgggctttgcatccgttgcgcagagggccagaaaggcccgttcgcgcgcttccggagagcgcccgtgttaaacatctgtttcaattaggcattatccgccgaaaaagtaaacgagttccgaagacgttgccgaaaatccacgacaacgacccgaaacggtcacccggcagacctggatgcgctgcaaaatgcagcaaggtgccatcaaagacgctgtttgatcgccgccacgatcgtatcgggcgtgtccccgcgattgaaatgggtgagataggccccctcgcggtccatcagatagatgaaggcgctgtggtcgacgagatagtcggtggcgctggcgtcgtcgcgcaccgcctgataatagacgcgatattccttggccgccgccgcaatggcctcgggcgttccggtcaggccggtgatgtgatcattgaacaggctgaggtaacgcgccatctgatcggtggtatcacgctcaggatcgacggtgatgaacaccggcgccaccttgtcggcatccgggcccagcatctccatgaccgctgaaatcttctgaaggtcggtggggcagacgtccgggcagaaggtgtagccgaaatagaccagcatcagccggccacggaaatcctggtcggtgaccggcttgccggtctgatcgttgagcgcgaagggcccgccgatcagggcccggcccgaggaaacgccgccggcgcgatccgccgacatttccacccagcgcagcgccagtacaccaccgatcgcgaccaccgcggcgatcgcgatgacggccagaatggacgggcggcggggggccttcttcgacatgatgttcacaatccgcggggaaggccggcaaggctggaaggccaccggtcgggaagtgccgaggggcgcccggtgagggagaccggagagccccgacgggaccaccgccgggaccaggggtcggggccggcgatggagacgtctccaccccatagcagtcggggccgggagccgcaaccgccgcatctgcgaccgatcgtcgctcgccatcctcccactgacgattgaccctcccctgccgccaccgcacactccggcgatcttccgtccttttcgccccggggggtctgtttccatgcccgcggacacgctgtccctcgctgccatcatcggtccggtcttcgcgcccgatcccggccttctgctgctggtggtcgcggttctcgacggcttcatcggtgacccgcccggactctgggcgcgcatcccccatccggtggcggtgatcggccgggcgatttcagcactcgaccgccggctgaaccgcccggagcgcagcgaagcggagcgggtgcgccgcggcgcgctgaccgtggtcctggtggcgggcggcacggcgctcatcgcctgggccctgtcggggctgctgcgcagcctccccttcggctgggtcggcgaggcgctgatcgccatgaccctcgtcgcgcagaagagcctgtacgaacatgtccgcgacgtggccgatgcgcttgcccgcgacgggctcgccaccggccggcgcatggtcgcccgcatcgtcggccgtgaccctgaaagcctcgacgaggccggggtgtcgcgggccgcgatcgagagtctggccgagaatttttccgacggggtggtggcgccgctgttctggttcgccgtggcggggctgcccggtatcgccgcctataaggcgatcaacaccatggacagcatgatcggtcatatgaccccgcgccatgccgccttcggccgggtcgcggcgcggctggacgatctggtcaactggccggccgcccggatcgccggcgggctgattgctcttgccgccgccctgcccggaccaggagatgccggcgaggcgatggccgccatgcgccgcgacgcccgccgccaccggtccccaaatgccggctggccggaagcggcgatggccggcgccctggggcttcggcttgccggcccgcgccgctatggcaaccgggtggtggacgatgcctggatgggccgcggcgacacggaagcgggcccggccgatatcgaccgggccctcaccctgtatctgcgtgcctgcatggccggtgcgccgttgctggccctgctcaccaccctgctcgactaggccatcctgctcgaccgggccatcctgctcgaccagggggcggcctgccggctcagcggcccgagagcgtgctcttcagcgtgtcggccttgccgtccgaaacattggtgcgcaggatgttctccgccgtcagcgactggccgtaataggcgcggttccagtcctcttcgggcacgatcacggtgccgtcgagcgaggcgccgccgaacaggcccttggcgttggagaaggcgacgatgtcggcatccatattggtcgtggtgctgccctcgacgccggcaccgacggtcgccaccgcgatcgagacgtcaccgcccagcgaaaccttgtcggagagcagcttctgcaggccgcgctcggtgcgcacgaccagcaccgtctccgacacctgcacgccggcctgcaggccgatgccgcccttggcgatgtcgtaaaagaccgggccgcgccagccgcccgaatcgcgggccatcagcacgccgacgccgccctcgccgccgatgatgaagccggccttgaccaggctcggggcgatcagcacggcccgcgcgcttttcagctgggcctcgaaatccttgccctggggtgaattgcggatcgcttcgaccgtggcggcggccttggagaccgtctcctgctgatcgttggcataggcgggcgccacgatcgccagcggcgccatggcagccatggtggcgacggtcagcgcaagcgggcggcggtcgttgaggcgcatgcggaacatggggaaaactcctcggcgggtgcgtatccgacggcagcggcggggagcctgcgggctccgcctgatctgtgaagccccgatccctgaagccacagcggcggggatcggttccgtgccgtcctcttccccgctgttatgccatgaccggctgtgacaggggtgcgatcaagatgcgacctctccggcaccgaaagaaggccctttcagcaccagcggcaggcccgccgccacaaagatcacccggtcggccgcggccgccacctgctggttcatccgtcccgcaacatcacgaaaccgccgcgccagcgcattgtccggcacgatgcccagcccgacttcattcgccaccatcaccaccggccggcccagatcgcgggcggccgccacgagacgtgccgtctcggtatccggatcccgctccagatgcatcagggtcgccgcccagatcgtcagacagtcgagcagaaccgcccccgcgtccgcagccgccgcaatcgccgccgccgggtcggccggggcttcgaccgtcctccagccaggcccacgatccgcgcgatggcgggcgatgcggtcccgcatctcgtcgtcgaaggcttcggccgtggcgacatagagcggcggcgcgtttcccgctgcggacagcgtcagccgctcggccagcgcgctcttgcccgagcgggccccgcccagaaccagggtcagcatggctcgtcttctcctgtcggcagcggccggttcaccgtctccacccgccagagcaccgcgccgtcatccatctggatccggtcgatccgggtgagcgacagcggatcgaccacgaaggagatgctctgctcgggcgtcagccccagcgcctgggcaagggcggcccgcaccaccccggcatgggccaccaccaccacgggtcgcgtgtcggcctcggcagagatccggtcgacggtcgcggcgacccgggcgatcacatcagcatagcgttcgcccccgggcgggcgggcgcgggcaggctggcgccagaaggcggcataggcctcgggctccgccgcctcgatctcggcatgcacgcggccctcccagaggccgaaatcctgctcgatgaagcccggctcgatctgcgccgtcaggtcgggccggagcacggatgcggtgtcgcgggcacgggcaagcgggctcgccaccagcagcatcccctcgggcagggcgcgcgcgatccgtgccgcccgcatcggcgccggcaggtcgaccggcgcctcgcccgcgccatggatgcgcccgagggccgatgccgcaagcggggcatgcctcaaccagtaccagcgggtcacggccaccacagcaagcctccataggccaggagcagcgcgccgatttcggccacctgctgaagtgcaccataaacatcgcccgtggcaccaccgatctggcgaagcgccaggcgcaggatcaccagcgcgccgatcgccgcaccggccaaaagccccagcaccgccggcagggcctggagatcgagcacccaccagccaaacccggcggtgatcagcagggttgcgaccagaccggtaagggctgcggccgcggggccgcggcccgccgcatcggcaaggcccggccggtcccgccgggcgggtggcatccaggccatggcaaggccgatggcggcgcgggacagcccgcctgcccccgcggccagcacggccgccccgaggcccagcggagccagcgccgcatagagcgccgcgcgcaagccgaagcccaggatcagcgccccggcgccgaaggtgccgacacggctgtccttcatgatctccagcttcgccgcccggtcgcggccgccgccgaaaccgtcggcgacatcggcaaggccgtcctcgtggatcagcccgccgatcagcgccgcggcgatcagggccagcagggccgcgatccagcgatcggcgaaaacctctgccgcccccgccagcaccagcccggcaagcccgcctgcgatcagcccggccggccccagccagccggcaaagcgcgcggccggctgcagaccatgcggcgccggaaccggcagacgggtcaccagccccagcgccagccacaacccgtcgagcggtcgtgccggcggcggcgcagggggtggcgggggtggcgccggcggcaggacgggcagcggatcggtcatgagcctgcgaggtcggttgcggaacggggaactcgcccgaagatagcggcagcccggccacccgaccagtctgcggctcgtcagcgacgccagaaggcttgaccggaggggccgggcgcgcaatcgttccggccatcgcgtcccggtatcgttcgggacgaccgtccgcatcgaccggccgcgacgcccctgagggcgccggcggcccgcgcctcaggaggccccgagccgtggcagccgaccattccgccatcccgttcacggatctcgccggcgtcgccgagctggtccgcgcctttcccggccccgacgaggaagcgatggagcgcgcccgcgcccgcgacgcggaactgaccaagccacgcggagcgctcggccggctggaagagctggcgatctggaccgccgcctggcaggccgcccatccgccccgggccgcccggccgctcgcctgcgtcttcgcgggcaatcacggcatcgccgaacggggcgtctcggcctatcccgcctcggtcaccgggcagatggtggcgaatttcgtcgaaggcggggcggcggtgaaccagctctgccgctcgttcggggcggggctgtcggtctatgagatgggcctcgaccagccgacggcggatttcacccgcggcccggcgctggaggatgccgaggtgctgcgcgccatcgccttcggcatgcgggcggtggagcccggcatcgacatcctttgcctgggggagatgggcatcggcaacaccaccgccggctcggccatcgccgccgctctcttcggcggcatgggcgccgattgggccggtcgcggcaccggcgtcgacgacgccggcctcgcccgcaagatcgcggtcatcgacgaggctctgggcttccatggcccggcccttgccgacccgctccaggttctccgccggctcggcggtcacgaactggcggccatcgtcggggcggtgatcgcggcccgcatgctccgtgtgccggtgctgctcgacggcttcacctgcaccgccgccgcagcggtgctctggaagctcgatcccaccgccctcgaccattgccgcatcgcccatctctcacgcgaacccggccatcagcgcctggccgccgccatcggccagcggccgctgctcgatctcgatatggcactcggcgaggcgtcgggcgcggtgctggcctcggccctggtccaggcggccatcgccacccataacgggatggccacctttgccgaggccggcgtcgcgaccgccgcagactgaggcccggcgtcgattttttgcactgcgatgtgcgttaacgactcttaaacaattgaacccttatgctacagagtgcgtccgaattggcggatgcaccctgcgccggtgatgccggcgccgcgtatgcagcagagttgtcggaggggtcgcgtggaatacgcggagcagaccgatcggtcggaatcccacgcacaggctgccctcggacttctcaaatcccacgcagttgcgccaaatccgatcaattatacggtggcctatgtccacgaggccggtcgcgatccggaactgagccgggcgatcgacgggctgttgaccgatggcgggcagctgaccccggatttcctgcgggaagccttcgagcggcatttcggaatggcccgcgaggcccaggcggtccgcgaaggtggtgcccggcttgcagcagaggcggaacgcgcgctcagcgccgcagaaggcgcccgttcggctctcgatacggccgccgacgaggcccagcgcctggctgaccggctggagcagggcgacacgatcgacccccgccgcctggccgaggcggcccgggggctggcgctgttggcccggcgcacggcccagcggaccgagggcgcggtgcgttcgctcgatgccgccaccgatcagatcggcggtgtccgccgcgatctggacaaggtccggcgcgaactcgccaccgatccgctcaccggtcttgccaaccgccggcatttcgagctgcgcctgggcgaggagatcgcactggcccgcgagaccggcgacccgctgaccgtcatgctggtcgatgtcgaaggcttcgacgccatcgccgccgcccatgggcccggcatcggcgaccaggtgttgcggctggtgggcaagacgctcgccgacggtgtgcgcggacgtgacgtcgccgcccgcttcggtgcccagcgcttcgccgttgccctgccccacaccaccgaaagtgaatccggggccatcgccgagcagatccgcaacatcgtctcgggccggcggatcgtgcgtcgcgacaaccgggaagcggtgggccggatcgcgctctcggtctcgcgcgcgaccctgcagccgggcgaggatatcggccggctgatcgcccgcgccgaggcaggtctggacggccgccgcacccgcagcgcccgctgatccgaccccggccgggccaccatcgcctgacccacgcccatccacgccccgcggaactttttcgcggggcgtcgttttgcactgatccgctcagcgccggtccgcgtatctctcggacaaaggaaccaatggcctgaaaggccggtccatgaccgatgagacctgcatccgtccgcgccttgcggcgcggaaaggagtcctgttagatggcgccatgagcacggtgagtggtcgtggcggcccgtccgacggatcgcgcacggtatctgaacgcatggccgatctgatggtcctggtcgcacacgaccgggatcgtcgggcattcgccgagctgtatgcgtggttcgcgccccgtgtgaagggtttcctgatccggcgcggcctcgatgcccagcgggctgaagaagtcacccaggaagccatgctgaccgtctggcgcaaggccgaccggttcgaccggcgccaggcatccgtggcgacctggatcttcaccatcgcccgcaaccgcagcatcgacgaattgcgccgcgagaagcggccggagatcgagctggacgacccgaccctggtcggggacggcctggcccagccggccgaaactgcctatgccgccggccaggaggccgaacggctgaaggcggccatcggaaccctgcccgaggagcaggcccgcctgctgcatatggcgttcttcgaggacaagtcccacagcgccattgcagagagcgaagaccttcccctcggtacggtcaagtcacggttgagactggcgctgtccaaactcagggcggcgctggggccggtacactgatggagcatcacgagacgatgggtccgcagcaccacatgccggaggcgtggctggtcgattacgcggccggcacgctggacgaggcgaacgccctgctggtcgcctgccatgccgccctgtgcccgacctgccgcgagacgctgcgcctgctcgacgcgacgggcggggccctgctcgaggatcaggcaccggtcgcactggcggatgacgcgctggccacactctttgcccggatcgatgccgaggatgccgcggccgagccggcgcggcccggtcaccggcccggtcaccagactgtggatctggacgccctgctgccggcaggcgacggtacgctgcgcctgccgaggccattgctcgcctatctgcccaccgcaccccaggatctgccctggcgctggaacggtcccggcgtccatgtcatcgaccttgcggtcggccggcatccgggcacccgtaccgtgctgatgaagatcggcgccggtcgcgccatgccccagcatacccacaagggcaccgaggcattgatggtcctggccggcggctatcgcgacgagagcggcgacttcttccccggcgatgtcgcgatctccaccggtgaggtggatcatcgccccatcgcccatgacgacggcgaatgtctgtgccttgcggtgctcgacgccccgatctcgctgaccggcaccgtcggccggctgctcaaccccttcatccgcttctgagcgccaccccgaagccttgaactgcggggattgcggcatcatcctgaccgccggacgcacagtggaggcggagagggtgatgatgagcgatccggttctggtcgaagtggtccgcggcggcttcgtcgaaagccgccatcgcggcgctgtcgtggtgtgcgatgcacggggccgtgtgatcctggcgctgggcgatggcgaccggccggtttttccccgctctgccaccaagccgatccaggccctgcagctgatcgaaagcggcgcggccgatgcgatggggttgagcgcggcggaactggccctctctcaggccagccataacggtgagccgatgcatgtcggccgggtgtcggcctggctggatcgtatggggctcggcaccgaggacctgatctgcggtgcccactggtcgtcgcacgacgcaaccgcccgcgccatggcgcgcgacggcggcgcgccctcccgcgcccacaacaactgctccggcaagcattgcggcttcctggccaccgcccgccatctgggcgaggccatcaccggctatggagatcgcgaccacccggtacagcggcgctggcgggatgccctgtcggagctgggcgatcatccgctggatgatgcgcccgaagggatcgacggctgcggcatcccggtcatcgccatgccgcttcggtccctcgcgctcgccttcgcccgcattgccgacccctcgcgcgaaaccgccgcccggcgcgatgccatggcccggttgagccgggccgtctggtcggcgcccgagatgatcgccggcacaggccggctctgttccgccatcgcccgtcaggccgagggccgggtgctggccaaggtcggcgccgaaggcgtctatgccgcagccctgcccggcctgggtctcggggtggcgctcaaggtcgaggacggggcggtcagggccgccgaaaccgccctgctggccacgctggcccggctcggcgtgttcgatgccgccgatctggatgcgctcgccccctggagccggcgcggcatcaccagctgggccggtgccgaggtcggcgtgatccggccatcggacgcctttggctgaaacgagacaaggccggcaccgcgggatgcgatgccggccttgtcagtcgtcaggcagatcgtccggtcaggcgagatcgtccagtcaggcgagaccgggcgccaccttgaattcggcctcggtacgggccttgacctcgtcgaccgtcaggcccggggccagctcgatcagggtcagaccgtcttcgaagctgaacacgccgacctcgctgatcagcaggtcgacgcaggccttgccggtcagcggcaggctgcattccttgaccagcttggccgacccgtccttggcattgtggtccatgatgaccaccacgcgctgaacgccggccaccaggtccatggcgccgcccatgcccttgaccatcttgcccgggatcatccagttggcgagatcgccggtctcggagacctgcagcgcgcccaggatcgacaggttgatatggccgccacgcaccatggcgaagctggtcgcactgtcgaaatagctggaataggacagttcggtgatcgtctgcttgccggcattgatcaggtcggggtcgacctcgtcgtcataggggaagggccccatgccgagcatgccgttctcggaatgcagcaccacatgcacgccgtcggggatgtagttcgcgaccagcgtcgggatgccgatgccgagattggcgtagaagccgtccttcagctccttcgccgcgcgacggcacatgtcttcgcgagtccaggccatggtcacgcctccccacgggcacgagtggtgcgctgctcgatgcgcttctcgtaattgctgccggccaggatccgctggacgaagatgccgggggtatggatcgcgtcggcgcccagggcacccggctcgaccagttcctcgacctcggccacggtcaccttgcccgcggtcgccatcatcggattgaagttccgggcggtcatccgatagaccagattgccttcggtatcgcccttccaggccttcacgatcgacagatcggcgaccaggccgcgctccatgacgtactgctcgccatcgaactcgcggacttccttgccgtcggcgacgatggtgccgacgccggtcttggtgaagaaggccgggataccggcaccgccggcgcggatgcgctcggccagcgtgccctgcgggttgaactcaagctccagctcgcccgcgaggtactgcttctcgaaggtcttgttctcgcccacataggacgagaccatcttccgcacctgccgggtctcgagcaggatgccgaggccgaagccgtcgacgcccgcattgttcgagatgacagtcaggtcgcgaacgccggactcgcggatcgcaaggatcaggttttccggaatgccgcacagtccgaagccgccggacatgatggtcatgccgtccctgagcaggccggcgagcgccgccaccgcgtcagggtagactttcttgctcatgcataccgccttttctcgcgagggtttccccccgatgatacccccggtccccgtttgataagcggcggggccgacgctgtcaatgagcgccgcccctggccggggcgaaaccgcgggtatccggcaagtgcttggcccgccgggctttgggcgtccggctgtcgggatcgcgggccgcatccatacggcgttcgccgccgcctgcattccggccatgcgcaagcggggatccgcagaccattggcatcgccgccgatcgggggtctattgtctcgtcacccgccgcgatccgcccgtcaggttccccagatgcccgtccgtcctgtcccgtccgccccggtcgatccgggccgcgccctgatcgtgggcgggctctggatgaccgccgcctgcggcatgctggccctgcttgcggccgagatccgcatggcggcccagcatgtccacccgctggaggtggtgttcttccgcaacctgttcggcgtggtgctgatggtgcccatgctgcgccggctgccgctgccctatgatttccggcggcgctggacgctgttcgggctgcgcggactgaccagcttcctggcgatgtccacctggttctttgccgtggcgaccatcccgctcgccgatgcggtggcgctgaacttcaccctgccgctctttgcaaccctgctcgccgtcatcaccctgggcgaaacggtgcgggcccggcgctggaccgcgctggcggtgggtttcgccggcacgctggtggtgctgcgccccggctttaccgaggtgtcggccggcaccatcgccgcgctcgcctcggcactgttcatggcctcgtcggcgatctcgatccggcgcatggccgcccatgacgggccggcggtgatcaccttctggtccaatatcgtgatgacgccgatctcgctgatcccggccgccttcgtctggacctggccgggctgggaaggctgggcctggctgcttctggtgggcgccaccgccatcatcgcccagatcttcctgtcccgtgcctatgccgccgcccccacctcggcggtgatgccgttcgacttcacccgcctgccctttgcggtgctgatcggccttgccttcttcgacgaggtaccggacccctggaccttggtcggcgcaaccgtcatcatcggctcggccgtctacatcacccgccgcgaggcgcggctggccagccggcccacggccgggcagatcacgacggcaccacagcccgaccgccccgaaatcacgtccgaggacaaatgaccgaccgtgagacaagccgccccgccctcgccaccattctcgccgtcaatcagcgtgaggcggtggagcgcgtggaagccggcgacggccggccgctctggcggctgatctggttcggtgcctcgcgcatcggcatgggggacgccgggctcgaagccctgcaggatgcgctgggcgaggacttccccgacttcctggccgaagtggatcgcggcgaggaagaggccgaacgggtgctggagctggacctgcccggcgacgggccggaagacgagcgtgccgcccgtgcgatcgcggtcgcggccaacccgagcgcgatcgtgttctcgggcgtgttcgaaggcgcgccctcggcaggtggcgcctcgcggccgatgatccagcacgaggatgacgaaggcgaggaactgatcgcgggcgacggtgcccgctggctggcggtggtcgcggtggaccgaagccgcgggcggctggccctcagccgggtggtggaacgcggcgggcgcccgacggtggtgccgcctgcgggcgacgacgacctcgatgccttccacgacctgatcgactggctggccggctgggccggctggacgccggtcggcacccgcaccctcgactcctgaccgccggcctcacgccacgcgatggcttcggccctgatccggcaaccgggcgcccgcctgcggcgcgacccggccgtcgcagggtgacccgcgggtcggccgggcttgacccctgccgctgaatggcggatcaatgcccggcgatgggggagcattccggaggtcgccgccccgcgccccggccccgcagcgacagcgatcgaggagaccaggacccatgcagatcaacggtgttgccgcagtcgtgaccggtggtgcctccggcctgggcgccggcacggcccgggcgctcgccgccgccggcgccaaggtgaccgtcgtcgacctgaacgaggaggcgatcgaagagctggcgcgcgagatcggcggcctggcgatcaagctggatgtgaccaacccggctgccgccgaggccgccttcgagacggccgccgcggcccacggcccggtccggatcctggtcaactgcgccggtatcgcgcccgctttcaaggtgctcggcaaggaaggcccggcctcgctcgacgccttcgcaaaggtggtgaacgtcaacctgatcggcaccttcaacatgatccgcctggccgccgcccagatggcgaaggccgatccggtgacccaggacggcgagcgcggcgtgatcatcaacaccgcctcgatcgcggctttcgaaggccaggtcggccagtcggcctattcggcgtcgaagggcggtgtggtcggcctgctgctgccggttgcgcgtgaactggcccagcacggcatccgcatgtgcaccatcgccccgggcatcttcggcacgccgatgctcttcggcctgccgcagcaggttcaggacagcctgggcgccagcgtgcccttcccctcgcgcctcggccggcccgaggaatatgcggcactcgcccgccacatcgtcgagaacagcatgctgaacggcgaggtcatccgcctggacggcgccatccgcatgtcggcgcgctgaaccgccgccggacccggcagggccgcaaaaacgacagggaaagggccgctaccccgcgacggggagcggccctttccctatgaccggtcaggtggacaggccgctgccggccgccgcctcttcgatcacccgggcgagcttcgcgtcgcgcgccgacaggccgtcggcatcatgggtggtcagcaggatcgtgacccggttgtagacgttcgaccattcgggatgatggtcctgtccgtcggccgcaatggcgacccgggtcatgaagccgaaggcggccttgaagtcggtgaagcggaaggtcttctcgatcgcgtcacggccttccacctcggtccagccggagagcgaggcaagaagttcggcacgggcggcggggtcgagcttttcgaccatgtcggggctccccatatcgcgtccacgggcctctggcgcccgcggatctctgaccaccagaagggccagcaggcgcagggcctgtcaacccgagagacgtgacatcccaacggaggcgcaagcccgatgaccgctgccgaggacgatccggcccgccgctatggcaatctcgtggcgcccggcctcgatgtgttcgatgcgatcgccgatcaggccttcggcagcctgccggccgccttccgcgaggcgatcggcccggtcgccatccgggtcgaggattttcccgacgacgaaaccctggcggagatgggcatcgaagacccgttcggcctgctcggcctctatcggggcgtgccgctgaccgagcggtcactgacccagccgcaggcctggccggacatggtcttcctctaccgccgcccgctgctcgacgcctgggccgagacagagggcgaggccgccggctcgacgctctacgagctgatccgccatgtgctgatccacgagatcggccaccattacggcttctccgacgaggatatggagcggatcgaggcggattgaaccgccccgatccctggcgcagcgctccgtctcaggcgccctgccagcccatgcgctccagaaaccagcccggcacgggcgccgagcggccggccttcatatcggtatagacccagatgatctcgccggtggagagcagcgcgtcctcgcccttgggatggatttcaatcgcaaaggtcacgctcgaccggccggctgcgccgatgcgcacgcagacatcgatctcgtcgtcgaaccggatcggccgcttgtattcgaccgtcgccttgaccaggtggaagtcgaaagtatccggcgagaagtgatcgttatagccgatctcgcgcgagcgcaggaattccgtgatcgcggtgtcgaaataggtcagataatgcgcattgaataccacgcgctgaccatccacctcggaatagcggatgcggaaggggaagtggaaatcgaaatccgaacgggccatgggggagggcgtctcctgggtgcgggcgcctcgcgggatgcgggcgcctctctttgatctgccaccgcccgaacgggccggggcatgcggtgcctatcctagacgggccggcaacggccggccagatcctgtagcgcaacgcccgcggggcttgacagcccggcgcatcggtataccatcgcggacatgagcatgatcggacatcgccatacgcgcggttctgcgcgaattacgggcccggccctcttctgagggggccgggggttttcccgtcttgcgatgagggtcgctgccggcttgcggcgcctgcggtccgccaccagatcgatgcgttggtcccgatgaccgtttctgtcttcgtctccccccgcagctgcgtctctgtccgacaccgccggcgtcacactgcatgctggaccggtcttcgaattatcggcccggttctccactgagaaccgggagaccagatgacggcatgcgatatcccctgcccgcccgtgacggttgcggcaggcggatgtcgggacagagaccgtgaccggagaacggcccccgacaacagcagggccccggttaccgacgacgaggaccgcccccatgttgaccgccaccctcagcaccaccaccgcccatctcgccccggcagccgaagcggtggcgcctgccaccgcctgcttcttcgtggtcgccgccgccgaggtcggcaccatgtcgcgggtgctggaagtcttcgccctgcgcagcctgctgccgtcgcgctggcacagccagcgggtcggtggccgtgcggacgaggttcatatcgacgttcagctcgacgacgttgtgccgggcgaggccgaaaagctggcgcgcaagctccgccagctggtcgaggtccgccaggtgctgatcaccttcaaggcggtggccgactgaagccccgccctctccgcacccgtcccgaccggcatccgcccctccgatgatgccccgggatggtggcggcatgtctccgcccgcgatccacgcccccttcccccggatcgtgcgcgctgatccccatgacatgccggccccgaggcccggcccgcggcgccccaccgcgcggccgggcttttccgtccggggcggccgggtctaatcggcatcagccagacccagccgtcggcggatgccggccggcgtgacacccgcctcgcgcagatcggcaagccgcacgccgggcgtgcgcttggccagccgccgcccctgatcgtcggtcaacaggcgatgatgccgccagaccggcaccggccaacccatcagcgcctgcagcaggcggtggagatgggtcgccgcctcaaggtcgcggccgcggatgatgtgggtgatgccctgcaatgcgtcgtcatgcgtgaccgcgaggtgatagctggccggcacgtccttgcgcgccagcaccacgtcgccgtgaatggcgggcgtcgccttcaccggccccgcatccatatcggtccagctgaggtccgaggcgacagtccccagggcggccagcgctgccgccatgtccagcctgagggcgtgcgggtgccccgccgtcagcctggtcgcacgcgcggcaggcgtcagcctgcggcaggtgccggggtagagcgggccgtcgggtcccgcaggcggggggccgtggggcgccgaggcactggccgcaatctcgacctcgatctccgaccgggtgcagaagcagggatagaccagatcccgtgccgtcaactcgtccaggacggtgcgatagacgtcgaaatgctccgattgccggcgcacctcgccatcccagctcagccccagccagtccaggtcccggaagatcgcatcgacgaattcggggcggcaccgggtggtgtcgatatcttcgatccgcaggatgaaacgtccgccatgcgcccgggcgtaatcgtgagacagcatcgccgataatgcgtggcccagatgcagcagccccgtcgggctcggcgcgaagcgggtgaccggcatcacggccgggggcgcgggatcgatggtctggctcatccggccttctccgggtctttcatgtgcatatgcaaccgtgggacgattaatgaaaacgataattgactctcggtcctgtcctgacagaggatatcaaccagaagtcgttatgggtttggtttcatattgcaataaagctgcaaagggactgcagcaaagaccatgaaacccccaggcgacgcggaatgtccatcacgggcgacgcgggcggcgcctgccccgccttcggggcctgccggtctcatccgggagaccgcatggctggcgccagcttgaggagtggtatcgtgacgatcagggtcatcgacgtgacactccgcgacggcggatatgtcaacgatcacggctttacgccacaacaggccgcagcactggtggcgggccttgcggcatccggcctcgactatgtggagatcggctattaccggccccatgacgaggccctttatgacggtcggccggcggcctgctgcccggcctggtatgtcgaccagatgcgcagggtgtcggaccgcaccggtctgacggtgatggcgcatgtccatcaggtgatgctggacgattatgcccgcctcgccgatcagggcgtgcggctggtgcgcatgccggcaacgccggcccggctcgatgccgcgctcacccatgccgagcgcatccgctctctgggcatggaagcggcgatcaatctgattcgggcatcggaacagccgctggatctggcgcctgacgtggcacggcgtgcccgggatgccggtgccaactggttctacatcgccgacagcaatggcggcctctatccgcacgaggtctcacgccgcattgccgacatcgcggaagcggcaggtcccggcggcccgggcattggttttcatgcccatgacgggctccgcctcggcttcgccaacacattggctgccatcgaggccggcgccgttatcgtcgatgggtctctcggcggcatgggcaagggcggcggcaactgccagaccgaggcgctggccgtccatctgcatcgtggccagggccgggcattcacccatgagcggctggcgcggctgatctcggagcatctgctcgactgggtcgaccggcgggccttcgcgctctacgagaactgcctggccgcatccatgaacctcaatctcgacgatcttcgggcgctgcgcgaagacgcggcccgcgacggccgtgccttcctggatgtacttgccggccggctggccggtctgatgcagccggcggaagcaggcaccctggcccgcggcgcggcctgagcctcgaccgccctggctcttttcccgttctcaccaaacgatccacccacgcgacgactggaaggttcgacatgacggacttcgtcgaaacgctcgaccgcatgattgccgagcgcaagaagatgaccagccccctctatcagctgatcatgagcggcaaggcgacgcagcggctgctgcagaacttcgtcatccaccgctggccgatcaagaacttctggacccgcaacatcctgggcatcgcctcgcggatcgacgattacgagctgcgcatctcgctggtcgagaacatctacgaggaagagaccggccggctgaccgacagccgccgccacctgctctccttcgtcgatttcggcaactcggtcggcgtcaccatggatgacattcaggccgccccgctgctgcccgagacccaggcggtgatcgaccacaatgtcggcgtctgcaacaacaccgccgtccatttcacggccggcgtcgcctcggtgctgctgctgatggaaggccagccgccgatcgtgaacccgcagaagcgttcgatgctcgacgtgatgcgcgacgtctatcagctgccgcccgagggctatgactatttcgttcatcatgcgtcgtcgaccgagggcgacgaccatgtgagcgagctcgaggacgagcatgccacggtcgcgcgcgagctgctgcgccgctacgccaacacccctgagctgcaggaccagtgcgtgcgcatgctgggccgggcgctggatctgcgccacgcccatttcgacgcgatgctgcgcaacttctacgacccggccgaagcgccgttccgctaccaggacgtcgccgcctgagatgaccgggtccgggtccgccgtcatgcggcggacccggacccttcactcccgacgcccccaccccgacgccccgccccggaagccgctccatgcccacacccgtgcgttcatcgaagacctttccgctctgccatcacgacggtgccctggtgccctgggaaaccgcgaccctgcatgccgccagccttgcgctgcgttatgccgtctcggtcttcgagggcatccgcatctaccgcacggccgatggccgcgggctgaaggtgctggaactgcacccgcatctcgaccgtctggcggcttcggccggcatgatgtggctgccggatcccgggatcgaccgcatccccgacatcatcgccgaactggtggcgcagaacgtcgtcaccgacgacgcctatgtccgtccctcgatctcggccggcaatccgggggagctgggccaggcggctcagccgctgctgaccgtcaccatcaccgcccaggggcgcaagacctggctcgccgacgacaggcggatgaaggtcaagctttcggcctggcagcgcgcccatgacctggccttcccgtcggcggcgaagaacatctccaattatgcgggggcgcgcatcgcgatgctggaggcgaagtctcagggcttcgacaacgtcgtgctcgccaatgccgacggctatctgtccgaggcgccgaccgcgatcctgttcctggtgaagaacggccggctgatgaccccggcactgtcggaaggcgtgctgcccagcatcacccgggcgctgaccctggacattgccgccgaactcggcattcccgcggtcgaaacccggctgacccgcgccgatgcctggacggcggacgaagccttcctctgcggcaccgggcttgaatacgcgctgatcggccagatcgacggccatgtgctgaagcgggccgacgcggccccgatctcgcagcagatcattgcgcgctatttcgagcgcgcgcgcgacatccgggccgccgcgggcgatctgatcctgccgcttcccgatgcggccgccgtcgcctgaccgccgcacgcctcgtcagggatacatccccgaagaagggtccagagccatgatcgactggcatgccgccgccaccgtcctcgccgggctgaccgccgagggggccggcctcgcccggcgcgtctccgccgccgtcgccgcagccccccgtttccagaacaaggccttcgacctggccccggcgccgctgatggtgcgcgccgaccgggtggaggctcatgcccgcgacctggaggcctatgtggcgctgctggaatcggcggtcgaagcctatcgcgccgaccccgaggtccgggcctatatcgcgctcgatcctgcggaagaagccgcatcgctggcaccccatcatctgccctccaccgttcgggtctgccggatcgacggctaccccgccctgcctgacggccgggtggtggtgctggagaacaatgccgacagcccggccggcaccatgttcaccggccggatcaacgccgtgatcgacgatctggtcgaggcgccgctcgccgccgccgggctcggcatctgcaagctgccgctcgacaagggtgcgccgctgctggagcgcttcctggaagactaccggctctggggcggcaccaatccggatccggtgctggccgtgctgcaggaagacggcaaggccaatgtcgaatcggtcgaaatggcggccgcctatacggcgctcggcacaaggaccctggtggtcgatccgcgggcggtcgagttccgcgatggcgccgcctgggcgggcgatacccgcatcgatctctgctggaacaagatcaacaccgtctactggcgccggctgaccgcggaccatcccgatctgctgccacgctgggtggcggcgatcgaggcgcgcgccatcctgcacctcaaccccttcccggcccgctatgtggccgaaagcaagcgcactctggcgttggtgcgcgagccgcgcttcgcccatcacttcaccgaggatgaacgcgcgctggccgagcgtctgctcccctgggcctcgaagctggagccgggcaagcaggtgctgttcgagggcaccgcgcgcgatctgcgcgacctgctgatggaacgcccgcaggactgggtgctgaaagagccctacgacatccgcggcgacggcgtcaccatcggccgcgacaccgatcacgtcacctggatcgcgaagatcgaacagggcttcgccgagggcaatatcgcccagcgctatgtgccgccgttgacctatccgatcctgaccgacccggcgacgggcacctgcgtgccgatgaaggtcagcctcgacaccttcgtcttcggtggccgtttcatcggcttcggcgccaaggccagcaacaacgaacgggtcaacgtattccagggtggccgcaagcttgcggtccgggtggcggagccgcgccgtgccgccggcctcgcctccgacgccgcctgatcagccgaccccggcccccggccccgcacccccgcacccgacgacaacggaagaaccatcccatgaccgaccagagccccgccgccgctgccgaaaccctgccgctcgacgatgccggcgtttatgccgtgctctcgcgcgcttcgaccgccgcggtctctgacgtgctcgacatgctgggctacaataacggcctgctcggcatccgcccgctgaagcctggccatcgggtctgcggcccggccttcaccgtggccttcgaaccggtggccccgggcgagccggcaccggccgccgattatatcgaacaggtgccgccgggccatgtggtggcgctggccaatgacggccgcacctggtgcaccgtctggggcgatatcctgtcggcgctggcccagagccgtggcatcgccggtaccgtcatcgacggcgcctgccgcgatgccaccgagatcatggcgctcgactacccgatgttctcgctgaccgcctatatgaagtcgggcaagaaccgggtgcgcatggtggcgacccaggtgccggtgaccatgggcggcacgcaggtggagccgggcgactggctggtcggcgacgattcgggcgtggttgccgtgccggcggcccggcgcgcggaagtggccgggctggtgcgcgaggtggaggcgatggaggcgcgggtgatcgccgatgtccgcgccggcatccccctggccgaggcacgccgccgccacggctataaccgcttcgccctcaaggtcgaaccccggccctgaccgatcggcccgagccgggccgccccctcctgctttgcgcggtttccaccggtcccgattgactttcgatccccggctgtcgccatgatgtacgcacctgatcatggcggtggacgacggagacggatgggagagcgggacatacgcgacggcctgcgcaacgcccgggtggcgatggaggccgaactctcaaggcgcgccgcgatcgccaccttcccgggggcggctgcggccaccgccttgatgtggccctatgtcgaccatctctgggcgatcggctgggtggtgctgatgtgggcgatctcggcgatccgcattccggtcgcccttctggccctgcgcgcagccgaagccgacgccgtcaccgaagcccagagaaccatggtcgccggcggcatcgccgtcgcgtccttcggctgggggcttggggttgccgcgggcctggggctcggtaccgcaggggccacgacgattgccgtcgtggtcctgcttgcgatttcgtcggtgggcatcgcctatgtgatggatcgggcgatgctggtggccttcatggtaccgctggccattccgccgatcgtcttcctgctcgcccgtcacgaggggcaggatctgacgatggccgcgtgctatgtcgtctatctggtcatcttcgggagtttcgccagccgccatcaccgctggatcgcggacatgctgcggctcaacatcgaaaaccggcagctgctggaacgccaggcccgcgatgcggggcggatccgggccctggtcgatgaattgaccgtcaccaatacccggctggaacgctcgctgcacgatgcccaggcggccaacgacgccaagagccgcttcctggcccaggtcagccacgagctgcggacgccgctgaacgcgatcctcggctattccgaaatcatccgcgaccagatgttcgggtcggatgccgccaccttccgccgttattccgaacaggccggctatattcaccagtccgggcagatgctgaaggcgctgatcgaggatctgctcgatgtcgccaggatcgagagcggccgcaccgaggtcgagatcggcagagtggatgtctcccgggcgattgagggcgcattgacggccattcgtccgcaggcggccgccaaacggcagtcgctgcgggtcgacctgcccccggacctgccggccgtggcagccgatcatcgcgcgctcggtcagatcctgaacaatcttctcggcaatgccgtcaagttcacgcccgaggacggccatatcaccatcgccgcacaccggacgtccggaccgggccgccagatggtcgcgatcaccgtcaccgatgacggcatcggcattcctcccgaggcgatcgaccgggtgttcgagcctttcgagcgtggcggcaacgtcatccggcggagcattgaaggcaccgggctcggcctcgcgatcagccggcgcctggccgaagccatggaggggagcgtgacgatcgagcgccagcgccgcatcggcaccgcgatcaccctcagactccccgtcgcctgagccgatattcccccggtgaacgaccggactgcatccccctgcagttgaaaccgtgccgtgccggccccagtccggcccgcgcacaggctcttgatctttcatgcaagcatcacaaatcattgataccatatggtcgcgaggcgggcgtcctccacgcccgcccggttcagggggagacggagcctgtgggcctatccgcgagcacctgtccggcgctggtactgaacgccgattaccgaccactcagctacttcccgctgtccctgtggtcgtggcaggacgcgatcaaggcagtattcctcgatcgcgtgaacatcctttccgaatacgactccgtggtgcacagcccgcgcctggagatgcgtctgcccagcgtgatctcgctgcgcagctatgtgccggtgaaccgtcgcccggcctttacccgcttcaacgtcttcctgcgcgaccgtttccgctgccagtattgcggccggcgtttcgccacggaagaattgaccttcgaccatgtggtcccccgcgcccgcggcggcaccaccacctggcagaacgtcgtcactgcctgcacggcctgcaataccgccaagggtgcccgaacgcccgagcagtgcggtctgaccctcaggtcggtgcccaaagccccggacctgaccgaactccaggaagccgggcgccattttccgcccggcaatttgcatccaagctggcgagactatctgaacttcgccgggctgtccgagatccgctcggacgaggatgcggtcgacggggctctggccgcgcataccaccttgcgcgccatccagagcgaggcccagggccgcgccttcccccgggacatgaccgagggtgagtactggggggtccagctggaagacgattgatcgcccgttgcgttcatgcccgcgatccgcgaggatcggcaccctgagacggtgtcgacagatgtggggcgtcatgagcgggcatgagagcggggcgaatacgggcgtggccggcaggcttggactgtcgacacgaatagccgccatgccgaccaaccagatcgccgatatcgccgatctggcccgcgaggatccgtcggtgatccggctgtggatcggcgaaggcgacctgccgaccccggatttcatccgtggggccgccgaacaggccatgcaggccggacagacccgctacacctacggccatggcctgccggcgctgcgccgggcgctcgccgactatcacgcccgtcattggggcgtggccgtcgatcccgggcggttcagcgttacggccggcggcgttcaggcgatgatgcaggccttccaggcgatcctggagccgggggacgaggtgatcgccccggtgccgacctggcccaacctgggcgcgatcgtgcgcatcaatcacggccggctggtgcccgtgcccttccgggtgagcgacggccgcttctcgcttgagctcgacgatctggtggcggcgatcggcccgcggacccgggcgatcgcgatcaactcgccctccaacccgaccggctgggtgatgccgagagagcagatggccgagctggtgcgcatcgcccgcacccgcgggctctggatcctgtcggacgaagtctacggcctgttcgtcgacggcgatcggccggcaccctccttcctcgaggtagcggagcccgatgaccgtctgctggtcaccaacaccttctccaagaactggtgcatgaccggctggcgtgccggctgggtgattttccccgacggcatgtcgcgggtgttcgagaacctgtcccagtacaacaccaccggcgtcgccaccttcattcagcaggccgccatctcggccctgaacgagggcgatcccggcgtcagggcgctggtcgcccgcaccatggccgcccgcgacgtgctgctcgatgcgctggccggcatccccgagatcacggtggtgaagcccgatggcggcttctacctgttcttcggcgtgcgcggcatgaacgatgccttctccaccgccgtgcgcatcctgcgcgaagcgggcgtcgggctcgcccccggctccgccttcggccccggcggcagcggctatctgcgcctgtgcttcgccatcgatccggcgctcgccgccgaggcggcccggcggctcgacgccttctttgccggcacccggcagggttagccccggcgacagtcccggatggcgtcggcgatcagccgggccgcggcctcgggatcgggctgtccgcagatcgccgagaccaccgccaggcccttggcgcccgatgccagcaccggcgccacatgctccgccttcagcccgccgatggccaccgccggcacgggcgacagcgccaccagccgggcaaggccgtcgaaaccggtcggcggctcgtgatccggcttggtctgggtcgcgaagacagggccagcccccacatagtcgaccaccgagggatcgaccgcccgcaccgccgcctcggtctcgaccgacaggcccaggatcatccccggcccgacccgccgacgggcctctgccgcgggcatgtcgccctggccgacatgcagcccatgggcaccgatcgccaccgcggcatcgacatcgtcgttcacgatcagcggcacgccggttccgtccagcaccgacatgagcgcccggcccgtctcgatcagcccggccgtgccggccgccttgtcgcgcagctgaacgatcgtggccccgccggcaacggcggcgcgggtggtctccaccatcgatcgcgcccggcagagatcggggtcgagaacaagatagagcgagagatcgaaacgcttcatgccggccggatcctttcccccacctcgagcgcctgagagtcaagaccatgcagcgcatcaaggaagcgcacggcaaaagaccccggaccgcctgcgccctggtccgccgcctcccccgccgccgcaaaggtggcgagcgccgcaaccgtggcctcgaacggggcgtcgggagccacggccgtaaaggcgccgaccaggcaggtgagcgagcagccgagcgccgtcaccttcggcatcagcgccgagccgcccgagatccgcgccgcccgcctgccgtcggtcacgaaatcgaccgggccggtcaccgccaccaccgcgccatgggcccgcgacagccgccgggccgcctcttccgcctgttccaccgggtcgccggcatccgccccctggccggcactgaccccgccgtcgagcgcgatgatctcggacgcattgccgcgcaccaccgtcggccgcaaggccagcagctcagcggccacacgccgccggtagccggtcgcgaaatgggcgacggggtccagcacccagggccgaccggccgccatggcacccgcaatcgccgttttcatgccaccaacccagccgggggaaagggtgccgatattgacggtcagcgcaccggcgatgcgggcgaactcgcccgcctcttcctcggcatggaccatggccggagaggcgccggcggcgagcaggacattcgccgccacgttcatcgccacgtaattggtaatgcattgcaccagcggcgcagtctgccgcatgcgggcatggagttcagcggcaccggcggtcttctgcgaggtcattccggttcctccctctctcggtcttgatcgacccggcccgcaccggcagcgaggggagaggttccgaaacgccgtctcccccgcaccgcatgggttgcaggggccggccatccgcaccatccctccgccagtatgaactggatcaggttcttcgggtccctgcgctgccttgcggcccggcagaatctcagccccttgtcgggacacccctggtgaggtcttcagactgcgcgccgcccgggcgcggtgtcaacagcgccgatcagagtcgggtcgacagccagatcgcaagccgggagcctgcaccgatcagcgccttcatcgccttgtagccggtcgcctgttcggcgccatgggcgaggccggtatcgcgatgctccagctcttccgcgcgaaaacgctcgatcgtgtcgcggagcggcgcttcgtcggggccaagtgcggcagactgggcgcggtagtggcggtcgatctcttcctcgaccgcaaccgtgcaggccatcgccgcccgcggccccatggcggcggtcaccgcccccagcgcaaaacccgcggcatgccagaccggcgacagcagggtcgggcgcacccggcggtccaccatcatccggttgaaggtctccagatgcacccgttcctgatctgccatatgtcggatcgtggcaccgtgcgggcccttgcccatcaccgccagctgcccggcatagatccgggcagcaccatattcccccgcctgatcgacccggatcatccgctcgaccagggtgcggggatcgggatcgccgggcaggctgcgtgcagcggtggggcggcggtcggtcgggctgggttcgtctgtcatctcaaggcggtctccggtcggctcgtcagccatgcctgaagatacgccgcgcgccgcccgcggcaatccccgccagcagaatcgacagcagcgcattccaccccgccatgctgatccccagcaacgaccagacgatatcggtgcaggcggcacgcggtgcgccggcaatggcggcccgcagcgcggccagatcctgggcaccgccgccttgggccgtgctcatcgtacaggcggcgcttgcctccacccagccctgctcgacacccacatgatagaggccgatgccgccggtcaccagcagcagcaccgtgatcagcagcagcccccagccctgcacccgccgcgagggcccgagcgccgtcagcgcacctgccgccaccaccacgcccagatgcggccagcgctgctgcaggcagagcacgcagggctccagcccgcccaggacctggaaactgagcgcgcccgccagcagggcaaggctggcggcccccagaaaggggagcagcggatcgatcccacgggcacgcaggcgtgccgccatcaggtcgacgggcttggtgagcagggacatggggcgcgttctctccggcatgtcggacggccgcacgggcggccgggcgggccatcctgcggcagggcctgcgaccgttccgtgacgtgtgtcacggcggctcgacggatgccgcgagtgtggctaggatcgaccggacaagcaagtcgcactccgcacacaccggacaagggtcgtgcggccccctgcgacgcctcgtctcgccagcggagatccgtgcatcatggcccgcagcacccggaccgccgtgtccgcctgtcccgtccccgccccggacttcatgcagattatctacctggggttgatgagactggtggcgctgcgacgatgggccgctgcaaccgtcgtcgccggcctgctctcggcatcgggtcaggccgccgcccaggaagaggcgatgcgcttcttccgcatcggcacgggatcgaccggcgggacctatttcccgatcggcggcatcatcgccaatgcggtcagcaacccgcccggttcccgcccctgcgaggatggcggcgcctgcggcattccgaacctggtcgccgtggcggtcaccacccgcgggtcggtcgacaatctcaacctgctgaacgacggccaggtcgacagcggcctctcccaggccgatatcgcggttctggccgaggccggtcgcggcgccgaaatcggcgcgccctcgatgccggatctgcgcgccatcgcgagcctctaccctgagagcctgcatgtggtggcaagggtcggcgccggcatcaccgatctcaaggatctggtcggcaagcgggtatcgctcgaccgcaccggatccggcaccctggtcgacgcccggctggtgctggctgcagcgggcattccgctcgacaggatcaaggtcgagaacctcgatcccgaggtggccgtcgaccatctgcgcgacggctcgctcgacgcgatgttcttcatgagcggctatcccgcggtctcgatcggggccgcgatccgcgacggggtcgcgaacctggtgccgctggcgcccgaactgcgcggcgccctggtcgaaaaacacccctttttcgtggaagacgtcatcccccgcgatgcctatgatctggcagccccggtgggtacggtcagcgtccgcgcactctgggtggtgcgcgaggggctggatgccgaactggtctatggcctgacccgggcgctctggagcacgcccacccgcggcctgctggatgccggccatgccaaggggcggctgatccggcccgagaccgcgacgctcggcgtcggcatcccgcttcatccgggggcggagcgtttctatgccgaatggcgggcggcccgcgacaaggcggccgccgaaggcaagccggccgatgccgatgcggcaccggatgccccatccggcagcccgcccgaagcggcaccgctggatgatctgggcagcgagcccgcggccacgcccgaggcaccggcgacaccggatgcaccgatgcccgaacccaagcccggcacccccgccagctgagccgcatcatctgacggtaccggatgatgatcccccgggcttgacggcggcgccccgggcgctgaccttgtcgattggcgcgattttccgcatccatcgatcgaggagccccgcacgtccatggccgagatcccgagcctgtcgcgtgaccgcgacgccgccgccctgccgctgaccctggtgaccgagcgcgatttcgccgcctggcgcgatgctgccgagccccggatcgcggcctggctttcggcgcagggcttcaagccgcggccgggtgcccatgcgctgctgcccgatgccgagggcggcatcgccggcgccgtgatggtgaccgcagcggaaccgggcccctgggccatcggcgatctggcgcagaagctgcccgagggtcgctggcggctggatccggaaccgaccgatccccggctcgtcacgaacctcgccatgggctgggcgctgggcgcctatcggttcgaccgctatctgggccgcaccgaggaccgtcgggccccggccaccctggtggtgccggccgcggccgatcaggtgcggctggccgccctggtccaggcgatttcccatggccgcgacctgatcaacacgcccgccgaggatatgggcccgcacgagctggcgctcgcagcccggcggatcgccgagaatgccggcggccgctatgacgagatcgtcggcgacaatctggtccagcggaatttcccggcgatccatgcggtcggccgggccagcacccggccgccaaggctgatcgatttcagctggggcgacgaaagccaccccaaggtcaccctggtcggcaagggggtctgcttcgacagtggcgggctcgacatcaagccggcctcggccatgcggctgatgaagaaggatatgggcggcgccgcccatgtgctggcgctggcgcggatgatcatcgacaccaacctgccggtgcggctgagagtgctgatcccgacggtggacaacgtcatcgccggcgatgccttccgccccggcgacgtgctcaagacccgcgccggcatctcggtcgaggtgggcgacaccgatgccgaggggcggctgatcctggccgacgccctggccgaggcagcgcgggacatgcccgaactgctgatcgacgtcgccaccctgaccggcgccgcccgggtggcggtcggcaccgaaatcgccgccttcttcgccgaagacgacgctctggccgcggccctggaaagtgctgcccgtgccgaagacgatccggtctggcgcctgccgctgcatcgcgcctatcgccacatgctcgacagcaagatcgccgatatctgcaatgtcagcggcggcggtttcgccggggcgaccacggccgccctgttcctcgacgcctttgcgggcgaggcgcgcaagggctggctgcatctggacctgatggcctggaacacgcgcaatcgcccgggccggccagaaggtggcgaaatcatgggcgtgcgggcgctctaccggatgatcgccgaccgctgggcgccttcggcctgacatccggagcgcgggcctgatcggcaatcaacaaccgcaaagcggaatttgcccaatcttcgcaaggcgccctgcgtcggttctggcagactttgatctgcaagaagaaccagcgcagggagacgccccccgatgtcacgtacagcccttacccggcgcggcctcgccgcaccgcttgcggcactcgccgccctggcggccatcgccgccacgccggtcaccgccgccgagatgccccgcccgaatgccgcccagggcgacggcggggtctcggccttttacgactggaccggcagcatcccggatcaggccggcctgctgctccggaccgaacccctgcccgcaaagctgggcctgcccggggccgggcagcagatgcgcatcctctacacctcgaccgacggagtgtcgggcaccggaccggtggtggtctcaggggcgctgttcgtgcccaagggccggccgccggccggcggctggccgctgctcgcctgggcgcatggcacggtcggcgtggccgatacctgcgcaccctcgtggaccgggcggtccaagcgcgatgtcgactatctgggccgctggctgcgcgaaggcttcgcgatcgtcgccaccgattatcagggcctgggcgtcgccggcccgcacccctatctcgccacccggcccgaagcctacagcacgctcgattcggtccgcgccgtgcagtcaggccagaaagagctgggcgtcgcccttgccgaccgggtggtgctgatcggccagtcccagggcggcggcgccgcctttgcgaccgccgccttcgcaccggactatgcccccgatatcgacatccgcggcacggtctcgaccggcattccctatctgacaccgcagctgatgaccgcggtcgccaaggccaatcccgacaaggtcgacccgaccatcgcctatctgctctatatcggcctgctggccgaacaggccccgaccaaagccgatgtcagccagatgttcacgcccaaggcgatgccggtgctgaaccaggcccgcaccggctgcgtgatgccgatcttcaaggcagtcaccgatgccggcctcacccgcggcaacgccatgccccccaaggccatcgaggtgatcaccgggcttgcgccgtcgctcgcctatccgacggtcaagctgacccatccgctgttcgtcggcaccggcgccgaagatcatgacgtgccgccagcgatgcagaaggcggtggtcgatgccgcctgcgccgcgggcacggtggtccaggctcatgtctatccgggcctcgaccattcaggggccgtcaacggctcgctcaaggacagcgtgcccttcgtgcgccaggtgatggcgggcaagccggtcagctcgacctgcggcgcatcctgaccggggcttccgccacctcctcccgcggctcggtcgccgcccgtgccgccgcatccgcggtggcacggtccgggtggatctcggcatgctctgcctcgagcagggcccgcttcacccgctctccccagcgatagccggcgaaaccgccctgttcgggcagcacccgatggcaggggaccagcagggagatcttgttggtggcgcaggcccgcccgacagcccgggctgcgccggggttgcccagcgcccgggcgagtgccccataggtggtgacggtgccggccggcagccggcgcaacgcctcccagaccctgagggtgaaggcgcccgcccgcagatccagcggcaggctgtgatcatccagccgggcggcatcgcgggtcagcccgtccagcacgacctcggcggcgcggccgatcagcggatggtcggccgcggcctccacccgcagggcggcgggaaaatcgaccgcaagccccctgagcagggccgcatcgtcgggatcgatcgcgatcatcgcgatcccgcgttcggtcgccgcgatcagcagccggccatgcgggcagtcgaagatccgccacgacaccacctcgccggcgccgccggccgcaaagcgcccgggcgccatgcccagccccgccgcaccgccgtcatagacccgggcggggccgccgaagccggcggtatagaccgcctcggtgacgctttcccccgccttcagggccgcgcggaaccggcggcgcttcagcccgcgcagcatctcggccggcgccacccccagcacccggccgaaggcgcgcgccagccgccgggtctccacccccagcaggctggcaagttccgtcgcccccgggacctcttcgcgccggtcgatggcgcccatggcggagaggaccagcttctgttcaggccccagcgcctgtgcctctggcgcacagcgcttgcaggcgcggaaaccggccgcctcggcggcatgggcgtcgggatagaagcggacattctcgcgattgggcagccgggcagggcagcccggccggcagtagatgccggtggtgatcacgcccagccggaaggcatcagcaaagcggcggtcccggtcggcgacgatgcgccagagccggtcgtcgccgacctgatcgccggcaagcgccagcacgtcggccggcgccgcaaggtcgacgggtacagaacgttcgatgggatcagaggccatgggtcgggtttcctcccggcagatcaaggggatcgattgcccccatcctgcacccatggcccccgccgcaccatccgcgaccggacagggatgtcacgcgcccaagcccgctcgcgctcaggacaggccgtcgggaaaagccgcacggatcagcgcccgggtataatcggtctcgggcgaggccatcaccgaggccgcctcaccctgctccatcacccggccctggcgcagcacgatcagcttgtgggccagcgcccgcaccaccgccagatcatgggaaatcagcacataggccagctgccgccgccgttgcagcccgcgcagcagctcgacgatctgggcctggatcgagacgtcgagcgccgaggtcggctcgtcgagcacgatcagctcgggctccaggatcagcgcccgggcaatggcgatgcgctggcgctgcccgcccgagaattcatgggggaagcgatcctgcatcgccgcatccagccccacttcggccagtgccgcaccgatccggtcccgccgcgccgcccggtcggcgatgggcgcatgcacatccagcccttcggccacgatgtcgcccacggtcatgcgtgggctcaacgcaccgaacgggtcctggaacacgatctggaagcggttgcgcaacggccggaggcgcttctgatccagcttcgcgaggtcggtgccggcaaaatcgaccaccccttcggcggtggtcagccggacgagagcggcggcgacggaactcttgcccgagccgctctcccccaccagccccagggtctcgccggggcggagggtgaaattcacccccaccgccgcctcgacatgagacaccacccggcgcagcaacccgcccttcaccggatagcgcaccgccagatcccgcacggtcagcagcggagccgccccggccgggaccggatcgggcaggccacgcgggcgcgaggcgatcagcatgcgggtatagtcgttgcgcggcgcgcggaagatctcgtcggcagagcccgtctccatcatctcgccgcggcgcatcaccaccacccggtcggcggtgcggcggacgatggcgaggtcgtgggtgatcaggatcagcgccatgccgcgctcgcgccggatgcgggcgagcaggcccaggatctcttcctggacggtgacgtccagcgccgtggtcggctcgtcggcgatcaggatctcgggctcgttggccagtgccatggcgatcatcgcccgctggcgctgaccacccgacagctcgtgcggaaaggaccgccggatgcgggcggtggagccttcggcatcgaccagcgccacctcacgcaacagcgcgtcgatccgggccgcggccgcagccccctcgaggccgcgatgcagggcaagcgtctcggcgatctgccgctccacccggtgcaacgggttgagcgcagtcatcggctcctgaaagatcatcgcgatgcggttgccgcgcacctggcgcagggaccgctcggatgcgccgacgagttcctcctcgcccagacgggcgctgccgcctacggcgacatcggcgctgcgcggcagcagccccagaatgcccagcgccgtcaccgatttgccggagccgctttcgcccacgatcgccagcgtctcgccagcccccaccgtgaacgacacccccgccaccgccctggtctcgccggtttcgtgccggaaggtgaccgacagatcgcggacggacagaacggaaggacttgcctgacgggcgccgctcacgagaacaccttgcgcgggtcgaaggcgtcgcggatcgcttcgccgatgaagatcagcagcgacaacatcaccgccagcgtcacgaagcccgaaatgccgagccagggggcctgaagattgttcttgccctgattgagcagctcacccagcgagggagagcccgccggcagacccagccccaggaagtcgagcgaggtcagcgcggtgatcccgcccgacaggatgaagggcaggaaggtgagggtcgagaccatggcattgggcagaatatggcggcgcatgatgccgatatcccccacccccatcggcccgggcggcgcggacatagtcgaaattgcgggtgcgcaggaattccgcccgcaccagcccgaccagccccgtccacgagaacagggtgagcaggcccagcagcagccagaccgtgggttcgaacagcgccgagaggatcagcagcacgtagagctgcggcagcccggcccagatctcgatcagccgctggaagatcagatcggtgatgccgccgaaataaccctggatcgcgcccgcgatcaccccgatcaccgagcttgcgatggtgagccccagcccgaagagcaccgagagcctgaagccgtagatcagccgggcaagcacgtcacgcccctgatcatcggtccccagccagttctcggccgaggggggcgccggcgccggccggtcgaggttgaagttgatcgtgtcgtaggagaagcggatcggcggccagatcgcccagccctcggcgtcgatcgtctcccgcgtgatctggtcgcgataattggccggggtcggcaggaagccgccgaattcggtgtcgggatagtcgaacagcaccggggcatagagacgcccctgatacgagaccaggatcggccggtcattggcgacgaattcggccccgagcgagaccacgaacagcaccagaaagatccagaacgaccagaaaccccggcgattgcggcggaaattgcgcagccgccggcggttcagcggcccgagcggtcgaaagccgaggcgtgcgacgatgcccatggctcagcctcccctggcttcgaaatcgatccgcggatcgatcgccacatacatcaggtcgccgatcaggttcagcagcagcccgatcagggtgaagatgaacagcgaggcgaagaccaccggatagtcgcggttgagcaccgcctcgtaggacagcagccccagcccgtcgagcgagaagatcacctcgatcagcagcgagccggtgaacagcagcccgacgatggtggcgggcaggccggcgaccacgatcagcatggcgttgcggaagacatggccatagagcacgcggttctcgctcaaccccttggcccgggcggtgatcacgtattgtttgccgatctcgtccaggaaggaattcttggtgagcagggtcagcgtcgcgaagccgccgatcaccagcgaggccaccggcagcgccagatgccagaaatagtcgaggatctgctgccaccagggcaattcggcccagttgtccgagacgagcccgcgcagcgggaaccacgacaccaccgagccgccggcgaagatcaccaccagcaggatggcgaacagaaagcccggcacggcataccccacgatcaccagaccgctggtccagacatcgaagggcgtgccgtcgcgcaccgccttggcgatgccgagcggaatggagaccagatagatgatcagcgtgctccacagcccgagcgaggccgagaccggcagcttgtcgaggatcaggtccaccaccggcgcattgcggaagaaactgtcgccgaaatcgaaggccagatagctgcccatcatgtcgacgaagcgttcgaccggtggcttgtcgaagccgtaaagggtgcggatttcctcgaccagcccgtccggcaggccgcgggcgccgcgataatcgctgcccgacatggagggggcggcgacctctcggccccctccggaaaaccccgaggtggcgtcggcctgggccccgctcagcgtcgccagcatctgttcgaccggtccgccgggggcgaactggacgacggcgaagttgatcaccatgatgccgaacaatgtgagcggaataagggccaggcggcgcaggacgtaagcgaacatccggaaccgggccccctgtcagcgcaggccgtagcgggcggcgagcgcgtcgtcgacccaccaggtgtaaagatcgatgccgtaatcgggcagcaccggcgggcgcccgaacttgttccagtgcacgattctgaaggccggcaggtggaattcagggatgacgtagtcgccccaaagcagcacccggtccagcgctttcacggccgtcaccaggctctgccggtcctcggcatcgatcaccttctggatcagcgcatcgaccacggagttcctgatcccggcataattgcggctgcccggccggtcggcagcctcgctgccccagaattcgcgctgctcgttgccgggagattgagactgcggccagatttcggtgatgatgtcgaaatcgaaggtctgcagccggttctcgtactgcgccgcatccacctgacgaaccgtcgcctcaatgcccagccggcccagactgcgggtgatcggcatcacgatgcgttcctcggcggcatcctggatcaggaattccatccgcaccggcgcatcggcatcgggggcgaacagcttgccgttcttcacctcgtagccggccttggccaggatgtcataggcggtcttcagcccctcgcgattggcgccgctgccatcggtcttgggcacggtatagggcttcgtgaacagatccgccggcagctggtcgcgatagggctccagcagcgccagctccgccccttctgggatgcccgaggacgccatgttcgagttctcgaaatagctgtcggtgcgggtataggcgccgtagaacagggtcttattcgaccattcgaagtcgaacacgtactgcatcgcccggcgcatcgccgggtcctggaagatcgggcggcgggtgttcatcaccagcccctgcatgccggtcgacagccggtgcgggatggtgtcgagcttcagcttgccgctttcgacctcgggcatgttgtaggcggtggcccagcgccgggcgctgttctcgacccgaagatcgtactggccggccttgaacgcctcaaccgagacctcgtcgtcgcggtaatagtcggtgacgatgcggtcgaaattgtaccggccgacattcaccggcagatccttggcccaatagtccttcacccgctccatcaccagcgtacggccgggctcggcgcgggccaccttgtagggcccgctgccggggatcggctccagcgtacccgcccccagatcatgggcatcgagccaggccttgggcagcaccggcagctgacccaggatcagcgccagttcacggttcttcgtgttggcgaagcggaagcggacggtgtggtcgtccagcacgtccacgcccgccacctcggcataatagatccgataggtcgggtggcccttctcacgcagctgatcgaaggtcgccgccacatcggcggcggtgatcggcgtcccgtcgtggaaacgcgcctcgggacggatggtgaaggtcaccgaggaattgtccggcgccttgtcgatggtcctggcgatcagcccgtattccgaaaacggctcgtccaggctctgcacggtcagcgtgtcgaaggcaaggctgaccggtgcggagatgccccgcagcgcaaaaggattgagactgtcgaaagtgccccgggcggcgcttctcagcgtgccgcccttgggtgcttcgggataggcataggcgaaatgatcgaaatcgccggggtatttcagatccccatacatcgatatgccatgcgacggctccgccagagcctggcccgaaagaaccggcgtgaaggcggcgatgcttccggccaagaggccgcccagcaccagtaccacccgggcggggcgacgccatccgcgtccccgcatccgttgttcggccatcacctgtcgtcatccctccggtcggtgacgctatccctccatccgcgatgatagggcaagttcaggccaaggccagcatttccagtgcaatccggtgcgcaagggggtcgccggcagccagcacgcgcccatcgccatccaggccgagcggcccgcccgaccagtcggtcaccaccccgccggcgccctcgatcaccggcacaagtgcgcaccagtcgtatggcttcagatccacttccgcaacgagatcgatcagaccgagggcgagcaggccgtaattgtagcaatcaccaccccagagcacgtcggtgacccgcccggccaggcggtcgaagcgggcccggtcgtcgggtccgaacattgtgggcgatgtggcggcaagccgggccagcgccggatccgcgcaggcgcgggtgcggatcggccggccgtcgaaacagctctgtccgccggtgatcccccaccagcgctcccccgtgccgccggcatcgatcacccccagcacgggctggccgcgaaagcacagcccgaccagagagccgaaagtgggtcggccggtgatgaacgagcgggtgccgtcgatcggatccagcacccattgccagtccgccgcctcgcgcacccggccatgctcctcgccgaagatgccgtgcgcgggcagctccgcctcgagaatgcggcgcatggcggcctccgcctcgcgatcggccagggtcaccgggctctgatcgggcttcacgtcgaccggcacggcggtgcggaaatagcgccgggcctctgcccgggcggcatcggccagacggaaggcgacgggcaggaaagaggcggcgtcttcggcaagacgggtcggggtcatgtggcgcacagggctccgagaggatggctccgagagagcggggtccggaacgacgacgcccgccgggtccgcatgggaccggcgggcgtcgcgaaagatgaccgggccgggcaggggatgcaacccggcgacgacatcgccggaaatccgcagcctggtctgacctcagccggcgttctgctgggcggcgggctgctcgccggccggctgttcggcagcgggctgctcaccaccttcggcccccccctcggcgggcgccgccgggatctccttgggggcatccgactggctgttgagataggcaatgaccgcggcgcgatcctcgaccttcgacaggccggcgaaggacatcttggtgcccggcgcaaacgaggccggcttggtaaggaagtggtcgagcttctcgaaggtccactcgccgccgatgcccttcagggcgtcggaataggcgaagccgtcggcagaggccaccgggcggccgaccacgctccacagctcggggccgaccttgttcgggccacccttcgagtcgtcgtggcaggcggtgcagcgggcgaagaccttggcaccggccttggggtcggcactggccagcgccacctcgaacggcacttccttcggcgcctcggcggcggcgtcggtggcgacgccttcgatcgcgtaggcgttcttctccaggtgttcaggctcgtacaccatgtcggagatgacacccacgaccatggcgaacaatgccgccgtcaggaacgcggccatcagcttgttgaattcgaagcctgacatgcccaatcctcttccacacgacgcccgacggcccttgacatgcattccggacagcagggcacgggtcgacacggatccggccgtgccgcaggttcttgatgagcgccgcactctccggagcggtcccggcggagcccgcggccgacggatgacatgcccgtcggtctgcggatccggcccgtcccagcggagggaattccgtcaggcggcagccgcgcttgcgggagcgtccggacaccttcgggaagcgttacggcacgggtttatgggtcacaccgcagatgcggtcatgacgggcgaagattagccacttcccccgcttctgtccaatccctataagggttccaggggctccggttccatacgagaggtcgagcctgcgtcacatggtcgcaacctccggtccggaatatggacgcccgattcttccatcgccgaggcagagaatgaaccccctggtcgtgatccccacccgtctggctgccacccgcctgccgcgcaagccgctggcggacatcaacggccggccgatgatcctgcattgcctcgaccatgcccttgccgccggcgtcggcccggtggtggtggcggcgggcgatcaggagatcgtggacgtggtggaagcggccggcggcacggcggtgctgaccgatccggccctgccgtcggggtccgaccgcgtccaggcggcggccgagattttcgaccccgaccggcgccatgacgtgatcatcaacttccagggcgacatgcccgcactggacccggccctgccgcgtgcggcgctggaggcgctgggcgatcaggccgatatcgcgacgctcgtggtcgagacctcggatccggcggtccgcgccaaccccaatgccgccaaggcggtgctgtcgatggcgccgggcagccggatcggccgggcgctctatttcacccgcgccaacgccccctggggggacgggccggttcaccatcatatcggcttctatgccttccggcgcggcgcgctcgaccgcttcgtctcgctgccgcccagcccgctggagctgcgtgagcggctggaacagctgcgcgcactcgaagccgggctgcgcatcgatgccgccatcgtcgacaccgtgcccttcgaagtgaatgcacccgaggatctggaggttgcccgccggctgctgaagcctgcgagctgacaccccgccccccgttcctcagccaggatgtgcatgcgggggccatggacagatgcagcgggccggcgcaagatgccggcccctgccattccagccggaatcgatcgatgcccgccgcccaggacatgcccgccacgccagcccgctccatcgctttccagggccagcccggtgcctattcccacatggcgtgcctggagatgtttcccgagctggtccctctgccctgcccgaccttcgccgatgcgatcgaggcggtgcgcgagggcaaggccgaccgggcgatgatcccgatcgacaataccctggccggccgggtcgcggatgtgcaccggctgctgccgacctccgggctccatctgaccggcgagcatttcatgcgggtcagccactgcctgctgggcgcacccggggcgcgtctggcccaggtgaagacggcgctcagccacgtccacgcccttggccagtgccaccgcttcatggacgcgcacggcatccggccggtgatccattccgacaccgccagtgccgccgcccgggtggccgagctgcgtgacccggcggttgccgccatcgcctcgcggctttcggccgacatctacggcctggacgtgctggccgaggcgatcgaggatgccgagcacaacaccacccgcttcgtggtgatgatgcgcgaaccggtgatcccggcgccggataacgggctggtggtgaccagtttcctgttccaggtgcgcaatgtgccggcggcgctctacaaggcgctgggcggcttcgccaccaacggcgtcaacatgaccaagctcgagaactatctgatcgacggcgccttcacgccggcggtgttctatgccgagatcgagggccacccggaaaaccgggccgtggcgctggcgatggaggagctgggcttcttctcgaccgatgtccgcatcctgggcgtctatccggcaagcccgcgccggcagcaggatccggacgccagcgcccgctgaccggcccgtcacgttacgttcgtcacggttacacccgtcacgggcacacccgtcacactcacacgcggagatctgcaggccatgggtggcagcggaatgggtgcgggccttgcctgggtgctgcttgccggcgccatcatggctgaaatcgtcgccaccacctcgatgaagatgtcggccggcctcacccggctcgggccgacggcggtgatggtggtgggctatctgatcgccttcggcctgcttgcggtcgcgctcaagcggatcgagatcggcgtcgcctacgccatctggtcgggggtgggcacggcggccatcgccaccatcggcgtgctggccttcggcgaaagcatgaacacgatcaaactggtctctctggggttgatcgtgctgggcgtgatcggcctgaacctgtcgggcggccactgagcccacctcgcctgccaggcccccgcccccccggcgtgtcgcgcgccgccggggaaagcgggaaggctcaatcccggccgtcgcgcagatcgcggatgtcgccgatcaccaccagggccacggccgggccctcgcccagattggcgtattgatgcgcgacatgggcctgatagaagatcgcatcgccgcgctgaagcacgtggttgatgccgccgacggtgacgcccagccggccttccaccaccaccagatattcctcgacgccatagcgatggccgacgaagggccccgccgtcgccccctggggcacggtcacctgaaccaggtccagcccgcgcgaggggaagatcggcgacatcgaccggcgctcgaaaccggtctcggggtcgacgaaggccgcctgatcggcgcggcgcaacaccagcacgtcgtggcggtcatgttcgcccagcaggctggagatggtgacgcccagcccggcggccagccgcgccacggtcgccgccgaagggctggcctcaccgcgttcgaccttggagatcatcgacttcgagacgccggccttctcggccagcgtctgcagcgtcatgccgcggtcgcggcgaagctcgcggatgcgccgggagacacggctctcgatctggcctgcctcgcctggtgcaacgccgtcctcgtcgtcttcgggtacagacccggtgtcgtcgatgctcatgatgttcctcggggtcgctgacgctgatccggtcgtcgccagcgcgttcgggggcgcgccgccggaagtggcccgagaataaccgcgggcaccggtcccggtccaggtaccgtgagggatcgggtggaattctgtccaatgggcgcaggcgcccgacgccggccgtcgtttttcatctcccgaaacgatggcggcggccgcagagctgtccgctccacggccgccgccggatcgtcggatgcgccggatcaataggcctgatcgcgcgcccaggcgaaatacagatcccaggccttgcgggcgatcgggcccggctgaagattgcgatcctcgatccggttgacgctcgccaccttgttgaagttgccggtcgagaacagctcgtcggcatccttcagctcgtcataggtgatcgagcgctcgaccacttcgataccgtcggcagcgaacagctccatcacccgcttgcgggtgacgccggccaggaacgtgccgttcagcttcggggtgtggaccacgccgtccttgaccatgaacagattggccgaggcgaattcggcgacattgccctcggggtcgagcatgaccgggttatcgatgccgcggcgcgcgccttcattcagcgcccggccagtcatcggataaaggcaggccgccttggcgtcggtgggcgccatgtcgggccctggccggcgataagggctgagcccggtcgagaagctgcccatctcgttcgagaacggaatggcgaagaccgtcatcacgaatttcgtgctgtcggggttcacctgcaccatgccgtcatcagcatacatcaccggacggatataggtcgccacgtcgcgcgggaagcgcttcacaccgtcgatcgcggtgccgatcacggtgtcgagatcgaccttcggctccagttcgaacgacttcgccgagcggagcaggcgggcgcaatgcccctcgagatcgggtaccacgccgtcgaaagagcgcgcgccgtcgaagaccatcgaggcgaactgatagccctgggacatcggtcccatgatcggcggattgccttcgacccagcggccgtcgatatacgaccaggccgccaggctcgacagattggcgaatgccatggggtgctgctcctgcaagcgatgccgctgccggttgcgatcctgcacggaagcggcgggcccgcgggacacggccggggttgaaaccggggtctcgggagggtccggaggctcgggcgccgggggcggggcagcgggacgtcactatgccggcgccgccctccgcacggggagcgggcatccggcatgttctgaaagaaagcatactcccttgccgccaactgtcaaagcgaagcagtcggcgttttatcgcgtcatacgttcttttcgcccttgcccggcaaccctcagagccggcgagcttcacagaccggcccgttcgcgcaggatccgcgccggcggcacgcgcagcgcgccggccaccgccgccagccccacaaccagggcgaggccgatgcccgccagggccgacgccgccaccggcagcatcgagaaggcgaaatcgatctccagcagccagcgggtgatcgcccaggcggccagcgtgccgccggccgccccgatcagccccaccaccaccgccacgatcaggaattcgatcgcaagcccggcggcgatggtccggcgtgaggcaccgacaaccttcatcatcaccgcatcgaagcgccgcttggactgggcagccagaaccgctgcggccaacaccagcgcccccgccgccagcacggcgattgcagtgatccgcaccgcaccggccaccccctcgatcagcgcgccggcctggcgcacggcatcgccgacgctgaccgccgagacattggggaagcggtcggtgacctcgaccatcagaccttcggctgcagccgggtcgcccgaaacggtggcgatatgggtggccggcgccccggcaagggcgcccggcgacagcaccatcacgaagttgagcgacagatccagccattcgatccgcctgagattggcgatctccaccgtgatggtccggcccagaaccagcacatccagccggtcgccgatcttcgcgcccatgccccgggccagttcgtcatcgatcgagaccagcggcggcccggcataatcggccggccaccagctgccttcggtcagccgggtaccctcgggcatctctgccgaccaggacatgccgacctcgccgcggatcgcccagcgctcgcgctccaccacatccgcctcgtcgatcacctggccgttcagcgcccggatccggccacgcagcgtcggcatgcgggcaaggttctccggccccaccgcctcggccgccaggcgatcgaagaccggcacctggtccggctggatgtccaggaagaagtattgcggcgcccgcgcaggcaggctgcggtcgatcagccgggtgaggttgtcctgcaccagggcaagggcggtcagcaccatcagcccggcaccgagtgcggctgcaatctcggccgtgggcgccccggggcggcgcagccccgcgacccccaggcgcagggccggccgccccggcacccgcacccgccgcgccaccgccgcaatcccgatcgaggccgcacggaagaccagcagcgccaccgagatcgacaggatggcgaccccggccagcatcggatccgcagcaccgcccaccaccagggccacgaccagcgtgcccgcggcaagaccggtcagaattccccggcggccggtgcgggcggccagcggcaccaccgccgcccgcagcagatcggcgggccgcacgcccgaggcacgccccagggccggggcggtgaaggcgatcgccaccccggcgccgatcagcgcggcacgcgccagaggcagcaggtagaggtcgggcaggatgggtgtcggcagcagcccgtcggcgaagccggcggcgatccagggcaccgtcgcccccgccacgacaccgatcaggatgccgagcgccgccaccacggccatctgcatcatgtagaccacgaaaaccgccgccgggcccagcgccagcgccttcagcaccgcaacggtgcgagcccgcgcctccagatgcgcccgggcggcgccggcaacgccgatgccgccgatggcgagtgcggccagcgccaccagttccagatgggtcgccagccggtcgacgaagcccgccaggccgggattggcccggtcgagggtgcgggcgcgccagctctcggccggccaggccgcctcaagcgcctccacggtggcggtgggggaaacaccaggcgccagcaaagcacgggtcatgtggcgggagatcgtgcccggcgcatccagccccgcccgggcgagcccggcttgcccgatcaccacccggggcccgagcgcgaagccgaacccgccctgatcgggctgggcgatcagccggccgcgaatggtgaaatcggccccgcccagctgcacgacatcacccggggcaagccgcaaccgcgcaagcagggtgccctcggccagcagcccatcagcccccaacgccgcagccggtgaccccgtgatcggcggctccgtctccatccggcccaccagcggataggccgcatccaccgccagcacctggaccagggcgcggtcattgaccggcgcacccggcgccgccccccgtaccgcaccccgggcccggacctcgtccggcgtcaggcggaccatgccgcgcaggtcgaccacggccgagatcgccgcggaccgcgccgccagatcggcccggaccgcatcgggcagcggccggccggtggtggcgagctccagatcaccgcccagcagggcgcgggcatcgcgggcctggccggcgaccaccgcggcatccagcgcgccgatgccggccatcgccgccacacccagcgccagagaggcgagcacgatggcgaacccgccgaccccccggcgcagatcgcgcagggcgaagcggatcagcgcccgccagggcaggccgcgcgcagacggcacggcatgtgaggcgcggccggcgaccgtttcgcccgcgctcatggccgaacctcggccggaagccccgccgcttcggacaggcggccgtcttcgatccgcaccacccggtcggcgcggcgggcaagcgcctcgtcatgggtgatgaccatgaccgcggccccggtctcgtcgcgatagccgaacagcgcatcggaaatcagccgcgccgtggcccggtccagattgccggtcggctcgtcggcgagcagcagcgacgggcgatgcaccaccgcccgggcaaaggccacccgctgctgttcaccccccgacagggctgccggataatgatcgagacgaggccccagccccacctgttccagcgccgcccgggcgcggtcgtcggcatcgaccgccccggccagttccagcggcagggcgacgttctcgcgcgcggtcagcgtcggaatcaggtggaaagcctggaagacgatcccgatatgtcgggcgcggagccgggccaggccatcctcgtcgagccggcccagatcctggcccgcgatctccacccggccggcgctcgcccgctccagccccgcaacgatcgcgagcagtgtcgacttgcccgcgcccgagggccccagcaccgccagcgtgcgcccggcttcgagatcgagatcgaccgatttcagcacgtcgaccgcggcggatccgcggccgaacgacaccgacacctgttgcagccggatcatgagattgaggagcctcccagacgtgaccctgttccgaccgaccgatgccggcccctgcgaccatccccgccatgccccgggcacggacaatgcccgtcgcacgcacggatctccgtcgccatatggcgccgcgacgggcgggatcaaaccggaagcccgttccgacgaagcggcggtgtcggtttcaccacacacccttccttcacgggcaggctgcggatctccgacgcggcgggcggtgctggggctgatcggcctcggcctcaccgcccttcttgtccgccccggccccctcggcgccgcagagaaccagccgctgatcctggcgctcggcgacagcctgaccgccggctatggcctgccggaaggcgagggcctggtgccgcagcttgaagccgccctggccgccgccggccggccggcacaggttgagaatgccggggtttcgggcgacaccaccgccggtggtcgggcccggctcgactgggccctggggggcctgccccgccagccggatctggtgatcgtggcactcggcgccaacgacgccctgcgcggcatcgcccccgacgaggccaaggccaatctggacgccattctggacacgctcggccgcaagggcctgccggtgctgctggtcggcatgctggccccgaccaattggggcccggactatcgcagggccttcgatgccatttatcccgatctcgccggcacccacgacgtgccgctcgaccccttcattctggagggcgtggcgctggagccgtcactcgttcagcccgacggtctgcacccgaatgtggcgggggtggagaagatggcggcacggctggcacccgtggtgatcggggcacttgatgcccggaaggtgccgaaggtgagtgactgattgaacacaatgaagcgcaggctgtcccccgtccgcaggaatgctaggatcgcatcaggaatgccccacgccggcagcctgttccgaccggcggcagacgatacggaaggacgaggaaacccatggagctttcgggcgaataccgcatccccgccgcccctgagacggtctgggcaaagctggtcgatccggcagcgctcaaggactgcattccaggctgccagtcggtcgagcagaccggcgaaaaccagtatgccgccgtcgtcaccgccaagatcggcccggtgaaggcgaccttcaacggccaggtgaccctgtcggatttcgatccgccgaagagctaccgcattgcgggcgagggcaagggcggtgctgccggcttcggcaagggcaccgccgatgtgacgctggagcccgacggcgcgggcggcaccatcctgcgctacacggccgatgcccaggtcggcggcaagatggcccagctcggcgcccggctgattcagggcacggtgcagaagctggccgacgaattcttcgccaaattcgccgaactcgctgcggcaagtgaaccggccgccccggcggctgcacctgccgcagcccccgcgccggcagacacccctcagccggcaccgcaacccgatcacggagccccggtctcgccggccgccgccggcatgagcgcgggcatctcgccggccgcggcggcgatggatatcgccggccataacggccatgaccatgacgatcacggccatgacgatcatggtcacggccatggcagccacggcaagggcgcgaaccccgtcgtctggctgggcgcgctggtggtcgtctcgctggtgatggtgctgctgttcggctgaaggccggacggctgatgacgcggtctcccgacgggaccgcgtcggtcagccgacgacgcgcaaccccgtcctgaaccgtgccgcattgcggacatagccctcggccgagccctgcagcatcgcaagcgctgccgcgtcgagctggcgcaccgcctttgcgggggagcccaggatcaggctgccctctgggaattccttgccttcggtcaccaacgcatgggcgccgaccaggcagttggcaccgatccgggcgccgttcaggatggtggcaccgatgccgatcagggtgttgtcgccgatggtgcagccatggaccatggcgtggtggccgatggtgacgccggtgccgatggtgagcggcacgccccggtcggtatggagcgtggcgccgtcctggacattggtccggtcgccgaccgcgatcaggtcgttgtcgccgcgcagcaccgccccgaaccagatgccgacatccagccccagccgcacccatccgatgacatgggcatcgggggcgatccagatccgggccggatcggcgatctcgggttccaggtcgtccagggcatagagcggcatcggcagggtctcctctggcgggtggcgggcggtccggtcagtcggccgccttggatgggggcgccgtcacgacgcccgctgccaggatatcgccgatctcggtctccgacagtcccgcctcgcgcagcagctcgataccgtgctcacccgccgcgggcggctggcggcgcagacccggccgcccgccgggcagatgcaccggcagggccggaatgccggcccgcgcagccgcaggcccctctgcccgaccttccgaagccgcaagctccacatccagcagcccgcccgaggccagaagatgcgggtcgtcaaacaggtccgacggcttggcgatcggcgcgaagggcacgcccagccgctccagccgcgccatcgcctcggccttggtcacccgccggaaggcgtcggccacccggggcagaaattccggccgcgccgccgcaagccgcggcacgctgtccagcgccggatcggccagcagatcctccagcccgaaggcgccgcagaaggcacgccattgccccatgctcaccacaccggcaaagatctgctcgccgggcccggccgtgtcgaacacgtcatagaccggccagggcttgcgcatgcccgggtctccgaaaggttccggatcggtcgcctcgatggccgcacgcgccatgtgctgggcgaccaggatcatgttggtctcgaacaggcccgactggaccagcccgccgcggccggtgctctcgcgctcgcgcagcgccgccaggatcgcgatcaccccgaacatgccgcccatgatgtcgttgaccgaagatccggcgcgcagcggccggccacgcggcccggtcatataggcaagcccgcccatcatctgcaccacctcgtcgagcgcggtgcggtgctcgtaaggtccgggcagaaaccccttcagcgcgcaatagaccagcctgggattgacctcggccatggcagtcggccccagccccagcgcttccatggcaccggggcggaaattctcgatcagcacatcggcatcttccgccagccggcggaccagggccacgccctcgggccgcttcaggtcaatgcacaggctgcgcttgttgcggttgaaggtcgggaagaagccgatcgccgccccggtcagccggcgggtggcatcccccgccgggccgggttcgatcttcaccacatcggcgcccagatccgccaggatcatgccgcaggacggccccatgaccatgtgggtgaattcgagcacgcgcagaccggcaagcggcagggcgggggcgtccggggaggagactggcaagacggtatcctcttgcaaagcaggggcagacagaggggagacggatatcacccggccatgtgccaggtcggcggaatgccggcagcggcaacccgcccgtgcagggcctcgccgggcaggccggccgacagcagctcccgcgcccggatcagccggtccagatcgatgccggtatcgaagccctcggattccagcagatagaccagatcctcagtagtcacgttaccgaccgatcccggtgcgaaggggcagccgccaaggccgccatgggcggcgtcgaaaccgcgcaccccctcttccagcccggccagcacattggcgaggccggtgccgagcgtgtcgtgcagatgcagattgccaagcggcaccgcccccagttcggcgcgcaccgcccgcaccagccggcggacctgacgtggggtcgcatagcccagtgtatcggccagcgccaccgcatcggccccggcccgggccagcgcgacggcggtgtcgatcacgtcccgctccggtaccacgccctggcgggaacagccgaaggcggtggagatgccggcctcgatccgtggccggccgggcccaccatcgtgcaggcgggtcacgatgtcggccaccgccgccacctgttcggcacggctgcggcggagattggcctggctgtgcgcctcgctggccgagaccggcagaatgatcgtcgtggcgccggccgcgatcgcggcttcgacgcccttcatgttcggggcaagcaccacggcatgcagatcgggatgggtagcacggacccgggcggtgacctcggcggcatcggccatctgcggcatcagggcgggcggcacgaaactcgccacctccatctcgcgaaggccggccgccaccagggcggcgatccaggcaagcttgtcggccgtggccatcaccgcgcgggcgttctgcaacccgtcacgcgggccgacctcgcgcacgatcacccgggggcggtcgctcgtctcctgcgtcatctccagatcctcccatgcacctgcgggtgcaggccgtctgcatgcggttttctggaagagtggctcctcgggatacgaaggggaatcgcaaagatgcggaggaagcttccgtcatcgacggaagctcaatctgcctcactcaggctggcgaggtgatcatgcagcagccgcgccgcaggcggcagcatggcgggagcacggccgaccagccgcagacgacgatgtgcccatggctcggcaatcgccacgcccaccaggcccagcgcgggcgagaagatgtcgaacacaccgtcggggatgaccgcaacgccctgcccggccgccaccatgcggatggcgctgtctaccgtcgccacgcgaaaggcggcgcgcgggttcagaccggcccgctcggccatgtcgttcagcagcagggtgatggcgccgccctcgatgatctcgatcagcggctcgcgcagcagctcccccagaccgatgccctctcggccaggcccgcctctgccggcaagcgggtgaccatccggcaccaccgccagcagccggtcgcgcccccagggccggccggtcagcccttcgggcagggcggtcccgatggtgatgatccccagatccgcccgcccctcgaccagctcgctcagaatggtcaggctggtgctctcgatcagctcgatttcgatgccgggccgggcgtggccaaaggcggccagggcctggggcagcggatggccggcgaccaccgacatggtcgccgccagccgcacccggccgagcccgccgcccgctaccgcccgcagatcatcggccagccggtcaccaaaggcgaacatcgcccgggcatggcgggccagcacctccccctcgggggtgggggtgaccccacgggcggcccggtcgagcagccgcaccccaagttccgcctccagctcctggatgcgcttggccgcggccgaaaccgcgatgccgcagcgcccggcggcacgggtgacactgccgcaatcgatcgccgccagcaggatctgcaggctccgccagtccgggggcagggtcatgccggcccgtcgccatcgtctccgcgaccatcggttgcgggcgcatcatcggtctcgatcgcatccacccggtcggggtagaaggcgagccggccgctgatcgaggccatggcgggcagcggatcctcatagctccaggccgcattctcgccacgtgtcccggccgcagggatcgagaaataggccgcctcgcccttataggggcaccagctggtctggctggtgcgggccagcgcacccatcgccacatcggcgcgcggcaggtagaagaccggcggatactcggcctccttcagcaccaccgccttgcgactgtcggcgatcacccggccgccggcgcgcacccggacccggccgggccaggcggtgacggtgatcggatggtcgggcccgggcacccggaccgtgcgtgttccggtcatggtctgtcgctccttgctggcaggggcagacgccctcgacggcgcccgatcggatctggcagatctgggcatgaccagggcgggtcggcaaggggtgggggccggatcatcccctctgcccggtggctgatcatcctgcgggtgatcaatcctgcccgcagggctatgctagcggccatgccccgaaaaagcccggaccagacatgacccagatcgcccccgccgagactgccgccccgaccgcccccgtggcgcaggaccacctgatcccgacgcccaggggccggctcttcgcccgcagctggacgccgcccgcttcggaggaacgagtggggggcggcggggtgcccattctgctcttccatgattcactcggctgcgtcgcgctctggcgcagctttccggaacggctcgccgccgccaccggccggcgggtgatcgcctatgaccggctgggcttcggccgttccgatccctaccccggcctgctgccgatcgatttcgtcgccgccgaagcgcgagaggcggtgccggcaatctgtgacgcgctcggcatcgacggcttcatcgcctgcggccacagtgtcggcggcggcatgggcatccataccgccgccgcccttcccgagcgttgccgggcgcttgtgaccattgccgcacaggccttcgtcgaggaccgcaccatcgccgggatcgaggtcgccaaggccggctttcagcggcctgaagagctggccaaactcgcccgctatcacggcgacaaggcacgctgggtggtcgatgcctggaccgagacctggctgtcacccgtcttcgccgagtggacggtggatgcggcccgtgcccgggtgcgctgcccggtgctcgcaatccatggcgagcttgacgaatacggctcgcccgaacatccccgccgcattgccggcaccaccggcaccgcgcgcatcctggccggcatcggccatgtgccccaccgcgaatgcgaggacgacctggtggagctgatcagcggcttcctggccggggcggtgccggcggcaggctgatctgccgccctgccgtcacccgtgcgaccagtgccggcgggatcaccggattgacgatctggatcagcaccagcagggccgttccgatccgccccgccagaaaggcgaccagagagcccatcagcacggcgtgcagcaacaccccgcccgcaaccgtgccggcaaccgcccgccgccccagatcgggccggcccagcgccatgcggaaactccacaccgacagcggcagaaacagaaccagcgcggtcaacaggcccggattataggccccctccaccacggccggcaccagatgggccatggtgttcaccgccggcacccccagccaggccagcgccagcgccggccgccgccgccccagcagcgcacaggcgggccccgccagccagaccaccgggatgttcacggcggtgatgaaggcctcagggatcggacaggcggcgggatccggaaagccgaaggtggcgcacagcatgccccggaaggcatagggcacccccagcgcatcgacgccgtgctcctccacctgatggaacagataggccagcgtccccgcccagcacagccagaccggatcccgccagcgcgtgacggaacggtctccccgcaatcccccaccggccagcacgatcgccagcggcaccgccagcaccagcccgatccagggccagaggtgcgagaaggtcatcgacggggggaagagatcggcgacgggcatgggggcgtctccgctcggcatgatcctcgacagcatcataggccgggtcaccgaccatgacgatagccgccacagcatccttcatcgtggggcaatcagacgtataatcgacccgccaccactttggccggagcatccccatggcgaacaagcagccccgccccgagcggaaggtgccaggccgggtcgaacgtctcggcttccggctggacgaagagaccaaggaactgatcgagcgggccgcccatctgtcgcggcgcaaggtgagtgatttctgcgtcaccgccctcgtcgagaccgcccgccgcacgatcgccgaacatgagaccctcgctctgtccgaccgggatcgggcagccttcttcgatgccctgatcgcgccccccgaaccgaacgaccggctccgccgcgccttctcggaacacgggcggcgcgtggtttcctgaacatggcggcgatggatccggatttgcggatcgacgctcttgcaccgcatcacgatcgggccggcttctcctgcggtatcgacgacctggatcgctatctcgcgacgcaggccgggcaggatgtacggcgcaaggccaatggcgtcttcgtggtaacggcctccgcccgacccgaaaccgtgctcggctactacaccctgtgcgccaccgcgcttgagccgggagcggtccccgctgctgcccggaagcacatcccacgctatcccctggtcagcgccaccctgctcggccggctcgccgtctcgacgacctgccagggcacgggcctcggcgccatcctcctcgccgacgccctgcgccgcgcttacgcctccgccacgacaatcggttcctgcatggtgattgttgatgccctgaacgcacgggcagcggccttttatgccgcccatggcttcatgcagctgtccgactcgatgcggctggtgttgcctatggtggtggggaagctggttttatgattcggccacattaactttcgacctccgtcggtcgaacgccaccacggagcaaggaatgagagtctgcatctattgcggccgtgaaaaacccgaatgaagaactttccgaccaatagatatggcctaacgccttgggcaacacaagtgtagcaacggcgcggcaatagccgtcgggaatcccgagccaccgcacagagctaaaatgcctgcaaccgggaccagctgatcatgacattagggtaatagagaatggcgcactcgacaggattcgaacctgtgacctccgccttcggagggcggcgctctatccaactgagctacgagtgcgtggccggggcgaacctgcggcggacggcgggggtggcccccggcgtcgaggcctggacattagccgaaggcggcggcggcgtaaagtgtttcgcgcggggttttcacagggggtgaaagccggggtgcagccggtcaggccgcagcctctccggctgcatcggattcgcgggtcaggcgcaggaacaggtcttccaggtcgggttcgcgggtggtgatgtcggcgaccgtcagcccggcggcggtcacggcggccagcaggcggccgacgggggtttcgctcgggcggaagcggaagcagacggtgccggcctcggcatcgacagcggcgccgaaggcggcgagcggtgccggcacctggcccggggccagggcctcggccacccgcaccaccagttccttggcatccagctgcgagagcagggcgtcggtgcggtcgcaggcgatcagccggccgtgattgatgatcgcgatccggtcgcagagttcctgcgcctcttccagataatgggtggtcagcaccacggtggtgccggccgcattcagctcgcggacataatcccagagcttgcggcgcagttcgatgtcgacgcccgccgtcggctcgtccagcaccagcaccggcgggttgtggaccatcgccttcgcgaccagcagccggcggcgcatgccgcccgacagcgtgcgggcataggcatcggccttgtcgtccagccccaccgccttcagcagctccatggtccggcgttcggatttggggacgccgtagaaaccggcctgcagctccagcgcctcgcgcggggtgaagaaggggtcgagcaccagttcctgcggcacgatgccgatggccagccgggcatcgcgctggcggcgatcgagatcgcggccccagatttccaccgtgcccgaggtcttgtggaccatgcccgccagaatgttgatgaaggtcgacttgccggcgccattggggccgagcagcgcgaacatcgatccgcgcggcacctcgagcgtcaccccgtgcagcgcggtcttgccgccggcataggtcttgcgcagctcgcgggccgagatggcgaggtcgggagcggtggcagaggcggtacgggtcggggacatcggcggggctttcctggcggcggtcaccggtggctgagccttaagcccggccggaggccgcgggacgcacttgcgcatgggccgaccttgggtatcatcgggccaccgtccggtcaacgccggccggccgggcagcgtcatccgggcgatgcgcgcgccgggccagggccctgaatcagaccggtcccaaaacagatatcgtgttcaggcgacatccgaggcgagaaacatggaacccgttgagaccatcatcgtcgagcagacccagctcgcatgcgacggcggcgtcggcgccctcggccatccgcgggtctttctgaacatggaaggcaagggctatgtcgactgcccctattgcgggcgtcactatgtgctgaagcccggcgccaaggcctcgcacggccactgagccggcagccggacgcgaccagccgacatcccgaacccgggtcgcccgccgcggcccgggttcttcgtgtctgcaccggccgctgacggcatgggcgccccttgttccacgtccgttcgcggatgggttccgggcggctttcatgccatactgcccgccgcgatgaccgcggccttcctgtacccagacttatatcccagacttcccggagccgagacggtagagatgagcgaccagaccccgagcccccagagccccctctacctcgtcgacggatcgggctacatcttccgggccttccacgccctgccgccgctgaaccgccccgacggcacgccggtcaacgcggtctacggcttctgttcgatgctgctgaagctgatcgaggatctgaaggccgagcggctggcggtgatcttcgatgccggccggctgagcttccgcaatgagatctaccccgactacaaggcccatcgccccgagccgccggaagagctggtgccccagttcccgctgatccgcgacgccacccgcgccttcgccctgccctgcatcgagctgcccggctatgaggccgacgacctgatcgcgagctatgcgaaggccgcccgcgaggccggccaggaagtcgtgatcgtctcggccgacaaggacctcatgcagctgatccaggacggcgtctcgctgatggatcccatgaaggccaagaagatcggccttgaagaggtgatggccaaattcggcgtcgcccccgacaaggtggtcgacgttcaggcgctggcgggcgattccaccgacaacgtgccgggcgtgcccggcatcggggtcaagaccgccgcccagctgatcggcgaatatggcgatctggacacgctgctcgcccgcgcgggtgagatcaagcagcccaagcgtcgccagaccctgatcgacaatgccgacaaggcgcgcgtctctcgtgagctggtccggctgcgcgatgatgtcgagctgcccgacccgctggacagcctgcatgtcggccagatgagcgccgaggtcgtgctctccttcctggaacagcagggcttcacctcgctggtggccaagctgcggccgcatctgggcgcatcgaaacccgcccatggcggcagcagcagctcggccgccgcagcagcggccgaagacatgcgtgcggcggtgcgcgattacgagctgatccaggacgaacccgccctcgcccactggatcgagatggcgaccgaggcgggcatcgtcggtttcgacaccgagaccaccagcctcgacgcccatcgcgccgtgctggtcggcttttcgctggcggtggcgccgggccgggcctgctatgtgccgcttcgccatgtggcgccgcgcaaggcccggcagggtgcgctcgatctgggggccgccggcgaggccggggcggatgagggcgcgcccgagcagatcccggtcgaccgggcgatcaccctgctccgcccgctgctggaagcgccgggcgtgctgaaggtcggccagaacatcaaatacgacatgatcgtcatggcgcgcgaaggcatcgagatcgcgccgatcgacgacaccatggtcatgtcctacgcgctcgacggcacccgccacggccatggcatggacgagctggcccagatccatctgggggtgacgccgatttcttatgacgaggtcaccggcaagggccgcgaccggatcggcttcgacgaggtgccgctggaccgcgcccgcgactatgccgccgaggacgccgacgtcacgctgaacctgcaccggctgctgaagccgcgtcttggtcccgaaggcgtgcgggcgctttacgagcgcaccgaccgggcgctggttccagtgctggcgcggatggagcggcgcggcatccgcatcgaccgcgacatgctgggcaaggcctcgcgggaattcgccgacggcatggcggcgctggaaacgcgcatccacgagctggccggggagagcttcaacgtcggcagccccaagcagctgggcgagattctgttcgacaagctgagcctgcccgggggcaagaagggcaagaccggcgcctatgccaccggtgccgatatcctgcagaagctggccgccgacggccatgagctgccggcgaaggtgctggactggcgccagctcgccaagcttaagaacacctatgccgatgcgctggccgaggcggtgaacccggaaaccggccgcatccacaccagcttcgccctgaccgtcaccaccaccggccggctgtcgtcgaacgaccccaatcttcagaacattcccgtgcgcaccgaggaaggccggcggatccgccgcgccttcgtgcccgaggcgggccatgtgctgatgtcggccgactacagccagatcgagctgcgcctgctggccgacatcgccaacatccaggccctgcgccaggccttccgcgagggcatcgacatccatgcgctgaccgcctctcaggtcttcggcgtgccggtgcaggggatggatccgatcacccgccgccgggccaaggcgatcaatttcggcatcatctacggcatcagcgccttcggtctggcccagcagctggacatcccgcaatccgaggccaagcgctatatcgaggcctatttcgagcgctatcccggcatccgcgactatatggagcgcgccaaggccgatgcccgcgcccatggcttcgtgaccacgatcttcggccgcaaatgctggacgcccgacatcgccgccaagaacccggcactcagggcctttgccgagcgcgccgcgatcaacgcgccgcttcaggggtcggccgccgatatcgtccggctcgccatggtggcgctggatgaggcgctggaggcaagcccgctcggcgcgcgcatgctgctccaggtccatgacgaaatcctgctggaggtgccggaggccgaggtcgaagagaccgccgccctggtcaagcgggtgatggaagatgtggtgtcgaggccggtgccctatgtcgtcgaagtcggcaccgggctcgactgggatgccgcacattgacggcgatgcctgcagatagcggagccgtcgaggcggtcgcccccggccggatccggctgccggccggcatcgatctggtcaccgccttcgcgggcctcgccgcccatggcgatgacgggctggtgcggctcgacggtgaccggctctatacgatcgagcggatcgaacgcgcgccggtggcggtggaaaccatcctcacccccgatgcccggggcgatttgcaggtgacggtggaaaccggcgccgtcgacctgctcgagatcgcgacccgcgccattgccgcccgtctgcatctgccgggtgcggccttcgcggcgcttgccgccgatgatccggtgatcggccggatcgccgccgcccagggggtgcgccccaccctgctctaccccgagcccatggtggtgatgctgcgcacgatcagcgcccagctggtcaacctcgcctgggccgcgaccacccgccgtcgcctggccgaagccttcggcatccgccggccggtgggcagcggctgggtgatcgatatcgacccggcccggatcgcggcgatcgaccccgacgagatcaagaccctgcagttcaccggcgccaaggcccgggcgatcgtgagcgtggcacgggcgatcgtcgacggccggctggatgcagccgccatggccgcggccgacacgccggaaatccgcagccggctgaccgccatctcgggcatcggcgactggaccgcagactgggttctggcccgcggcctgggccggccggtggtcgcgaccggtgatctgggcgtgcgcaaggccgtggcccgcgcctatcacgatgccgagatcattcccgcggccgaggttgcccgcaccaccgcccattggggggaagccgccctcgacgcccagacgctgctgctctccaccctcggcgccgccggggccgagggcgccaccccgcggcttgcccgcaagcgggccgccgtcacctcgccggaggagaaacgcccatgagcggccgtatccaccgctacaccgccgaaaccgtctggaccggcgataccggtcaggggacggccggctaccgcagctattcccgcgatcacgacctcaagatcgcgggcaagccggtcatcgccggctcttcggacccggccttccgcggcgacgccacgcgccacaacccggaagacctgctggtcgcctcggcctctgcctgccacatgctctggtatctgcatctggccagcacccggggcatcgtcgtgcgcggctataccgatgccgccgagggcgagatgaccgaacgcgccgatggcggcggcgccttcacccgcatccggctcaggccgcgggtgaccatttccgccggcgatccggccgtggcgcagtccctgcatgccgaagcgcatcatctctgcttcatcgccaacagcctgagctgtccgatcgagatcgaggatacggtcgaggtcgtcagcgcctgagcacgagccgagccctcttgcggagcacgtcttgaagatccggatcgatatcgacagtctgctcgacgagatcgccccttcgatcgtcagccggggtgagcgctaccaccacgatggccgcgtgaccatcctcgacgccgatccccaccgggtgctggccagggtggagggcacggagccctacatcacccgcctgttcatcgaccgggatggccatgtcgatggcgactgcagctgcccggcctatgaaaattacgggccgtgcaagcatatggtcgcggtggggctgaccatcctgaagacggggtttcagcccgatcccgagatcgcccggacccgggcgcggatccgcacccatctgaaaagcctggacgtcgacaccctggtgggaatcgtgctcgactgcgcgcttaccgatccggagctttatcgcaggctcgatctgaccgccttgcctggcgatgagagtgacgacgacgccttcacgcgcctcgcgaaggtgatcgacgctgcgctgcccgacgtggaggatgatggctgggtcgatgcggatatggccgagggctggacattatcgatcgatccgatcctgaccgccctgcagaccatgatcgagaccggccgcgctgagctggcccgacgcctgatcgatcatgtccatgccgccgcctgccgtctgatcgtcggcattgaaggcgacaacacgccagtcatcgagctgttctccaggttggaccagctgcatctggccgcctgccgggcagcagcgccgccgcccgtcacgctggcggcgtggcttttcgcgcgcgatatcatcgcaccggaagagatcggcagccgtacgattgcgggttacgcagatctcctcggccccgaaggccttgcgagctggcgccggctcgtcgccgaggcctgggctgccgaaccggtgattgcccccaggcctgatagtggcacgctcccggagataccggcgcggcgcctcgcgctggcgcggatcatggagcagatcgcggaggctgatggcgatgtcgaggcccggatcgccatccgggccagaaccctgacatcgcccgccgactatcggaaactggtggagttctgcctggaagccgaccggcccgatgccgcccgacacttgctggacgaggggatctggctgtttgagggcaggaagcaacttgtccgggagctgatcaccctcaagaccaggctaaagacgcccgccaaggcgtcgtcaccccctgcggatgcagagatccaggcacgtacggatcggatcgaagcgctgatcgcgaccgggggcaggccagcctatgaacaggcctgccagctgctgaaacagttggcaccgctgaggagtcccgccgctcatgcgacgcatctggacgagatcaggcggcgctaccgcagccgtcgggtactgatgagcctgctcgacgtctgacccgcatcagccgccgtagatctgcccctgcgcgaccgagatccagtcgatgccggcaccgccggtcacgcgctccagtgccgtgtcgtcgatcgcgccgtcggggccgaccgcatcccgcgccgcctcgatccgcgccagcacctcggaggccagggcaaagccgtgggcatcggccgccgcggtcagcagggcgtcgcgggcggccggcgtcgccgcatcggccagggccgccgcaagccccggatcggcggcaagcagatcgacgagaagacgagcgctgtcatcggacattggggcgttcctgcaagctgggttgcggcccgacggggctggccggcggggaccgccggggcatgactgtcggctgacgttatcctagcatcatgccaggtacccggccgccagacgcaaccggccggtcgacactcgtcaaccggccgggaaaggtcgcggggcaaaagctcgtaggggcaggatcgcaggcgacggcgatcaatggatcgtcgccggcaccatctcgtgctgcaggatggcgccgatcgcagaggcgctgtcggccatcacggcgacgcgttcaccgctggcggaaaatacgccgaacatcacgccgccggcagtggtcaccgggcggacataggccacctgctcaagccccagcgccgcgaaggcttcgggcgtcatccggcggatggcggcgcgggccgcttcggccacatcggcaggggaacgggtcgtctcttccaggttgaagcggggcatgggatcagcctccttcgtccgcggccgtgccgggcaccggatcggtcgccctgtcgcccgcgatgggtccacgtctcttcaggataagcggtcagcgctcgtcgagcaggctgcccgactggcgtccgtccggctgggtcttgcggatcgagatcgtccgcaccgaggattgcggcagcggttgctccagatcgatatgaagcaggccgttgtccagcgaggcgtccatcacctggatgccgtcggcgagcaggaaggtgcgctggaactgccgggccgcaatgccgcgatggatgaactcccggccgtcattggcgtcgtcgtgctgccgcccgcggatcaccagctggttgtcttccagcgtgaccgtcaggtcgtccatggtgaaacccgcgaccgcaagcgtgatgcgcagccgccgctcgccgagtttctcgatgttgtagggcgggtatccgtcggagccggtcttggccagacggtccagcatgcgctccatgtggtcgaagcccagcatcatcgggtgattgaaagcggtgaaccgcgacatccctgacatctcctccgcgacagacgagcgagatccggatccggctgccgtggcggcgacctccttggggagcatccaccgcgcccggccggcgcgccggcaggtccgtccgacgggtggtctccggtcgctttctccgcccgcattccgggccggagacggcgttcaccggccgttccatcggttatctggagatagggaagctgagaggtccgttcaagaccaggcaggcgcggcaccgggcacgcgacatgacaccccgggcgacaacgcagcctgggcaacgacgaaaaagcccggtaccgaagcaccgggctttttcgaagatggtggagccaaggggagtcgaacccctgacctcttgaatgccattcaagcgctctcccaactgagctatggccccgaaacctgtctgatgccgttggctgcgtgtgaccggggtcccggtttccgctgccgtgcgccgtttggggcggcgcgccgtgcgtcagcggagcggaacatagtggccgcggccgggcttggcaagcggtttttttcacgccaccgtcatcttcgacgacagcggcaggaactgtgatgcaagcccctgcttttgcttacaaaaagccgtcccctgaaaccgaaaccggcgcccctgggtcgaggggcgccggtcgcgggatcagttctcgtcgtcctcgtcgccgagacggacgtcaccgacgtcatcgtcacccagctccgaggcatcttcgatgccgacatcatcctcgtcgtcatcctcgaaggcctcgtcgaagccttcctcgtcgacatcctccacctctgccggcacgaccttggccttgcgggcctgggccgcgcgctcacgggccagctcgtcggcctcccgtgcggcccggcgggaacgggtctcttcgatctgcggctgctcagcaccgcatttggggcatgtcaccggcgtgcggcgcatatcgtagaagcgcgcaccgcagctgcggcaggtgtgcttctgcccccactcctccttcgccacgcgaccacccttgatagctgttggacgtgtacaggaacgaattcacgggaacgggttgccggcacaaggggccggccatggtgatggcgcgatcgtgcgcgtcaccccgtcggctgcgtttgccacgaagcgccggggctgtcaaaccgctaaatgcgtccgggcagggttgcatcgccgacatcgccattcggtggggggcctgcgatgatgcacaggggcccctgctgtgatagaccagccccgaacctttcccgcttccgccccgcctttccggacaagggccccgtcatgacccatgccgcgccgcatcccgccaccgcccgcctctcccacgggctttcgggcgacgtcaccgtccccggcgacaagtcgatctcgcatcgggcgttgatgctgtcggcgctggcggtggggcgctccaccgtcgacggtctgctggaaggcgaagacgtgctcgcgaccgcggccgcgatgcgcgcgctcggcgccggcatcacccgcgaagagaccgccggtcccgacgataccccggccatccgctgggtgatcgacggcgtgggtgtcggcggcctggccgaaccggccgatgtgctcgacatgggtaattcgggcacggcggcgcggctgctgatgggcctgctcgccacccatccgctggtcgcggtgatgaccggcgacgccagcctgcgcaagcggcccatggcccgggtcgccaccccgctcgaaaaaatgggcgcgaagatcgtcacccgggccggcggccggctgccggccaccgtcatcggcacccgcagcccggtgccgatccgctaccgcctgccggtgccctcggcccaggtgaagtcggccatcctgctggccgggctcaacactcccggccgcaccgtggttgtggaaccggaagcgacgcgcgaccacaccgaacgcatgctgggggccatgggcgcccggatcacggtcgaaaccgaggccgacggcgcccgggtcatcaccctcgacggccagccggaactcagcgcccgcgacatgaccgtgccgggcgacccgtcctcggccgccttcccgctggtcgcagggttgatcaccgaaggctcggccgtcaccgtgcgcaatgtctgcctcaaccccggtcgcgacggattgatccgcaccctggtcgagatgggcgccgatctgaccgtcaccaacccgcgggatgtgggcggcgaaccggtcggcgatctggtcgcccgctcgtccgcactcaaggccgtgaccgtgcccgccgaacgcgcgccctcgatgatcgacgagtttccggtgctggccgccgccgccgccacggcccacggcaccagccgtttcgaggggctcgcggaactcagggtcaaggaaagcgaccggctgcaggcggtggccgacggcctggcccgtgccggcgtcaccgtgcgcacgggcgaggactggctggaagtagacggctgcggcggcccggtcccgggcggcaccgacgcggtcgtcacgcatctggaccatcgcatcgccatggccttcctggtgctgggcctggctgcacgcaacggcatggtggtcgacgacgatcggatgatcgccaccagcttccccggcttccgcgccctgatgaccgggctcggttgcgacatcaccgatctctgagcctgccggagcccgccgcgcatcatgacccggaccctcatccatccgccggtgatcgccatcgacggcccggccgcagccggcaagggcacgctcgcccgcaggctcgcagccgaactggggctgcgccatctcgacaccggcatgatctatcgggcggcggcaagccggctgctcgccggcggcggcgatccggacgacccggccgcggccgccctggcggcgcagacccttggtgccgacgatctcgtccgcaccgacctgcgggccgagcgcaccggggaaatcgcgtcgaaaatcgcggcactcggccccgttcgtgccgccctgctcgactttcagcgcagcttcggccgcaccgctccgggcgccgtgctcgacggtcgagacatcggcaccgtggtctttcccgacgcgcgcgcgaagatcttcgtgactgcctcgcccgaagcgcgtgcactcaggcgacacgaagagttgcggggcaagggggttgccagtatattcgccgacgttctggaagagatgcggctgcgagaccgtcgcgaccgggaacgagcggtggccccgctgcgtcccgcggacgacgcggtcaccctcgacaccaccgacatgtcggcggacgaggttttcgcggcagcgctcgcgcatgtcaccagccggctctgaccggccggggcagggcacgggccggatcgtcaccggatcgaggtttcgccggtcgtcgcccacccccacccgggggaggagcggcgtttcggcgcattgacgactgaagcccgcggcggccggacggccgggcgtcgcgatcctgtaaaccagcaaccggcggggatgcccgccgtatccgaacccccgtcggtcggaacccgccccacccggcagcgccggtcaaggaaccgcggcgttcagacgtccacgacggccccgacccgaagcggcaggatccgcaacggccggagcctcggcgggtgccggagcctctccccaggccagccaccgacgcccggatggccctggagccgaggttccccggcaggacgggtggagaggtaggagaacccatgatcaacaccagccccgcgcccgagaaggacgtcatgtcggacgagaatttcgaagccctgctggccgacagcttcattgcccaggatggcctggagggaagcgtcgttaagggtcggatcaccgccatcgagggcgaccaggtcctcatcgacgtcggcctgaagtccgacgggcgcatcgcgctcaaggaattcgcccagcccggtcaggagaccgagcttgcggtcggcgacgaggtcgaggtctatatcgaccggatggagaacgcccagggcgaggtcgtcatcagtcgcgagcgtgcgcgccgcgaagaggcctggacccagctcgaacaggcgttcaagaacgccgagcgcgtcaacggcgtgatcttcgggcgcgtgaagggcggttgcaccgtcgaccttcagggtgccgtggccttcctgccgggcagccagatcgacatccgtccggtgcgtgacatcacgcccctgatcggcacgacccagcccttccagatcctcaagatggacaagcgccgcggcaatatcgtcgtctcgcgccgtgccgtcctcgaggagagccgcgccgaagcccgcaaggaactgatcgagaacctcaaggaaggtcagatcctggaaggcgtggtcaagaacatcaccgattacggtgcgttcgtggacctgggtggcgtcgacggcctgctgcacgtcaccgacatctcctggcgccgcatcaaccacccgaccgaagccctgaccatcggtcagtcggtccgcgtggtggtgacccgcttcaaccgcgagacccagcgcatcagcctcggcatgaagcagctcgaggcggatccgtgggaaggtgtcgaggtgaagtacccggtgggcgtgaagttcgccggtcgcgtcaccaacatcaccgactacggcgccttcgtggagctggagccgggcgtcgagggtctggtccacgtctccgagatgagctggaccaagaagaacgtgcacccgggcaagatcgtttcgacctcgcaggagatcgaagtgatggtgctcgacgtcgactcgcagaagcgccgcatcagcctgggcctgaagcaggttgccgacaacccgtgggagaccttcctggatcgtcacccggtgggttcggcgatcgagggcgaggtcaagaacatcaccgagttcggtctgttcgttggtctcgacggcgacatcgacggcctggtgcacctgtcggatctcgactggagccgccccggcgaagaggcgctcaaggacttccgcaagggcgacatggtcaaagccgtggtgctggatgtggacgtcgagaaggagcgcatctccctcggcatcaagcagctcgacaaggatcccttcaccgaggcgacccaggacctgcgtcgcggccagaccgtcacctgcacggtcaccaaggtcgtcgagaatggtctggagatctccacggccgatggcgccaagggcttcatccgcaagtcggaaatcgcccgtgaccgccaggatcagcggaccgaccgctacagcgagggcgacaagttcgacgccctgatcaccaacatcgaccggtcgagccgcaagctcaccctgtcgatcaaggcgctggagatggcggaagagaagaaggccatggccgagttcggttcgtccgacagcggcgccagcctcggcgacattctgggtgcggcgctccgcgagcgcgagcggacccaggcggacgattgatccgatcccgcgccctgggcatctgcccggcggatcgatgagcgtcctgcggccggcccggagcaatccgggccggccgcagccgtttcaggaggcaggatcggcgattgccggcgcggatctgccgctgatcacacctgccgtcacaggattgacatcaattcatattatataaatctccacatcattaattttctctatgtggagccagccccatgtcggatccccgccgccctcgcgatgccgccgcccgactggacgagatcttcggcatcttcgcggcccgtggcgacgacagctatggcgaggcggtgagccagatcgagcatgccgtccagtccgccgagattgccgaggcgcagggcgacgccgatacgctgatcgccgcagccctgctgcatgacatcggccacatgatccaccgcgatgccgcagccgcctttcatgacggccgggacgacgctcatgaacgcctggccggcaaatatctggccgggctgtttccgccggcggtgatccggccgatcgagatgcatgtggacgccaagcgctgcctggtcaccaccgaacccgcctatgccgccgccctctcccctgtctcgcgccggaccctggagctgcagggcggcccgatgaccggggccgaggccgcggctttcctggccgatcctcacgccgccgacgccattgcgctgcggcgtatcgacgaagcggccaagatcgagggcgccggccgcgacggcgtcgcacgtttccggccgctgctggaacggctggcactcggcctctgatccccatcccaccctgcatgcccagtccgggagcgccccgatggcccgcaatgtcctgctgatcatggtcgaccagtggcgctgggatctttctcccggcctcggcaacccgctggtctcaacaccggcgctcgaccggctggccgcgcgcggcgtggtcttcacccgccatttcgcccagagcgcgccctgcggcccggcccgggcgagttttgccagcggacagtatgtcttcaaccaccgggtctttgccaatccggtgccgatggcggcggggcgccggctgttgcagcaccatctgcgcaccgccggcatcaccccctacatgatcggctacaccacggccgtgccggatccgcgcggccgcgaccccaaggatccggtcttccacggcccctcggtcgccgaaggctggcagatcctgcgcgagatggacgaggacaaggcgcactataccgcctgggcccgcagtcagggggccgatctcgatcccgactatgatgccggcttcgcccaccatctccgcgccggcgcgccggtcgaaacctctccccagcccgacgggctgcatgacagccgctggctggccgatgcggcggtggcgttccttgataccgcacccgagcggccctggctgctgcatctgggcttctaccggccgcacccgcccttggcggcacttgcccgccacctggcccgggtgcccgacgccccgccgctgccgccgatcgacgccgccgccgaggatgcgatccaccccctggccgccctgttccgccgggtggtgccggcatcgatcgcccatccgggcctggacggccccgcatccgccctgcccgccgccacggtcgccgccctgcgcaaggcctatctggccctgctggccgaagtcgacgaagaggtcgaccgggtgctggcggcgctggagcggagcgggcgcggcccggacaccctggtcgtgttcatgtccgatcatggggagcagtggggcgagcatggcctgttcggcaagcgcgccatccaccaggcctcgttccgggtgccgctgatcatcgccgacccgcggccgagcgccgatccgacccgcggcgggcggatccacgccatcaccgaacatgtcgacctgctgccgaccctgctcgactggttcggcatcgccgcgcctccgcaatgcgacggccgctcgctgctgggcctgatcgccggcgatcgcccgtcggactggcgggatgccgcggtctacgagcatgacttccgcgacaagctgaccggcccggttccgggcctcgcccgctcgccgcatgaggcacagttcaccgccatccaggacgagcgctgggcctatctgcacttccccgatgcggatcccgtgctcttcgaccttgaggcagaccccggccagacccgcaacctcgccgccgacccggccttcgcgcccatcgtccaccgcatgatgcgccgcctgctcgaccaccgcatccgccacgccgaccgtaccctctcagaggcgcgcgcggcaccgggcgggatgatcgggcggtggtagaccggcgcatcaccgccaaagcgaaagagactgccaacccgggggaaacccactctggccgaaggtgacgccggggatgggcggaaaggtctcgacatgtgctttcagccgttccgcccacgaactcgacggattgatccgtcgcatgagcagccggatcatggccgcgacggcgtagagacgagtttgcgccagattgtccccaataagatgatcgagaacagggacctcgcctgggcgcggaagtctgggctgatctgcaggaggtcgattccagagtcggccatgatgcgcgcagatattgcgcacgtgattgatcgcccggacaccgctggtgagcagcgtacggcgcggcagcccgtatgacgcggcaaggggatcaagatccgcgtcccgcatgcccgccatgaagtgcgacagcctgccaaaatcccagagctctacagccatccataagggcagcgggccgccatacttttgcttgaagtgtgaagcaaaagattccttggacgacagctcagaagcatcaagtttattgatccatcgctgatgatcggtcagctcgtccttcttttgtcgcgcaaatcttggatgaagcagatcagcacaccgatgcgcccacggatcgtatcggcccatttgcagcgcaacatcaaccctgaggccaatctcgatacgttcgatggcgtccaggaacagcagccggaacttcttgtcgaaaacgtagagatccagaacgcttgcaaagctggcacccgggcgaaactcatccagaacctggattacctccctgccggtcatcggatcgatgatcggtatcgattttcgcaggggataccaatacccgctcaggcggtaatacccgatccgttgaagtgccgcctccgctcgtggctcgtcggaaatgtcgaggccgcggccgcgcagcagagagagctgctcctgtatcgtgagatatggttttgaatagggaaccatcaccctgccccgatacaagaaaaccggcccgtacatccagaggatgcagaggggccggccgtgttgcttcgaatatagcgcgcgttgtacgcgccatcaagcagaggcgatgctgccacctgccaatgccagaaacgccgccaccaccccgatcccggcaagctcgggcaggcaggacaggcggacatcggccgccagaagttcggcagccgggccggcggcggtcagggggcggtgggccaggcgggggtcgtggccggtctcgccgtcgaaaacgatgccatagccgaggccggcggcggtcgcttcgcggatcatctcgcggctgcccaggctggccgccatgcggggggacaggccgatcgcctcggcggcgcgcaggaagacctgacgggtgaccgaactcggctcgcgcagcagcaccggcagccccgccagggcatccagcggcagcgggtcgccggaccgggcaagaggatccgccgccggcaccagcagggccaggcgctgacgccccagcaccacccccgccagccgcggatcgggctcgctatggctggcggcgatcaggtccacccggcaggccaggacatcctcgatcagctgaccggtattaccggtggacagccgaagctccaccgccggatgggcgtcggcgaagcgcttggccagccccatgatcgttgccggcgtgctgagccccagccgcaccagcccacccgccatggccggatcagaggcgaccgccgcctcagtgcggtccatcagcagcatcactgcccggacatgggccagcagcctttcccccgcctcggtgggcacggccccctggccgcggcgcagaaacaggcgcacgcccagctccgcctccagcccgcggatctgcaccgtcaccgccggctgggtcacccccagcgatttggccgccgccgagaaaccgccctccaccgccacggcgtggaaggcgcgcatctggttgaagttcatgctgcgggctccgactgcatacgtccgaatccataagtcatcttcataagcatgtcataggacatgcgtagagtttatgacgaaggcggcatccagaccgctccgaccgggccgatcccttccttcccgccatcccgaggaaccagcaccatgaccaccctccgtctgcgcgcgggcctcaccggccttgtggcgctcaccatcgcaggtgtcgctgccccggccatggcccgggtcgagttcgacctctggcatgcccattcccccgacatcacgctcggcaagaccatcgcccgctatgcggccgagttcaacgccgcacagagcgactaccaggtcaatgcggtcttcaagggcagctatgacgatgtgatcaacggcgccatcgccgccgcccgggccggcaaggcaccggcgatcgtgcaggtccatgcgccggcggcccccaccgtgatctattcaaaggccgcaaagccggtcgacgaggtgatggcggaagccggtatccaggtcgactggagccgctatatccagccggtcatcgccgcctatcaggaaggtggccaccagatcggcatgcccttcaacacctctaccccgctgatgtggatgaaccgcgacctgatgtccaaggcgggggtcgaggctgtgcccaccacctgggacgagctggaggccgccgccgtcaggctgaaggccgccggggtggactgcccggtcgtgccctcctggcaggaatggacgctgatcaagaactacgccttcatccaggacatccccgtcgccaccccggccaacggcatggaaggcccgggggcacgcctcgccgtcaacgacccgcgcatggtcgcccatctcgaccggctgcagcgctgggtgaaagacgggctgatgagctatcagggccgccagtggaccggcgcacacgaagccttctacgctcagcgctgcgcgatcatgctggaaagctcggccgggtatggcgggatctcacagaaggccaaattcgatttcgccgcggccatgctgccggtggaggccgaaaccaaggatcccaagaacagcttcatcggcggcgccgggctgttcgtgatgaacggccagacgcccgaggtctacaagggtgtcgccgccttcctcgccttcctggccgagaccccgcgccagctggactggcacaaggtgtcgggctatgtcccgatcacgctggacgcctacgaggccgccaaggccgaaggctattaccagaaattcccccatcaggaactggccatcctgcagctgacccgcggcacccccacgcccaacacccgcggcatccgcctgggctatctggttcagatcgacgagatcctgaacgaggagctggagaacatctggtcgatgaagaagaccgcagcccaggccatggatgacgcggtgcgccgcgccaacccgctgttggaacgcttcgagcgcaccatcggccagtaataccgcggggctgccccacccggccgggcggactcctgcgggtccgcccggcactacttatccccggattccccatgtccatccacaccccgcctgccggtgcggtcttccgcggccgcctgctgccctggctgctgcttgccccacagctggccatccttgccctgttcttcttccgcccggcggcggaagggctgcggcaggccttccatctggccgatcccttcaccggccgcggcatctatgtcgggctcgacaatttccgggcgctgttcgccgaacccgaatacctggacagcattcgggcaagcctgatcttcgccggtctggtggccggcatcgccatggcgctggccttcgtcttggccgccgcggctgaccggctgctgggggaccgcccggccctgcgctcgacgatcatctggccctacgcggtcgccccggcggtcgcaggcgtgctctggctgttcctgctgcacccctccttcggcgtgatcgcgcggctgctccacgaggcgggactggcctggaacccgctgctcgacggcaccgatgccatggcgctgatcgtagcggcggccgtatggaagcaggtctcctacaatttcatcttcttcttcgccgccatccgctcggtgccgaaatcgctgatcgaggccgccgccatcgacggggccggccccctgcgccggctgcgcgacgtggtctggccgctggtctcccccaccagctttttcctgctggtgatgaacctgatctacgccttcttcgacagtttcggcatcgtcgacgccatcaccgaaggcggccccggcggggccacccggctgatggtctacaaggcctatcgcgacggttttcaggcccaggatctgggcgggtcggcggcacagtcgatcgtgctgatggcgctggtcggcgtgctgacggtcatccagttcggctggatcgagcgcaaggtgtcctatgcccgcagctgatccgaaagccgctccgaaagccgcacccgcgggcggcatggtccgccgcgacccggtcttccgggcggtcgccgccggcgtcttcctggccggcgccctggtcatgctgctgccggtctggtatgccctggccatcgcctcgatgcccgaagacggtcgcctgtcgatcggcagcctgccgggccctgcgctgatcaacacgctcgccgctgtgatcctggatccggtgatccagcggcagctgttcaacagcctggtcatggcggcggcgatcaccgcaggcaagatcgcgatttcgctgacggccggctttgcggtggtctatttccgcttccgcggccgggcgctggccttctgggcgattttcctgtcgctgatgctgccggtcgaagtccggatcgtgccgacctatgcggtcgcggccgatccactggcgcccctgatcggaggcttgcgcctgctcggcatcgagatcgggctctcgccctcgctgctcgacacccatgcaggcctggtgctgccgctgatcgcctcggccaccgccacctttctttatcgccaggtcttcctggccgtaccggcggatctggtagaggccgcccggatcgacggcgccgggccgctgcgcttcctgcgcgacgtggccctgccgctggcagcaccggcgacggcggcgctggcggtcatcctgttcgtctatggctggaaccagtatctctggccgctgctgatcaccaccgacgagcggatggcaaccgtggtgatgggggtggcacgcaccctgcccaccgacaacgccgaaacccgttgggggctgaccatggggcgggcgctggtcgcgatggcgccgccggtgatcctggttctggttctgcagcgccggcttgtggccgggctgaccgatgtcggcaagtagcgcccccggcgcttatccccttggccggcaagggtccaagcggctatagatgtcgccgaggcgccgccgccgggcggcgcgggaccaagccggaaggaagccgaccccatgtctccgttcgatgcgtctccgttcgacgccgaccgtgcggtcgatcgacgccgcctgaagcggggtctgaccttctggcgcatcgccgccatcgtgctggccgccatcctgggcggcatcgtcttccgggccacggatatcggtggcagcggcgcgttcaagggcgaccgcatcgccgaactcaccatcgacggcttcatcgccccggatgacgagctgtacgaccggctggacgaggcccgggaggatcccgcggtcaaggcgctgatcctgcgcatcgacagcggcggcggcagttcgatcggcggcgagttgaactacgaaaagctccgcgaggttgccgccgaaaagccggtggtggcggtgatggaaggcattgccgcctcggccgcctatatgaccgccctcggtgccgaccggatctatgcccatggcgagacgctgaccggctcgatcggcgtctatcttcaggcggtggaggcgaccgagctgctgcgctcgatcggcatcgaggccgatctgatcaaaagctcggtgatcaagggccagcccaacccgctggaagcgctgagcgacgaagcccgtgccgcactcgccgacgtggtggccgacagctacggctatttccgcggccttgtggccgatcgtcgcagccttgcgggcgaaaagctcgatgcggtggccgatggccgggtcttcaccggccgccaggcgcttgcggccgggctgatcgacggtcttggcggcaaaaaggccgcccttgcctggcttgaaggcgaaaaggggctggacgcggacctcccgatcgaggatatcaccccccgtccggaagacgggcgtgggctgctgggtgccgcggcggatgccgtggtcgaagccctgctcaaaaataccgaactgtcagaacggcttagagttgacggactggtatcggtttggcaacctcgcccctgacttgaacatgacggatgcatgaccgccggcgggccctgaatacggcccgcgaggacggtggcgcagtgccgccatttccggccgccgatcctgcggcccgccccaggcgcggcccgcttcacatgccttcaccagggaccatttaccaccatgaccaagtcggagctgattgcccgcctcgctgcgagccatccccatctctatcagcgcgacgtcgagcagatcgtgagcaccgtctttgacgagatctccgaagcgctggcgcgaggcgaccgggtcgagctgcgcggtttcggggcgttctcggtgaagcaccgccgctcgcgcaccggccgcaacccgcgcaccggcgatacggtcaatgtgccgtcgaagttcgtgcccttcttcaagaccggcaaggaactgcgcgaccgcctgaacggcgagtgaccccgcggccggtccacgcagagacgacgacgcgcgccacaggcgcgcgttttcggttatgatcggaccattgcggacctggcccccggtctccgtccgccggtttttgcccgttcgctcatccggaggatgtaaggccccatgctgcgcgccctgaaactcgccctgctcgccctgatcgcgatcatcgttgccgccttcgcgatcggcaatcgggatggcgtggtgctgtcgctgtggcccttcggtctggaactggccctgccgctgttcctggcgctggaggcgaccctgctgatcggcctggtgctgggcgggctggtggcctggctccgcgccggccgccaccggacccgcgcccgccgcctggcccgccgggtggaagagctggagggagagctgcatcgcctgcgttccggcgctgcccgcccggccgctccggcggcaccggccgggcccgccctcggcacggcagaggccgccccccggcttgccggcagccgcgacgccgcctgatccgcacccgatacatggccgccatccggcctgcatcgaccggcctgtatcgacacaggcacccttgccccgcccctgcaccggccccatgtgacgctgcgacccgcagcggcgcgcccggaatggtataggaagcgggcttcggcctctggtataagcccggaggttcgcgacataccggaagaccatgagcaagatcacgcctccccgtttcgacaatccgctcttcgtcgccatcgacacgaccgatgccggccgcgccgcggcactggcccgtgcggtcgcctcgtccgccggcggcatcaagctcgggctcgaattcttcatggccaacggggccggaggcgtgcacgcggtgcgggcggctgcccccgatctgccgctgttcctggacctgaagttccacgacattccgaatacggtcgcaggtgcggtgcgcgccgtggcgccgctggccccggccctgctcaccatccatgcctcgggcgggccggccatgatccgcgccgcgcgcgaagcggcggcggaagccgccgaccggctgggcatcgccacaccgccggccgtggtggccgtcaccgtgctcaccagcctggacgataccgacctcatgtcggtcggccagcgcgggccttcgggcgatcaggtgctgcggctgaccgacacggcgctggcgcatggggcggcgggcgtggtctgtgcacccacggaactcgtccggctgcgcgggcgtttcggcgcccaaccgctgatggtggtgcccggcatccggccggccgatgccgcccgcggcgatcagaagcgggtcatgaccccggccgaggcccgcagtgccggtgccgacgtgctggtggtcggtcgcccgatcaccggtgccgacgatccggcggacgccgccgcccggatcgcccaagagattgcggcggccgaactgacgggagctgcctgacccatgaccgcgccggccggcccttcatccacctcatcccccgcgatcaagatctgcggcctcaaccggcccgacatgatccggacggcgatcgaggccggcgccacccatctgggtttcgtgcatttcgcgccctcgccgcgccatgtcgatcatgccgatctggcgcgcctggcggacggcctgccccgaggcggcccggccaaggtgctgctgacggtcgatgccgactggccggtgctggatgcagcggtggatgcgctgggccccgatctgctgcagctgcacggccacgagacgcccgagcggatcgatgcggtgcgcagccgctatcgcctgccggtgatcaaggcggccggcatcgccgatgccgccgatatcgcggcgctgaagcctttggccgccacggccgacctgctgctgctggatgcccgtccgccgcgcgatgccacccgccccggcgggctcggccaggccttcgactggcgcctgctttcaggcgcggaatttgcggcggccatcggccaaaccccctggtggctggccggcggtctgaccccggcgacggtggcggacgcgatcacccggacccgcccccagggtgtcgacgtctcatcgggcgtggaaagcgcccccggggtcaaggatcccgcagcgatccgggccttcgtttccgcggcgcgcgccgccttcgacctcaagacctgacagtcaggaacagccggttcatgtcgcatacacccaacacctaccgttccgggccggacgagcacggccgtttcggactgttcggcggccgtttcgtcgccgagaccctgatgccgctgatcctggagcttgagcgggcctacgaggcggcgcggcaggatcccggatttgccgccgagatggccctgtttcagcgcgactatgtcggccggccgagcccgctctatctggccgaacggctgacggagcatctgggcggcgcgaagatctacttcaagcgcgacgagctgaaccacaccggcgcgcacaagatcaacaacgtgctgggccagctgctggtcgcgaagcgcatgggcaagaagcggatcatcgccgagaccggcgccggtcagcatggcgtcgccaccgccaccatgtgcgcgcgcctcggcatggactgcgtcgtctatatgggcgaaaccgacatcgtccgccagaagcccaacgtgttccgcatgcgcctgctcggcgccgaggtgcgcggcgtgtcgtcgggcaccgcgaccctcaaggatgcgatgaacgaagccctgcgggactgggtgtcgaatgtcgacgacaccttctactgcatcggcaccgcggccgggccgcacccctatccgatgatggtccgcgatttccagtcgatcatcggcgaggagacgaaggcccaggttctggagcgcgaaggccggctgcccgacatgctggtcgcctgcatcggcggcggttccaacgccatcggcctgttccatcccttcctcgacgacgacggggtacggatgatcggcgtcgaggcggcgggccacggcatcgagaccggcgaacatgccgcctcgctggccggcggccgtccgggcgtgctgcacggcaaccgcacctatctgctgcaggatgccgacgggcagatcctgaacgcccattcgatctcggccggcctggactatcccggcatcggccccgagcattcctggctgcgcgatatcggccgggtggaatatgcggccgtcaccgaccgcgaggcgctcgacgccttccagctctgcgcgcgccttgaaggcatcctgccggcgctggaacccgcccatgcggtggcgcaggtggtcaagaccgcccccaccctggcccgcgacgccattctggtgatgaacatgtgcggccgcggcgacaaggacgtcttcaccgtcgccgaagccctgggagtggacctgtgagcgccatggctgagaccctcgaccgttccgccgtgccgggtggcaccgcccgcatcgatcgccgtttcgcggcgctgaaggccgaaggccgggccgggctggtcaccttcgtgaccgcgggcgaccccgatctcgacaccggcgcccgggtgctggccgcgctggccgaagcgggtgccgacgtgatcgagctgggcgtgcccttcaccgacccgatggcggacggcccggcgatccagcgggcggggctgcgtgccctcgccgcaggcgtcaccatgatcaaggtgctggacatggtccgtgccttccgggcgaccgataccgatacccccgttatcctgatgggctattacaatccgatctacgcctatggtgccgagcgcttcgccgccgatgcgatggccgccggcgtcgacgggctgatcgtggtcgatctgccggccgaggaagaggaggagctggtccgcttcaccgatcccgcgggtcttgccctggtccgcctggtcgcccccaccacctcggttgagcgtctgccctcggtggtcgggcgggcgagcggcttcctctattatgtctcgatcaccggcatcaccggcaccgcctcggcagacatctccagggtggcaccgtcggtcgcccggattcgcgcggcgagcgaattgccggtggcgatcggtttcggtataaagactcccgaacaggcagccgccttcgcggcgatcggtgatgccgtcgtggtcggctcggcgatcgtgcaggaggtcgaacaggcggtggccgacggcgcgcctgaaaccgcgccggaccgggtccgcgatctggtcagccggctggcaggcggtgtgcagagcgctgccgcccgcgcctgacggcgacgtccgtgacccgccccgccccaggcatccgaacggagaccccaaccgcatgagctggctgtcgaacttcgtccgtccgaagatccaggccctggtccgcaagcccgacgcgacgccggacaatctctggcacaagtgcccgtcctgcgagcagatgatcttccaccgcgatctggtggaaaatctgcatgtctgcaccaattgcggacatcacatgcgcctgccggcgaagcagcggctcgccatgctgttcgacgacggcgcctatgaccggatcgacacccccaaggtgacggccgatccgctgcgcttccgcgaccgcaagcgctataccgaccgtctgcgcgaggcccaggccaagaccgacgagaccgacgccatccaggtgggcgagggccgcatcggcggcgtgccggccgtggctgcggtgttcgatttcgatttcctgggcggatcgatgggcatgggcgtgggcgaaggcctggtcaaggccgccgctgtcgccgtgcagaagaagcgtccgctgatcgtcttcccggcctcgggcggtgcccgcatgcaggaaggcgcgctgtcgctgatgcagatggcccgcaccacggtcgccgtcgaccgggtgaaggaagccggcctgccctatgtcgtggtcttcaccgacccgaccaccggcggcgtcaccgcctccttcgccatgatcggcgacatccacatctccgaacccggggccctgatcggctttgccggccagcgggtgatcgagaccaccatccgcgaggccctgcccgagggcttccagcgcgccgagtacctgatggaacacggcatgctcgacatggtggtgccgcgcaacgcgctgaaggaaacgctggcccggacgctgaagctgttgctgaagctgccgccggtggcagcccccaagcccggcaccgcgcttgcggagccggtgaccaacaccgtcaccccgccgcgcaagcccgccggcaatgccacggccaggcccgccgaggcgacaccgcgtgccgagcccgccctgggcacggctgcgaccgacgagccgcgcaaggcctgatactgcgcccgggccccgaaggcccgggtgccatccgacgtgaaggggctgccggcccatggatgacagcgccaccatcctcgaccggctgggccggctgcacgcgaccgagatcgaactcggtttcgaccggatcctgcgtctgctcgccgatctcggcaatccgcaggaccggttgccgccggtcatccatctggccggcaccaacggcaagggctcggtggtggcctgtctcggggcgatcgcccgcgccgccgggctccgcgcccatgcctatacctcgccgcatctggtccgcttccacgaacgcatcgcccttggcggccggccgattgccgaaccggttctggcccggctgctggcccggatcgaagaggtcaatgccggccgcccgatcaccttcttcgaaatcaccaccgcggccgccttcctcgccttcgccgaaaccccggccgatctggtgatcctggaaaccgggctcggcgggcgactggacgccaccaacctggtcgcccggccggccgcggtcggcatcacccgcattgcgctcgaccacatggaattcctgggcgacaccccggcgctgatcgcggccgaaaaggcggcgatcatcaagcagggtcgccccgccgccaccgtcgcccagacgcccgatgccgccgccgtcatccgtgccgccgccctgcgcatgcaggccccctttaccgaaggcggccgcgactggcaggcctcgctcgacacggaccggctggtgatcagcggcggcccggctgcgggcgcctggccgctgccggccctgatcggcgaccaccaggcctggaatgccggtctcgcactcaccctcgcccggcttgccgccgcggacataccggcactggcgccgctcggtcgggccgacgccctggccgaagggctgcgcaccacccgtcatcccgggcggctgcagccggtgacggcagagatcgcccgggcgctgccggcgctcgatccggccggtcggcacgagatctggatcgatggcggccataatcccgatgcggtggatgcgctcgtccgccacaccctgggcccctggtcggaccggccgctgctgatggtgctgggcctgctcgcccgcaaggatgccacagccgtgatcgcggggctcgcgccgctcgccggccgggtccggctcgcgaccatcgccatacccggtcatccctcgcatgacccggacatgctggccggtctcgcccgccgggcggggatcgacgccgcccccgccgcaggctggcaggccgcgatcgccgccgccgatcccgacatcgcccaccgcatcctgatcttcggctcgctctatctggtcggcgatgtcctcgccgccgtggaaaccgccgatgccgaggctgccgcctgacccgtgcccgatctccgttcaggatctgcatccatgactgccatacccgccttttccgtcgccgatctggggcacgtcgccatcgcccatgccctgctgccggcagaccggcccggcgggctgccggtggtgttcgtccacgggctgtcgatgcaggggcctgaatggcctgcggccttcctggacgagcttggtgcagaccatccgatcctgctgctcgacaatcgcgatgccgggctctcttccgccttcggaccggtggtgctgggagagccggacgccccgccgccccaggcctacgacctgttcgacatggcccgcgacgtcatcgccctgctcgaccgtctgggcctcgatcgggtgcatctggtcggctattcgatgggtgggcggatcacccagatcatcgccgccactgagccggcccgcgtggcctcgctcacctgcctgtcatcgaccggcggccgccggcaggtggaagcgaaggccgatgtccgcgacgccctgggcgccgcccgggcggaacgcctgctccatgcccccgatatcgagctgttcgtcgcccagtcccgcctgctcgacggcacggcccttcaggcgtccgacgacgagcaccggcggcggatcacgcaggcggtcacccgcagctaccggccgctcggcaccggccgccagatggcggcgatcgagagcacgatggatcgccgcgaactgctgggccgcatcacatgccccaccctgttcatccacggcaccgccgacccggtggtggcgctggaccgggcgcgggaaggtgtagagcggatcccgaatgcccgcctgcacgtcatcgaggggctgggtcatctgatcaccgaggcggcgacgccactgttcctcgccccactcgccgcccatatccggaccgcggaagcgaccggttgatcacgaaaaactgtcctcgggcagtttcagctcggccggggactgccccaggatccagccctccacggtcgtgaccggcgccagccgcggctctcccgtgggtcgggccccggccagcacctgcagcatgcccatcagcccgaccacggcatcgaactggtcctcgccccgggcaccattgccgaagccgtcacccagttcggcaaccagcggcatgtcgatgacgaaatccagccggcgtgccgcttccatcagtgtcgcggcattggcggcacgatcgttgcggttgcgcttgctgccccggccattggccgcctgacggcccagccgtacccccagatggcgatggaaggccgccggataggcctcgaccacggtaacggtatggcgggcgaccagttcgcccagccggccatcgaagggccagagccccagatccagccccgcgcggcgggccgggatcagcagatgccgccagacatgggcggccgcacggccgacctgggcggggcccatggtccagaacagcggggccgccgcccgacgggcgatggtcgcatgctcgcagatccgccgcagatcgtcgggcccgtccagccccagccggcgggcaagctcggccgggccgccctgcccctgccccgggcggcgcggaaagaacggccgctcgggcgaaatctcctcgggccgggccgccggctcaagcccttcgggcgcggccgcgaagcggtcgagggcgtcggagaagcgttcggcccggagcagcccggcataggccgccggcaggcccagcaccacgtccagccccagcagcacccgcccaccccggctacgtccaccccgggcacgctcgatcagccgggtgatcaggctgtcgaccggccccaccggttccgggacacccgcggcatagcggccatcctccatccgcgtcgccaccgccatccagcgcttgcgggcatcgacgctccaatcggcatgaaccaccagatcgggcggcacggggcagggcggcccgcccgcatcggtgccggcagccagggccaggcggttggcggcaggcgccggggtgaacacctcctgttcccgcgccgagccgcgcagctgcacccggcccagcgaccgccaggcggcggtggccctggcggcaaaggtgccactggcgatgatccggtggccaagcgtcttgctcaaatcctccagccgcgccgcctcgttgatcgaccggtcgatggcggtgaactgcagccgttcggcggtgccgatattgccgaacatcacccgccccagatgcaggccgatgccgaaatcgacccgcggctcgccctcggccgcgcgttcgcggttccacaactccagccggcgctcggcatcgcgcgccgccgcaagcgccgcatcgcaggccgcctccacctcgtcgccatagaccgccagcgggaagatcgcgagcacgctgtcgcccatcagcgacagcacttcgccccccgcgcccagcaccggttcggccgcgcattcgaaatagcggttcaccagttccatgaaccggccgacgcccagccgctcggccatggcggtggacccgcgcagatccgacagaaagatcgccgccggaatcaactcgccgtcgccgcggcggatctggcccgacaacacccgccgaccggcatgctggcccagataggtcatcgccaccgtatccgatacctgggccgtgaaggccagccggcaggctgccgccagatgcacctgcagggccgaaaggatggccagatcgcgatcactgaacccgtcgggtgcgtcggcggcccacgaggcgagcacgccgttgccgccaagcccgctgccgaaggcggtggcggtggcgacatagtcggtcatgccctccgcgaccagatcctcgaacagcgcgaattcccggctcgcctcgggcccggtcagccggcggcgcatccagtgcatgtcgtgggtcagcatgtagttgagcggcgaccgctgccaggcctcggacacgccggtcaggccatgtgccatcaccatgcgctccaccggctgcccggcctgccagaagaaggacacggccgcaatcagcggatggagggtccggaaagcgagatacacccggcgaaccggcagaccggcctcgaccaggctgcggttcatgccgtcgaagacctgctcaaaacttccggcctggatcagatccccggccatccgccccgcgaccgtcgcgacgacggcggcagcctctgcatccagcggcatcgatgcgggcaggcgcagctgcaggcgtcccatcacgtcgtcgcggctgcggggggcgacgtcacggcgactgcgatcgggcatcggctccggtcctgatggcggcgcgcacaaggcgcaggaaggtctgggtgccgaccgcaagcacgggggccgcatcggcaccgccggtatcgtacagcagccggaccatggccggcacgtcgtcatgatcgatgggcccgtaaagcggcgcgtccggcccctgtcccagccgggccgccagccggcgatgcacgcccggaccatgaaccagcggcccgcgccgcccctgaagcaccacgccgtgggcaggaagccccgctatggcaagcgcgtcgatcagcccgtcgacatccttgtcgtcggtgaccgacagcaggacccgccagcccgcctgccccagccgggcaaggcgtccggcatccaggctcgccgcctgcaccgccgcctcccagccgatctcgcgcccgtctgcggtcgtggctcgcccccaggagggcaccgaagccgccatccggtccagcgcctcggcgaccacggctgccatggggtcgatctcgtcggccacaagcgccgcacgggccagcgccagatcctggcgcagccagcccggccggtcatcggccgcatcgaccggcggcgccccgacgaccagagcatcggcaagacggatccccgcgtccctgccggtcctggcggcggtggcggtcagaatggtccggccgcaccgcccatggatgtcgagcttctcggccgcgacatcggcgagtgtcggccccagccggtccagatgttcaggcaggatcgcggtcactacgccgatccgcgcccgaagccggccggcctcgtcatgggcagcgccccggccggtttcgatcaccagccggtcggccccgacctcccgcgcatgggacagggcgatggccaggaactggccgaagggcgacaaggcctcgcccgccggcaaaccggcggccagggcctcgaattgcggggcgagcgccgcatggtggcgcaggaaatcctccgccccgatcaccgcgccgtccaggcggatgcggtcgagcgcggtggtctcttcgggcgaggtgaacagcagggtccggcggccggcggccgtctcccccgccgcgatcaaccgggcggtactgcccttgcccttcgatcccgtcaccaggatcacccggtccggatcgggcatcagcccggcggcggcgatcagccccagcagccggtccggccggcgcagatcccggtcgaagcccggtctggccggacgtgccgccatggcaccggcatagatcgcatccagcgcgcatcccgtcgcggcaccggggtcgggcgccgcaggaccgccggacaaagcgaagcccgcaccgcccccggggacgatgcgggcttcgacagcgtttccggcaggaccggaagcggaagtcagccgacgaccgacttgatccacttcgccagatcgctcttctgcatcgcgccgaccttggtcgccgcgatctggccgcccttgaagaccatcagggtcggaatgccgcgcacaccgtatttcgacggggtctgcgggttgtggtcgatgttcagcttggcgatggtgaccttgccgtcgaattccttcgacaggtcttccagcgccggagcgatcatccggcaggggccgcaccactcggcccaatagtcgaccaggacgggcgtttcggacttcagcacatcctgctcgaacgagctgtcggtgacggtggcgatggccatgggagttgtcccctcaaatcgtgagcggccgcggaggccggcggaagccggcacgacgaggccggcgggcacgcttggctcaatgtagaaagccgcgcgaagacggtcaagcacaccgacctttgcgtcggatgcacggcggcaatccgttgatcgggcgcaattcaaccagggtgttccagaagatcgccgggatccggatccggggcccagcggtcgagcaggcggtccggcaggtgcatcagcgacggcccgtcggtccagaccagcgccgtctccacctgccggccgggatagatccggcgcagcaccgcacgataggcggccatctggcgcaggtagtgccgggccaccctgtccggatcggatggcggcggccggtcggtcttgtagtccaccaccagcacgcggtcggcagaaatcagcagccggtcgaccgcgccggaaaccacgcgggatccgatcacggcacccagcggcacctcggcacgcgagcccggcccgaagatcggcgcgaaatccgggtgcatcagcaccgcctccacctctgcggccagtccctcgacctcgtcgggtgccaggccatgggcgggggcggccaggaagcggcgggcggccccggcgcgggcttccggatccagatccggcagcacctgcagcaggcgatgcaccagccggccgcgccggaaatggcgcacgccggcgtcgcccagcggcgatcgggcgggcggcgggtcgtcatcgggacgcgacggcgccagcggtcgcgacggcaccggttcgggcggtaccccccgatcgggatgcagtgccgccggcaggccgaccgtcacgacgtcgggttccgccacctcggcggctttccgctcaacagcgccatcctgcgggcaggtgagccgccagccggggccggcaataccgcccggcagcaccatctccaccggtgccgccatccctgccaacgccccctgaaccagggcataccagctgtccgcgggcgcctcggtcttgccgtgccagccacagacatacagccggtcggccgcccgggtcatggcgacgtaaagcaaccggcggtattcctgccggtcttccaccgccgtcaccgcctgggcgtcgcgcaccgtgtcggagacatccgccgatccgggcgagatcagcagcatcggcgccggatcctccagccagaccggccctgccggcgggcgtggcaggcggatcgtgtcgggcaggaacaccaccggcgcctgcagccccttggcgccgtgcacggtcatgatccggacctcgtcgcggccctgctcaaggtcgcgcttgacctccaccgcactgcgcccgacccaggcgaggaagccttccaggctcggcggctcggtctgctcaaaggcaagcgccaggttcaggaactcgtcgatcgcatcctcggcctcgggaccaagccgcgccaccagccgctgccgcccaccccgggccgccagcagatcggcgtagaaatcataaggccccatccggtcggccgcgcgggccagcgtcgacagggtcccggccgcggcgcgaagctcgtcatccccgcgggcccgctcccgcagggcccggatcagcggcatccgtccctcgggcgtgcggcgatccaccgccgcccggtagagcgccgcctcgtccaggccgatgatcggtcccttgagcaccgccgccagggtcagatcatcctcgggcagcagcagggcgcgccccagcgccaccagatcggccacggcgatctggtcgatcagcgccatgcggtcgacacccgccaccggcacgcccgccatcttcagcgcccgggccatccggccgacgaaggcgttgcggcgctggaccagaatcagcacatcgcccgcccggatcggccggccctgcgcctccagcatctcgccctcgtccagccagcggcggagcgtgtcggcgatggcatctgccacccggcccatcggatcgtcctggggttcgcgcaccaccggcgccacccaggcatcgtccgggtccggcttttcggccaccgccagcggccagacttccaccaccccggcctgaccgatgcgggccgcctcgtgcctgagggtccggccgggttcgaccacgccgtcggccgccggctggcgggcgaagaccgcatccaccgcatccagcaccgcgcggaccgaccggaaggactggcggagttcgaccggccgccacccgcgcgcagccccggtcacccgggcctcgaaaaaggcctgcatgcgcttgaagccggccgggtccgcgcgctggaagcggtagatcgactgtttcggatcaccgacggcgaacacggtgcgggccagcggcaggccgtccgcatcgctgcccgcctgctcgtggaccgcaccgtcgccggcgaaaaactcttcggtcagccgctcgacgaccttccactgttcggggctggtgtcctgggcctcgtcgagcagcagatgcatgatgccgccgtcgagcttgtagagcacccagggcgcgatgccgggcgtatccagcaaccgccccgcccccaggatcagatcgtcataatcgagccgcgcccggatgcgcttctgtccgtcatacagttccgccagccggtgccccacccggagcagcgccaccgaggccgcgaccgtcgcagccgcgcggcgctgatcctccagctccaccatccggtcctgttcgcggcggagcgccgcaaaggccgctggcgccgcttcctgggtcgccttcaccatcagccgggcacgcggcttgcgctcggcggtcatggtggcgcccagccggtcctcgaagcgggtgacgcgctccgcctcaccggccgccagccagccggccagcgcccggccgcgcaccacatcgtccttgccggacgacgcgaccagggcctcggctgcggccttgagccccgcctcgtcgaagccgcccggggcacaggcggccgccagctcgctttcgggcgtcgcccgcggatcgaggtcatgggccgccgccacccgtcggcaggcggcctccagcgatcccgccgcggccacgatccggcccagccggtggcgttcgccgatcaccgtggtcatcagcccggcgaaggcctcggcatcgaacagggtcgccagccggtcgaccgccgcccccagttcggcatcgcccgccgcctcggcgaacagccgctcgcgggcgccggcgatcagctcggcggcatcgcgctcgtccatcagttcgaaatgcggcggcagcccggcttccagcgggaagcgccgcagcagcgactggcagagcgaatgaatggtctggatgttcataccgcccggcgtgtcgagcagccgcgcgaacagccgccgtgccgcggcgagttcaggagcttcgggagagcgcccgagcagagtgatcaactcctccatcagcagcccggcatccgccgtcgcccagcgcgccaggcggcccgacaggcgaagcgccatctccgccgcagccgccttggtgaaggtgatgcacaggatccgttcgggtgccgccccggccagcatcagccgcagcacccggtcggtcagcaccttggtcttgccggtgccggccgaggcacccacccagaccgacagggccggatcggccgcgatcgcctgttcccggctcatgcctcgtcctccccggcctgccattcctggacgcgggcgagatggacgtaatccgagtagcgcggggccgcccaggcgcgcggtcgggcatggtagggctggtcgggccggtcgaaggcggtgatcagccgcaccagccccgccgccgcatcatcgatcagcgcccgggcatccccgccgggcttgagcacgaagcgctgctccccggccggccgccggcccgacagccgccagaaggccagttccgacacggtcgcaccgggcacgccggcaaacccgccacgatccagaatggccgcctccagcggcagctgcggggccaacccgcgctgcacctccttggtcgagggcggtgcaccggtcttgtagtcgatgatcgcgaaggatccgtcgggcagccggtcgatccggtcggcgatcgccgacagcacgaaccgcccgccaggtgcatcaaaggcgaactcgccgcggatctcggtcagggtggcggaaatatgggcgcgacgggcgcgttcgatgccggcgaaccaggcggcgatgcgctcgaaacgcggccaccagaaggccagcaccgcaggcggcaggcgcagctcgtccgtaacccgtcgccccagcgccagcagccgctcgaccgcatcctcgggcagaggggcaggggccggcgcctgttcgcgcaggaaccggtccagcaccgcatggatgaaccggccgcgctcggcggcacccgggtcggcatccaccggatccagcgcctccagccccagaacatggcgggcatagacggcgtaagggtcgcgcatcagggtctcgatctgggtgaccgacagccggcgcggccgccggtcgaccggcggcaccggtgccggcgggccggggcgggggcccggcgccaccatgtccagcgcccgcgcccaggcgatcagcggtatggccacccgcgctgccgcctcggcccgggccagaccggcaccggcaatcaccgcatccagcctgagcagccagcgcgagggcacggtcggcgtgccgtcgaccttggccgagcgggtcaccatcacattggggctcgacagcagggcccaggcgtcatgcgccgacaggccgatccgccgttcggccggcgggaagcccgcctgccggcgcatggccgggctgagccaggggtcggggcccggatcacgcggccagtcgccctcgttcatcgcccccagaatgaccagatcggccgagagcagtcgcgcttccagcggacccagcacctgcaaccggggatggctgcgccagcgcggcctgagcgtgcgttcggccagcaaggccgacagcagggcgggatagcgcgcggtcggcacatcgcccagaacccccgcctcgtcgcgcagctccgccagcgcctgcatcagcgcctcgccggcctcgccgcgccaaagccgttcggcaccggtctcgggcagggcggcggtgccgcccgcggccatcgcctcggcaagatcggcggccgccacctcggccagcgcctcggccgcggcgacatgggcgtcgagcagagcatcgaacggcgcctcaccggccgtcatcgccgcggcgaaatcgccgagacaggcctccagccggtcgatccagggcctgagttccgcggccgcgcggcggatgcgtccggcctcgcgtgcctccccgtccgccagcgcgccgtcgagcgccgcgcgcagcccggcgatgtcggccgcgggccgtggcccgcgcagcaggctgcgttccagcagccgcccacccgcccggaaccgtcccggcgccaggccgccgccggccagcggatgcttcaccagggccagcagcggcaccggcgccatgcgctcggcggccacccgcgcgatcaggtccagaaacaccgccggtcccgacgacatcagcggccgtccggcactgtcgtcgatatccagcccccagcggcggagttcgccggtcacccggcgggcaaggcggcggtcgggggtgacgagcatcgccgtccgacccggcacttccagcgtctcgcgcagggcgagtgcaatggccgtcgcctcggtgcggggatccggcgcctccagccgggtcaacccctccagcgccgccgcccggacatgggagaggtcggcccagcggtctgtggtctccgccgggcggaaggcctcggccagcagcacccgccggtcgcggccggcccgcaccgccgccgccggcacaccgggccagaccggtatggccgcgggcctcaggcccagctcgtcgagcagtcgggtcaggccatgctggggatgggtcggatcctggcggatggcggcacgggtatcctcgtccggggtttcgtccagcgccggcagcaccaccgccccgttgggcaggcgggcgatcacccggatcagcgcccgcgtcgccgcctggctgccggtcgagccggccacgatgacggggtcggcgggcggcatggcttccagccgcgccgcctcggcccggatcagccggttgcggcggtcgatggcgtcgatcgcgcccgattcggccaggatctcgggccagaagcggcggacgatgtcgacgaaggccagcacctcctgccagtgcttcgcataggcttcgggcaccagccggtccaggcaggccagatccacatcctcgaccagcgcctcgtcgagcaggcgcgccagtgcatcggccagccgcgccgcttcatccagcgtcagggcctgaccgtgatcgcgggcgctccagcgctcgatcagccgcgccaaccgcagtcggcgggccagcggcgacatggccggcggcaggtccaggatgtcggcggcgctgccgggatcgcccgcctccgccagcatcagctcttcggcctcgacatcgccgagcggcttcagccgcggcagcaaggccgcctcgccgtcggcggcgatcagaaaggcccgggccagttcgtcgatcgcgcgccgggtcggcagcagcacggtcatccgccccagccggtccggatcaccatcggccgcggcgattagcccccgggccagcgcatccagaaagccggccccggccgggatgcgccagaccccttgcggccagcgggccatggcctcagccgatccggtcgtaccggccgcggaccacccggtcggccagtctgaccgcgtcgggcgtgcccacggcgacgaaggcgccgtcatggaccacgccgtaaagccgctcgcgctcgatcgcccgatcgaacagcaggttcagcgagaatttgccggcgggcgcgtcctcgaacagcgccgggctcaggatctgcaggccggaatagaggaagggggcgacctcgcgttcccgccggcggcgcaggcggccggtctggtccatgacgaaatcgccggtgccgccgacgctcagcgcatagggcatcggcaccagcagcagcagcgcatccatccgcccggcatcgaaggcgcgggccagcacctcggccgcgggccgcggaccgttcagaagcagctggtcggcattgctgacgaagaagggggcatcgcccagcagcggcagcgccttcgccacgccgccgccggtttccaacagatcctcttcgtggctttccagcagttccaccccggccggcaaccgcgggcgcaccgcgtccagatgggcgcgcatctgcccggcatgatggtaggtattgaccacgatccgacgcacacccgtctctgtcagccggtccaatgtccagtcgatcagcggccggtcggccacctcgaccagcggcttgggacgggtctcggtcaggggccgcatgcgggtgccgagccctgccgccagcaccatggccgtccggggcgcaccggcaaagcggatggggtcggtcctggtcatgcgggatctccttcagtcgtcgtcgtgccggccgcgtccggatcgcgcggccgggtgcagccgcgggcatcccagggcaaggtctcgtccagccagtcggccagcgcatgcagggcgggatgcaccagatcgcgctcgatcagcccccagacccgcggctggtagttcaggtagcgcggcttgccgtcgcgcagatgcagccgggcgaaaatgccggcgatcttcatgttgcgctggaccccaaggatggccagcgccgtgcggaaggtctcgccgtccagggcatcgcgcctgcgccgcagatagcgctccaccatcgcctcggccagatccggcgccacgtcgcggcgggcatcctccagcagcgagaccagatcataaccgggatggccgatcagcgcgtcctggaagtcgatcagccccacccgcgacagcccgcgccgggccggcatccacagcagattttcggcatgatagtcgcgcagcaccagcacctcgggccgagccacctggtcgatcagcggtctcagccggtcgaggaagcctgcgcgctcggccgcggtcgccgcgcggccgagcgcaagcggccagtaccagtcgatcagcagcagggcctcgcgttcaagcgtcgccgcgtcatagaccggcacatccagcgccgccgcccccggccggtcgtgcagatcggccagcaggtcgacggccgccgcatagatcgcggtctcgagcgtcgggtcgcggtccagcaccacccgcaccagatcgtcgcccagatcctcctgcagcacgaagccggtctcggcgtcggccgccagaatggtgggtgctgcatagcccatcgccttcagatgggccgccaccttcaggaaggggcgcacatcttcatgcggcggcggcgcgtccatcagcacggcggtctggcgatcgagcttcagccggtcatagcgccggaacgaggcatcgcccgccagcaccgtgcgttcggcaccgcgccagccggcacgggcgacgaagcgggcgcgatcgagatcgcgggcatcggtcgggaccggggctgcggaaggggtatcggtcatgagcatgtccgtggcggtgaaccgggcgcggccgggttcccagaggtaagatggccgagccgcgccgtccagtcgccggacgggtggagcgtgaccagccgtgcgccgtcgggcgcgatggcgatcgacaggcgcagcgcccccggatcgagccggccgccggcacgatccggccattcgatcagcgccagcccgtcttccgcggcctcccacagccccagctcgtcgatctcgtccggatcctcgatccgataaagatcggcatgaacgaccggaaggtccggcagatcatacagctggaccagggtgaaggtcgggctcggcacctcgatcggggcaccggcaagcgcccggatcagcgcgcgcgaaaacgccgtcttgccggcccccagatcgccgtcgagcaggaccatgccgccggcggccatcaccggcgccaggcgctgcgcaaaggcctccgtctccgcctcgcttgcgaggcggatcaccggcgccggggcaccggttccgccggtttcgggggcccgacagagacgggatcccgggccggcgccatggcggatcgtcatgcacatccgcgggttctagcctgtcggcgcggccgcggcaatggccgctttgcggcagcgacttgacaagggccaccggattgagtcacaagcctgtcttcgcgcgagggcgggcgacatccgccgccatcacccttgtgcggaacgtcacgccgatcgatcttcagcatcaccaccctggaacgggggccgatgccgggggccggccggcgcccgcccggtcgggcgatacggaccttcggcgacgaaggcatgtgtccccgccgatgggagcatcagaggccggcgatcgtcgccggcccgctccgagcgagacggaaaccgatacgatgttcgagaatctgaccggccggctcggcgaggtcttcgaccgcctgaagcgccgtggtgcgctgaccgaagccgacgtgaccgcggcgctgcgcgaagtgcgcatcgcgctgctggaagccgatgtcgccctccccgtcgtcaaggacttcatctccgccgtgcgcgaacgcgccgtcggccaggaggtgctgcgtggcatcaaccccgcgcagatggtcatcaagatcgtccacgatcatctgacggacatgctgggcggcgacgcggtcgaggtcgacctgaacgcgccggccccggtcgcgatcatgatggtcggcctgcagggctcgggcaagaccaccacctccgccaaactcgcccgccgtttccgcctgcgcgacaagaagcgcgttctgctcgcctcgctcgacgtctaccgcccggcggcgcagcagcagctggaagttctggcgaagcaggccgaggtcggcagcctgccgatcgtcttcggcgaaaagccggtggcgatcgccgagcgcgcgatgaagatcgccgcccgcgaaggctatgacgtcgtcatcctcgacaccgccggccggctgcatatcgacgacgtgctgatggacgaggtcgcggcggtcaagtcgaaggcccgcccgcacgaaaccatcctggtcgccgacgccatgaccggccaggacgcggtgaccatcgccaagacgttccaggaccgtgtcggcctgaccggcatcgcactgacccgcgtcgacggcgacgcccgcggtggtgcggcgctggccatgcgttcggtcaccggcaagccgatcaagctgctgggtcagggcgaaaagctcgaccagctcgagaccttccaccccgagcgcatcgcctcgcgcattctcggcatgggtgacgtggtctcgctggtggagaaggcggccgagaccatcgaccgcgaagaggccgaaaagctcgccgccaagatccagaagggcacgggcttcgatctcgacgacatggccaagcagctgcgccagctgcgcaagatgggcggcatgaagggcatgctcggcatgctgccgggtgtcgccaagatgaaggcgcagctgaacgacgccaagctggacgagaagatcctggttcgtcaggaggcgatcatcatgtcgatgacgccgaaggaacgccgcaatcccgagatcatcaaggcctcgcgcaagaagcgcatcgccgccggctcgggcagcagcgtccaggacgtgaacaagctgctcaagcagcaccaggacatggccaagatgatgaaacaggtcggcaagctcggcaagaagggcatgatgcgcggcggcctgcagaacctgttgccgcgcatgtgatccgggccattccgccccgcctcatcccgcgcgcacgcttcccaagatccccgtctttccaaagaagacaccacctccgatacaggaccctccatccgatgtccgtgaagatccgcctgacccgcctgggtgcgaagaagagccccgtctaccgcatcgtcgtcgccaattcgcgcaacgcccgcgacggcgcctatatcgagaagatcggcacctacaacccgctggcggccaaggacgatccgaaccggatcgtgctgaacaccgagcgcgcccagtactgggtcggcgtcggcgcccagccgaccgatcgcgtcgcccgcttcctggccgccgccggcatcatcgccaaggtcgaccgcagcaacccgagcaagggcaagccgaaggcgaaggcgcaggagcgcatgaaggaagcggccgccgccgctgccgccgccgaagccgctgccgccgaggcctgatccgggccaaggcttccggcccgatccatagagggaacaccgttcgtccatgtcccgccccggacgtcccgccggccccaccgggggccgggctgccccgccgcagcccgccccggtcgatccggcagaactggtctgcatcgccgagtttgccgccccccagggggtgcgcgggctggtgcgtctgcgcccgttcaccgaggatcccgaggcggtggccgattacggccccctctatgaccgcaccggcacccgcgccttccgcatccgcatcaccggcccccacaaggtggggctggtggtgaaggtggatggcgtggacgaccgcgatgccgccgccgccctcaccggcacccggctccacgtcccccgctccgccctgccggcgatcgaggatgacgaagagacctggtatcaggccgatctgatcggcctcgaggtggtggatcaggcgggcgccgtggtgggccgcgtgcgggccgtccacgatttcggcgcgggcgacattctggagatcgaccggccgggcgaccgggcatcgatgatgctgcccttcacccgcgcctatgttcccgaagtgtcggtcgcagccggacggatggtgatcgatccgccggaggggctggaatgagcggccccgcggccggggacgggatcgaggacggcaggggcgagagtccctggtctgccgaaatcctgaccctttatcccgagatgtttcccgggccgctggggcattccctggcggggcgggcgctcgaccgcgggctttggaagctcggcgtcacgcagctgcgcgattatggtctcggccggcatcgcgcggtcgacgatacgccgtccgggggcggtcccggcatggtcatgagggccgatgtcctggcccccgcgatcgatgccgcgatcgaaaaatgccccggccacgccttgatttacttgactccgcgcgggcaaccgcttacccaatcgcggatcagacgtctggccgccgggcccggcgtcattgtcctgtgcggccggttcgaaggcgtggatcaacgccttctcgatgcccggccgttcgaggagatctgcctcggtgatttcatcctctccggtggggaactcgcagcgttggtcatgatcgacgcttgcgtgcgcctgttgccgggtgtcatgggggcccatgcctcccaggcagaggaaagtttcgaggacgacctgctcgaatacccgcactacacccgtcccgatgtctgggaagggcgcgcggtgccggaggttttgacctcgggccaccacgagcggatccgggcctggagacaggaccgggcagaggcggtgacgcgggagcgacggcccgatctgtgggcgcggcgtgaggcgcgccgccgcggcagcggcggcgggacctgacgccgcgcaaccttgccggccccggtgtttcgtccgggcaccgtcagggtcgccggaagaagctgaagaccgaagacgctgaagacctggaagacccccggatcatccgggaaagcattgacttgaaactggcctgcgcccggggcgcggcccccaacatggcgaaggcaggcggcccggtccgcccgccggatgtcgaaagaggtagggtgcgatgaacatcatccagcagctcgaacaggagcagatcgcgcagctgaccgccgcccgcgccgtgccggatttcgagccgggcgacacggtgcgcgtgaacctgcgcgtcgtcgagggcaaccgcgagcgcgtgcaggcctatgagggcgtgtgcatcgcccgcaagggcggctcgctgaacgcctcgttcaccgtccgcaagatctcgtatggcgagggcgtcgagcgcgtgttcccgctctacagcccgctgatcgagagcatcgacgtggtccgccgcggccgcgtgcgtcgcgcgaagctctactatctgcgtggccggaccggcaaggccgcccgcatcgccgagcgtcgcgacacccgcggccaggccgccggctgatcccgcaaggggccagcagtcgcagggcttcgaaccgccggccgtccttcgggatggccggcggttttcgtttgggggtcgcccccgcgtcgccctcccgcagggcatcgcccacccgccggcgggggcaggacggccaaccggaatgcccaattggtataccaaaatggggccccacctgttaacttattgaatttaaacatttctttccgcttcccaagggcgcgatgacatattattcttgccgtcgaagcagccgatgcgacgcaatctgtcgcgcagcggaaatcgccgccgtcaagacggcccgctgaccgcccaagcgtgaacgaggaaccgatgtccgccccacgtaccctgtacgacaagatctgggagagccacctggtcgagagccgtgaggacggttcggccctgatctatgtcgaccgcatgctcatccacgaggtcacgagcccgcaggccttcgagggcctgcgtgtcgccggccgcaagccgcggcgcctcgacgcgctgctggcggtggctgaccacaacgtgccgaccgtgcagcgggcccagggcatcgcggatccggtctcgcgcacccaggtcgagacgctggaagagaactgcgcccatttcgacgtgccctatttcccgatcatggacgaccgtcagggcatcgtgcacgtgatcgggcccgagcagggcttcaccctgcccggcacggtcatcgtctgcggcgacagccacacctcgacccatggtgccttcggcgccctggccttcggcatcggcacctccgaggtcgagcatgtgatggcgacccagaccctggttcaatcgccgtcgaagaccatgcggatcaatgtcgagggtgatctgccccagggtgtgggccccaaggatatcgtgctcgcgatcatcggccgcatcggcaccggcggcgccaccggccgcgtggtcgaatatgccggctcggcgatgcgcagcctgtcgatggaaggccggatgacggtctgcaacatgtcgatcgaggccggcgcccgtgccggcctggtcgccgtcgacgagaagaccatcgactatctgcgcgaccggccgatgtcgcccaagggcgagatgttcgagcaggccgccgcctattggcggacgctggtctccgacgaaggtgcggtgttcgacgacgagatcaccatcgatgccgccagcatcgtgccgcaggtgacctggggcaccagcccgcaggatgtggcgccgatcaccggcaccgtgccgaacccggccgaggtcgccgaccccatgcgccgcgcggccatggagcgggcgctgagctatatgggcctcgagcccggcacgccgcttgctgccgtgccggtgcagaaggtcttcatcggctcgtgcaccaacggccggatcgaggatctgcgcgaggcggcagccatcgcccggggccgcaaggtcgcagagggcgtgcaggcgctggtcgtgcccggctcgggcctggtgaagaagcaggccgaggccgagggtctggacaggatcttcgtcgaggccggtttcgaatggcgcgaagcgggctgctcgatgtgccttgccatgaatgccgaccggctgggcgaaggcgagcggtgcgcctccacgtcgaaccgcaatttcgagggccggcagggccgcggtggccgcacccatctgatgagcccgtcgatggccgctgccgctgccatctccggcacgctcgccgatgtgcgcgccctctgagccccgctctctgaacttccggccgaaagcctgatcccatggacaagttcacgaccctgaccggcatcgccgcgtccttcccgcgggtcaatatcgataccgacctgatcatcccgaagcagtatctgaccaccatcaagcgcaccggcctgggggtcggcctgttctcggacgtccgctatgatcgcgacggcaacgagaccggcgatttcgtgctgaacaaggcgccgtggcgcgaggcgaagatcctgctcgccggcgacaatttcggctgcggctccagccgcgagcatgccccctgggcgctgctcgatttcggcatccgctgcgtgatcgcgccgagcttcgccgacatcttctacaacaactgcttcaagaacggcatcctgccggtcaagctggacgaggccctggtgcagagcctgatgccgctggccgagaaccccgagaccgcggtgatgaccgtggatctggcggcgcaggagatccgcgcccagggccgcgagccgatccgtttcgagatcgacggtttccgccgtcactgcctgctcgaaggcctcgacgacatcggcatcacgctgacctcggaagaccggatcactgccttcgaggcgaagcagaaggccgcccagccctggctctacgccgccggctgaacgaccgatccgacccttgaggagggccgcggcgggaggcaaaacccggccgcggccgtcttcgatgcgacgaccgctcccccagacgatcgccccccattcgagacagaaagacggacgcgacacatggccgccaacaagaagctgctgatcctgccgggtgacggcatcggccccgaggtgatgggcgaggttcgccgcatcatcggctggttcgaaaaggcccgcgggctctccttcgatatcgcagaagatctcgtcggcggcgccgccatcgacgcctacggcacgccgctggcggacaagaccctggacctcgccatgggcgccgatgcggtgctgctgggcgcggtcggcggcccgaaatgggagccgctgcccttcgagatccggcccgagcgcggcctgctgaagctgcgcaaggaaatgcagctctacgccaatctgcgcccggcgatcgtcttcgacgagctggccgatgcctcgacgttgaagcgtgaggtggtggcgggcctcgacatcctgatcatccgcgagctgaccggcgacctctatttcggcacgccgcgcggcgtggagaccctgcccgacggtacccgccgcggcatcaacaccatggtctacacctcgccggaagtccgccgcgtgacgaagatcgccttcgatctggcccgcaagcgcggctcgaaggtctgctcggtcgacaaggccaatgtggtcgagaccaccgagatgtggcgcgaagaggtcatcaagctccacggcgagggctatgaggacatccagctcagccacatgtatgtcgacaatgccgccatgcagctggtccgcaatccgaagcagttcgacgtgatcgtcaccggcaacatcttcggcgacatcctgtcggacgaggccgcgatgctgaccggctcgctcggcatgctgccctcggcctcgctgggcgatcccgacgagaccggccgccgtcgcgccctttacgagccggtgcacggttcggcccccgacatcgccggccagggcatcgccaacccgctcgccaccgtgctcagcttcgccatgatgctgcgctattccttcgacctcgacgaggcggcgaaccaggtcgagcagtcggtccgcaacgtgctggcgcgcggcctgcgcaccggcgacatcatgcagcctggcatgacccgggtctcgacccaggccatgggcgaggcgatcgtcgaggagctggcgaagctgggctgaggcaccacgccccggcccccggccggcccttgccgagacgatctttacgacgacagaacggcgaagcccttccatcggcagggctccgcccctatcttgcgcccgcaaggcatcggcgagtttcgccgctgcccggcgggcgcaatgccgttccggaccgcctcctccccgcaacgggccgaggcctccccgacggcgcttccgcccttttcagacgagatcgaaggaagacgtcatggccgatgtgatcgcggtgatcggtgccgccggtgccgccggacgcgaggtgctgcaggttctggcggcccgcggaatcggcgtcgaacgggtccgcgcgctggagaccgaggttcagcgcggcgacgccctcacctatggcgacgaccacgaagtgccgctcgtgaagcttgccgatttcgatttcgcgggcgttgcgatcgcgatcttcgccggcctgccggccatcgccagggtgcacggcccccgcgccgctgccgcgggtgcggtggtggtcgacatgaccggcgcctatcgcagcatcgacggcgtgccccaggccctggtgccggtgaacccgcgcgcgctcagggcctggagccgccaccgtgccgtcgcctgcccgccggcggccgccgtcgcgatcgccatggcactgaagccgctgcatgccctggtccctgtgaccgccctctccgccaccgtgctgcaatccgtttcgggcgccggcaaggcggcgatggacgagttgttcgaccagaccaaggacatcttcatcggcaaccgccgcgatcccgagcagtttccgaagcagatcgccttcaacgtgatcggcgccgaggccgacgatgccgccaccggccgcacgcgggaagagcacgagattgccggtgccatcggcgccctgctcggccccgccatcgccgcccggatcatcaccgcacaggtgccggtgttcatcggcgacagcatcgcgctctccgtcaccttcgagcgcgcgatcgacccggccgcggcctgggcggcgctgcatgacgatcgcgatctggcggtcaccgccccggtgccgggcggcgaggccgaccaggatgccgccaccaccccggtcgagatcgtcggcgaggcgccggtctatgtctcgcgcctgctgtcggaccggagcgatgcgcgcacgctcgatctctggatcgtggccgacaacctgcatcgcggccaggcgctgaccgcggtggaaattgcggaagccctgctgcgcgaccatctcaccccccgcctcggcagcacacccgaggcctgatccggagatccatatggggccggccgaccgtcttgatctttctgtgccggccttccgcccggccccgctccgcgacgaggcggtctatccggcaagcggcctgcgcccggccggattcgcggccctcgacggcgtcttcgacgatgcactctgcgatgcgctgatcgccgccttcgatgccgtgggcggccataccgcctctctggtcaagggcgtgcagtcggccggcatccgccgatcacgcgtgctgtggttcgacgccgagagcagccccgaccccgacctcaccgccgcggtcgaccggcggatggccgaagtgacggcccttctcaaccgcacccgcttcggcttcgccctcgacggcttcgacgaagccttccagatcgcccgctatgatgcggagatcgccggcggctatatccgccatgtcgaccgcggcgaaggcccgcgcgcccggcgccgcaagctcggcatctcgatccagctttcggcgccagaggaatacgagggcggcgacctgattctcgaaccccaggcggtgccgatcaccggaccccgccgccggggcaccgccatcgcctttccgtcctatgtcgtccacgaggtcacgcccgtcacccgcggctgccgctacagcttcgtcgcctgggtgcacgggcccggcttcgtctgagaccgcggccggcctccgatctttctcaggcgctgcgagccttggcgatcttgtgcagataggccatgtagccgatcgggatgcggctggcgccgtggacctggatgacagtgcctgagacccaggccgcctcgtcggccgccagatagacgcagatgcccgccacatcttccggcgtgcccaaccggcccagcggcacggtgtcgatctgcttctgtgcccgcggacccgacatgaattcggcattctcctccgtgaccaccacacccggggcgaccgcattcacccggatgttgcgatggccccattccaccgccatggtctgggtcaggttttccaccccggccttggcggcaccgtactgacccgtcatcgggttgggatgggagcccgagcgcgaggtgatgttgatgatcgagccgccgtcggtcatcgcccgcgccgccgcctgagcggcgaagaaggtcgccttcatgttgaggtcgaccacccggtcccactgcccctcgtcgatatcgatcagcgggccgacatcggccgggtcggcactgccggcattgttgacccagatgtccagccggccgaaagcctccagtgtccgcgcgacgatcgtctgggctgcgcccggggcggtgatgtcctgcggcaccgccagcgccgtaccaccggcggcacggatcgccgcgaccgtagcctccagcggcgcttcggcacggccggtgcagaccaccctggcccctgcctcagccagggcgtggctgatccccttgccgatcccacggccaccgccggttacgaccgcaactttaccgtcgagtgaaaacaacgccttacccttcctgagcgccgggcataccacatgcggatgtgcccggtcatttcacttgcttgctgactagctatcaaatacgctccgggcatgcaatccgaagattgccaagatcacgggagggaacaggaagatgaacggggcaaggatcctgcgcaccggcgctgccgccgtgctggggctcgcaatcggggccggcacgctgtccgcatccgcgacggagctgcgcatcgccagcgggacggtgagcaagaacgcgctcaatggcggcatgtacaagttcgccgagttgatcgcgcagaagaccgacggcacctataccggcaaggtgttcccgggcacgctgctctccttcgccgagatgaccaacggcgtacgcgatggcgtggtcgatgtgggctatgtgatccctgcctatacccgggcggaatttccccagaccaacctcctgatcgacatgtcgaccgcttcctccgatccggtcgtcatggcaggggcgatcaacgactacatgttctcgtgcgcgccctgcctgaaagaattcgatgccctgaaccaggtcttcctgggcttctctgtggctggcccctactacctgatgtcgacgaagaagattgcctcgctcgacgatttccgcggcaagaccatccgtggtatcggccccttcggccgctggatcgaggcgatgggcggcaaatcggtgctggtcacctcaacggatgtctacgaatcgctcaaccagggccagctcgacggcaacacccaggggctggacacgctgaagagcatgtcgctgggcgacatcgtcgactacgtgctcgacatcccgatcggcctctatctgggcagcgcgctctatgacgtgaaccgcgatgtctgggacgacatgacccccgaacatcgccgcgccttcctggccgcggcggccgagggccatgcttggaccacgatcaactacttcgccgagaacaatgtcttcctgacccatcccgaaaccggcggggtcgagatcgtgaaacccgacgaaaaactcgccgccgcttcggcagccttccgggaagcagatctcgacacggtcgcgaaaatcaatgccgagaaatacggcatcaccgatgcgaccgagcgggtggcgcggctgcgtgggctggtgaagaagtgggaggggctgatgcaggacgtcgacaagacggacgtcgccgccgtggccgcgatctatgaccgggagatcttcaccaggatcgacccctcggctctctgacgccccgcccatgaggaattccgtccgatgcgctcactcggccgcatcctgaaccggctgtcgaccctctcggccgcgatcggcggcgtcgccgtcatcctgatgatgctgcagatcgtggtcgacgttctgctcaagaacctcttcacctggccggtgccgctgaccgcgaccctggtcaccaaatggtacatggtcgcggccgccttcctgccgctggcgctgaccgagatcctcgaccgcaatgtcgcggtcgaggtgctcttccagcacctcacccgacgctggaagcggatcttgggcggtgccgtctgcctgctctcggccgggattgccggcctgatggtcgtaccgctctgggacgaggccatgaagcgcatggcggctggcagcttcatcgtcgagaacggcgaccggctgtcggtctgggaggcctatttcttcctgcccgtcgggttcggccttttcgccctggtcctgctctaccgcaccgtcatcctctggacgggcgccgaaagcggtctgaacgaggtgccgatcgataccgaccgcacggatgacgacatgaccggcaaggtgcatggctgatggacagcgagatcatcggcctgctcggcctcgtggtgttgatgggcctgctgatgctgcgggcgccgatcggcatctccctcatcgcggtgtccttctcgggcatctactacctgatcggcccacgtcccgccttcggcatgcttgcatcgctgccctacgatttcgcatcgaaatggacgctgtcctcggtgccgatgttcctgctgatgggcttcgtctgcttcaatgccgggctgacccgcgggctgttccagaccgcacgcagctggctcgcctggctgcccggcgggcttgccgtcgcctcggtctggggttccgccggcttcgcagcggtcaccggctcgtcgatcgcctgctgcgccgccatgggccggatcgcggtgcccgaaatgctgaaggccggctatcaaccggcactcgccaccggcacgatcgccgcagccggcaccctcggcgcccttattccaccctcgatcctgctgatcctgttcggcgtcttcgccgaagtgccgatctcgaaactgttcatcggcggcatcggcgcaggtctgctcaccgccctgctctacatgggggtgatcatctcggtagcggtgatccggcccgactatgccccccggatgcgagagcgccccgacatggcagagcggatgcggcagctgcgcgaaagctggcccgtcttcgccctgctggtgatcgtgatcggtggcatgttcttcggcctgttcaccgccaccgaggcgggggcggtaggtgccttcttcgcgatcgtcatcgccctgtttcgccgcagcatcgggcttgccggcctctggcagtcgatccgcgaaaccatcgtcaccaccgcgtcgctgttcctgatcgcggtcggcgccaatctgctgacccgcttcctgaccctgtccggcgccagccactacatcgccgacgccatcatggcgctgcaggccgacccgctgaccctgctgatcgggctgtcggtgatctacctgctgatggggatgtttctggatccgctgggcgcaatgctgctgaccctgcccgtgctgctgccggtgctggaccaggccagaatcgatctcatctggttcggcgtcttcctggtcaagttcctggagatcggcatgatcacgcctcccatcggcctcaatgtcttcgtgctcaagggcgtgctgggccggcaagtcccgctgaccaccatcttccgcggtatattgtggttcctggccgcagacttcgtggtggttgcagccttcatcgccttcccgggcatcatcacctggctgccggaactgatgggctgacaccaccgcccgccccctgacatcccccccgaccatccgccatccgaccaaaagctgagggcagacccgcgccatgcagaccgacatcgcctcgacggaccggaccgagccgctgggctcgaaacagaggcgccgggaggaatccgaccggaagatgctccgggcagcactcgcgctgatcgcgcgccacggcaccgtcggcgccagcatggcacagatcggcatcgatgccggctatagccgcggcctgccggtccagcgtttcggcaccaagctcgccctgctcgaagccgtgatcgatgcagtgcaggaccgtttcctgcgccatgtcgaacgccgtaccgccggcaagcgcggctgtgcggcgctggtcgagaggatcagggtccagatcgaggcggtgcgcgacatgcccgattcggcgatcgccctctatcatctgatcgtcgactcggccggcgccgtgccggaactcaagccccgtatcgccctgctgcacgccgcctatcgcgacaatctgcgcacctatctgctgcaggcgcgcgagatgggagaactgcgcgacggcctcgatatcgaccagtacgtcaggaccatctcgggcacgatcagcggcatctgcatccaggcgctcatcgccgatggcgatacccgtcggctgggtgaggatgcgaagttcatcgccgatctgttcgtgtcccaggtggcccgtcacccgcccgggcgggatgcgccgggcggcaccgccggcgcctgagccggccgcagcacgaggacgacaggatgttcgtagaggtgagccaccccgctccgggcgtggcgatggtggcgctcgaccgtacggagcggcttaacgccctctcgacggcagttgcagacggcctgctcgaagcccttcgcaccatcgcggccgatgcgggaaccggtgccgtgatcctgaccggccacgggcgcggtttctgcgccggtggcgatgtcagggagatgcgcaccaaccgtgcgaagaccgtcgatcagcgccggcgggatctggcccggatgcacgacataccgcgactgctcagggccatgccccagccggtagtggcggccgtcgccggccccgcctatggcgccggttttgccctggctctcggctgtgatctggttctggcagccgacgacgcccgtttcggcacggcctttctgaagcagggtctcgccagcgatttcggcctcgcctaccagctggtccggctggccgggccggccatggcccggcgcctgatctatctggatgaggtgttgacggcccgtgccgccgcggaagccggtctggtcgcccaagtggtgccgcgtgccgagctggcggcacaggcgctcgattgcgccacccgcctcgcccggcttcctgccgatgcaaggcttgccatgaagcgtctgctcgccatggccgagaccgaaagccacgaggtgatgctgcagatcgagacttcaacccagatcgccctcgttacctcggcccaccacgccgccgccgtcgacgccttcctgggtggcgacccccacgcggccacgaagacgccccaggagaaacgctcatgacgactgccgcatccgccgcccgcggcgatccttggacgcgggaagcgctgctcccactctatgctccgcggagcatcgccatcgtcggtgcctccatgcgccccggctctttcggtgcccgcacgctcggcaatctcgatgcctatgacggccgcatccatctggtgaatgcacgttacgacacgatcgacgggcggccctgccatgcttcggtcggggtcctgcccgaagtgccggatctggtggtgatcaccaccccggcgccgaccgtcgaagaggttctggaagactgcattgcggccggcgtgccggctgcgatcgtctatgcttcgggctttgccgagaccggggatccggaggatgccgcccgtcaggaccggcttgccacccgcgcagccgaagccggactccggctgctcggccccaattgcgtcgggatgctcgactatgtctccggcgcccgggtcaccttcgccggcgtgcccgcaggccgggtgaccgagggcccggcgatcgggctgatctgccagtcgggcgcgctcggcttcgcccttgcccaggcgatggatcgcggcgtcgctttcagccacgtgctgagctgcggcaattccgccgatgtcgatgtcgccgactggatttcggccctggccgacgatccccattgttctgtgatcgcctgcgccttcgagggcgccccggatccacggcgttttctggcggcagccgaacgggcctgggcgcgcgacaagccgctggtggtcttcaagcttgcgaccggcgaggagggggccgtcgcggccatgtcgcataccgggtccctcgccggttctcacgcagcctggaccgcgctgttcgatcgcgccggtgcgatcgtggtcgaagacttcgatgccctggtcgaaacagcggccttcttcgccaaggcacccgcccggacgcctccggcgtcgccgtgctctcaggctcgggcggtgccgcgatcatggccgccgactgcgccgagacggaaggtgtcgccctgccccagccgtccgaggcggtgcgggcacggctacgcgccgggttgccgcctttcgtccagccccgcaatccggtcgatgccacggcacagatcatcaacgacatgtcggcgctgctcgactgcgccgacgcgctgctcggtgatccggccttcggcacgctggttttcggctacccctacgcctatgacaccgccactgcccgtcagccgcatctgagcgcactggctgcgcgacatggcaaaccgatctgcctggtctggctgacccagcttcttgaaggccccggcacgcgcgaggccgaagccgatccgaacctgatcgtgttccggtccatgcgccgctgcttccgcaccctccgtgcctggcacgaccggggggcccgtcgccgccggccggtccggtctgccctggcgacatatgatcgcgacagggtcagagccctgttcaccgatgccggacctggaccgctcggcgagggcgcatccaaggcgatcctcgccgcctgtggaatcgccctgccccaaggcgggcgcgccgccgacgccgccggggcagctgagcttgcggagcggattgcgggtccggtcgcgatcaagatcgacagccccgacatcccgcacaagaccgaggcgggcggcgtgatgctgggcgtcaccgggcccgaggccgcggccgaggcgttccagagggtcctgacacgctgccgcgcagcagcccccggcgcccggatcacgggcatcaccgtcgaggaaatgatcccgcccggcgtagaggtgatcatcggcatccgcgatcaggaagggttcggcccgacggtcaccgtcggtctgggcggggtgttcaccgaactgctccgcgacacccgcacagccctcgccccggtcgatatcagtgaagcactggccatgctgcgcggccttcgcggggccagggtgttcaacggttttcgcggcgcaccaccgatcgatctcgtcgcggtggcaggggtggtggcgacactctcgcagctcgccgccgacagcggcggccggctggccgaattcgaggtcaatccgctgatctgcctgcctgatcgggccgtcgccgtggacgggatggccgtcctcgcgcccccgccggcaggcaaatctgcgccagcaaggggagggctccgtccgtgaatttcaactggaccgaggaagaccgcgcctatcgcgcccggatccgggattttctgcgccgggagttgccggccgactggcacagcattgcccgccacggccccggctcgcgggagcagaccgccttcagcctggaattctgcgccaagctcgcagccgaaggcctgctggtaccgcactggccgcgggaatggggcggcgagaaccggccgacctgggagcacttcattctgggcgaggaaatgtgggcggcgggcgagccgcggggcgcccaatacatgaacgtgaactggatcggcccgacgctgatgcgctatggcacgcccgagcagcagcagcgctatctgcccgaaatggcggcggggcaggcgatctggtgccaggggttttcggaacccggggccggctcggatctggccgccctgcgaacccgcgcagaacgcgacggcgacgactacgtgatcaacggcaccaagatctggacctcctatgccgcgctggccgatcactgcttcctgctggcccgggtcggatcgggtgaggccggatcgggcagcgatcgcgcggggatcgcgatcttcctggtaccgatgtcgaccgccggcatccaggtgcgcgccatccccagcctgatcggccatggcgacatacacgagaccttcttcaccgacgtccggataccggccacggcccggctgggcgccgagggcgaaggctggtcgatcatcgcctacgcgctcgccaatgaacgggtcggcatcccgcgctatcaactctcggcgcgggtcctggacggcatggttgccgatctggctgcgcggggccgcttcgacgacccggtcatccgcagccgggccggcgccgccttcgccgcctgcgaggcggcccggatgctggtctatcgggtggtcgaccagcgggcacgcggtgctgcaccgggtcctgagtccaacatcgcccgggtggctgtgatcgccgccgaccatgccgtaaccgatttcggcctggatttcctaccccacagtttcagcggtgatggcgtctcgaccggtggcgatcccgacctgctcgcccatcacgagcgggcgatcgtcgccggcatcgccgccggtgccgccgaaatccagctggggctgattgcccgacgccacctcgacctgcccagagaggctccgtgatggatttcactccgaacgaggatcagaccgccttcttcgccatgctcgaccgcatgaccgaagcccccgaggccgggtgggcggtcgcacccgattatgctcgtttcgcctggtcggcaacgctcgatgcgacattggatgccaacggcttctacgatgcggccaacgaagagaccctgggccctgtcgccgccgccgaactggtccgcaggctcgcacggttgccggtggtcgttgaatgtgctgcctcggccctgctgcgcagcgccctgccggccgaccttccccggccccttgccgtgctcgaagaggcggcgggcgaaccggtccgtttcctcccccaggcccgcagcgtgctgagactcggcccgggcagggcggcgatcgcccggccggcaccaggtcaggtggtgacggtggacagtctcttcgcctatccgatgggacggttcaccgaacgggggcccgactgggagccgatcaacgccgatccggcagctctcgccgatctctggcggatcgcgattgcagctgagatggcgggggcactcgacggggcactcgacagcgtcgtcagtcatgtccgcgaccggcgccagttcggccggccgctcggcagcttccagacgatccagcaccggctggccgaggctgcgacccgtatcgaaggggcgcgacttctggtcctgaaggcagcagagcatcgggccccgacagaggcggccatcgccctcggctatgtccaggacattgccacccgggtgatctacgacctgcaccagttcatgggtgccatgggcctgaccctcgaacacccgctgcaccgctggacctaccgggtgcggttgctgcggtctgccttcggcggtgctgcccgcaacttcgacatggccgccggtcttcgctggacggcaagccccagcgccgccagcaccagcggatagatcaccgatccgccctgggccagggcgaggccggccaccagaaccacgcaggcggcggcgagcagccgggtgcccgggccttccgacagccggaacagcgccgccgccgcaaccccgtacaggatcaggaaattctgtccggcgatgccgagcaggacatcgacccggctgaagccggccgcgtcggcggcgatcaccgccagcaacaccacgaccagtacaccggccgccctgaccggctggtcgccccgcaggccggccagcgccgacggcagggtgccggcgcgggcgagggcgaaaatcatccgcgacacgccccagatggcggcagccagattggccaggatcatcacggtcacgaccgccgccaccgcccggccgccgacagccccgaaccggccgtccatgatcgccgcgaacggggtttcgaaccggccgtccagatcgcgggtctgggcgatccaggccatgaccaggtagagcaccaccgccaccacgaaagacagcgccatcgcccgcgggaaatcccgggccgggtcgcggaactcctccgacaggttggacgcgatctcccagcccgtgaaggcgaagaagatcatcatgaacggcgccagagccagcccccagtccacttggtccggcagcagcggcaggggggtggcggcttccgggaccagcacggcgccggtcaccgcaatcgcgcccagcagcaccagcagcacggccgccatcgcctggttgaccctggcggcccccgcggccgacagcaggttcaccgcaaaccccgccgtgaccagccccgccgcccaggcatgcgggctgccgcccaccgcacccgcggcataatacccgccggtcagcgcgatcgagggcaggccgatcgccaccgcccccagcaggatgaaggacgaggccggcgcccaggcggggccgaaggcgcgggcggcgaaatggccgatgccgcccgcatccggaaaccgccgccccaggatcacgaacaccgcaagcagcggcagggcggcgagcgcacagatgccccaggccagcagggcatgatcgcccgcctgccgcaccgccaggcccggcaggatcagcagccccgcccccagcacgatgttcagcatcaccgccgcccctttgagcgggcccagattgcgtgcgagttcgcggccgccctcgctcatgcggtccctcctcctcccagctccacgatgcggggcgcgatcagatagactacgcccccctccagcgccaccgaaccgtggcggataccggccggcagccggatcacatcgccctggcggcagagggtctcggtgttgccggacgcgtccgcccaatagaatcgcaggctcccctccaggatcaccagggtctcgtccaccggatgggcatgccaggcatgttccttgcccggccggtcgcgctgcacctcgaccgccccctgttccggcatcagcgtccggatcaggtcaggcagggccggcggggtcaggtggcgggtcaggatctcgaccatggctcagaccacctccgcatcggtatccctgagccgcgcaaacgggcaggcgggtgccggccggttggcgtcgtccaggaaatactggcgatgctcgcgggtctcgggtgcgccatagcggccgagatcgggcgaggccggcagcatgtcgaaggcgaccagccgccgacgcaccttggcgaacgacgtcgcggcagcctgttccgtccccaggattttgtcgaacacccagcgcggctggaaggtcagcatgaaggtgctggaccgccggctctggcgggcgatatgggcgggggtgttgcagaccacgaagaccggctcgcccgcgaagcagaactcccagagcggttcatcggtgccggctggaatctccgccggccagggcgccgcatcgcgccgggccagcgccgccagcagcccccacatccgcgcccggtattcctcgatcccggccacgcggccggggcggaagaaggcgaccagagaggcatggggcccgaagctgcgggcctcggccacgaaacggcccagcgccgcggccagccggtcggccgccggcccgtcgggatcggcggcctcgtcgtcgatgaacagatagcgcagctggtcggtctcgaagcccttcaccccgaagacgcaggggaaaggccggaccgggctcgagatggtggtggcgaattcgtcatacaccacccgctgccagctgcccgcaggcagccggccggcaagatcgtcgcgcgagagatagggcgcgggtgcagcggacatcggtcccgtatcgaacatgatgtcttcccatgactggcgatggcgggggtacggccgcaggccccgcaaatcgacgtccccacatcgatttggaagctataagttgcgaccgcagtcaccgcacacttaaccgttgcattgctcgccagaccagagttcaaattgaacacttcctaccataatgaaacccttgggcaataaccagggggcacgcatccgcaccggaacccatgatcatgtctcaggaccaggcctcacccggccggcgccgcaacgcgccggagccgtccctgagcgagaccgatctgcagctgatcgacctgctgcgtgaagacgcccgccgcagcatcagcacgctggccgccctgatcggcacctcgcgtcccgccatccgccgccggatcgatcgcctgcaggcgcagggggttatccgccgcttcacggtcgaaaccgccctgccggcagccaccaccgcagatcgcggcatcgacgccctgttctcgatcgtcgcccgcaccggcagccatcgcggcctgctcgccaccatccgccagcgcccggaatgccgcgccgcctgggcggtgaccggcacgcccgacctgatcatcatcgtccactgcctgtcggtcgcagccctcgacggcctgcgcgaccacctggcccggcacaccgcggtcaagtcggtctcgaccgcggtgatcctcgacggctggcagcgcgacggctgaggtggcgaccggccgatgtcagagcggatggaccccgaccgcacggtaatcggcggccagcatcgcctcctgcgccgccaccagggccagttccggcccgcccagcttgcggctttcctccaccaccgcccaggtggcggcgaccgcccggcggatggcgcgggacaggtcgcgatgggccagccagtcggcgagcagcacggccgagaacatgtcgccggtgcccgagaaatggaccggcaccagtggggtctcgatccggaagcggccggcgcggccgaccgcgatcacctccaccgaccccgccgccgtctcggcgaccttgaccgaggtcgccaccgccatctcgggccccatggccgccagccggtccagcgcctcgatcacctcggcgcgggtgtgggtgtggcggccggtcagatggtcgagttcgaaatgattgggcaccaccagattggcgcgcggcagcagatgttcgaccatcgcctcggccacgcccggctggacatagcgcccgcccggatagtcgccgatcaccggatcgaacagatagaaggccccgggcacccgccggcggacccggtccaccgcctcagccgccacgctcacctggccggcactgccgaaataaccggtcagcacggcgcgcacgaaaccgagcccgccgccagcctcttcgggcagggcgtccagcccctcgacgatgccgcgcatctcggtctcgtcgatcacggtgccccgccagccgggatagcgggggttgctgctgaaccgcaccgtgtcgatcgggcagacctcctggcccagccgctccagcggcagtgtggcggcgcagttgccgacatggccgaagctcacccgtgactggatgctgaggacagtcatcggcggtactcccaaaacgcagggtccggcagcgcatgcggtatcgcccgggctgcaccggacatagaggggatcaggggcgggagacggaagtcgggggtggcgaccggcttccggcggcagcccgtgttcgcaggcgccgcggacctggatgcttgcacggccgggccggaggcttcaacccctgcgcaccgtcggcggctgcagcccggacctgcacatcctgcaggcgcgggtcggcaactttgttgcgttgcggaacggatctgcgcaacgctttcgcagcggcacaaggtggtttatagtcgcgcgcgagccggccgggccttcttcccgtcccgccgcacggatccctgcccgcggatccggcgccgcgggggcggccttctcggggtccggccggggatcgcctttccaccattcaccccagccacggaagcccgcgacatggccaagaccaatcgtccccgccgcagcatgctttatatgccgggtgccaatacccgcgccctcgacaaggcccggagcctcgcggccgacgcgctgatcctggacctggaagacagctgcgcgccggatgcgaaggatgccgcccgcgccaatgtggtggcggcactggccgagggtggctatggcaatcgcgagctgatcatgcgcgtcaatgcgctcaccaccccctggggccatgcggatctggtcgcggcggcgaagagcggcgcccatggcgtgctgatccccaaggtcgacggtgccgaaggcgtgcgtcaggcggaagcggtactgcgcgatgcgggggcgcccgacgatctgaagctgtgggtgatgatggaaaccccgctcgccatcctgagggccgaagaagtcgccggcgccactccgcgccttgccggcctggtgctcggcacctcggatctcgccaaggatctccactgcgcccataccccggagcgcctgcccttcctcgccagcctgtcgctgtgcatcctggccgcccgcgccttcgacctcgcggtcatggacggcgtgcacctggatctggacgacgaagagggcttcgcccgcgtctgccgccagggtgcggaactcggcatggacggcaagaccctgatccatcccaagcagctcgccgccgccaacgaggccttcggcccgtcggaggccgatatcgccaaggccgaaaagatcattgccgcccatcaggccgccacagccgaaggcaagggtgtggtcgtggtcgacggcaagctggtcgagaacctgcatgtggtcggcgcgcgccgcctgctcgacatggcagagcagatcaagaccctgggctgaggcggaaccgatggcacagaagaccaatcccggccgcttcttcgaagacttcaccctgggtgaggaaatcgtccacgccaccccgcgcacggtgaccgagggcgaccagtcgctctataccgcgctctacggcacccgcttcgcagtgaattcctcggccgaattcgcccgcagcctgggtctcggcggcgcgccgatcgacgatctgctcgtcttccacatcgtcttcggcaagaccgtccccgacatctcgctgaacgcggtcgccaatctgggctatgccggcggccggttcggcgtgccggtctttgccggcgacacgctttccacccgctccaccgtcatcggcctcaagcccaacggcaacggccagaccggtgtggtctgggtgcgctccaccgggcgcaatcagcggggcgagatggtgctggactacgtccgctgggtgatggtgaagcgccgcgcccccggcactgatgtctccgccacccatgactgcccgccatccgatctgcccaaggcggtggatgccagcgatctggtggtgccgactgacctcgacgcccgcggctttgatttcgccctctcgggggagccgcacgccttcgaggactacacccccggcgagcgcatcgatcatgtcgacggcatgaccatcgaagaagccgagcatcagatcgcgacacgcctctatcagaataccgccaaggtccatttcaaccagctggaagccaatggcaaccgcttcggccggcggctgatctatggcggtcacatcatcagcctggcccggtcgctgtcgttcaacggcctggccaatgtggtgcgggtggcggcgatcaatgccggtgcccatgccaaccccaccttcgccggcgacaccatccacgcctggtccgaagtgatctcggccgacgccctgcccgggcgcaccgatctgggtgtattgcgactgcgtctcattgccaccaagaatcgggccgccgccgacttcccgctcaaagatgccgacggcaaatatcttgccgacgtcgttctcgacctagattacaccgtgctggtgccgcgccgcggctgaacagcgccgccgcccacaaccttcgggcgcccggttcctgccccctgtgcctgcgcatggcgtggggggtgcgactttcgccgggctttcgttgacttgggcggcgggtgggcctattcagtacggcgtgacgaaaggcgtgcgttttcaagccgtaaacgttgagccgcccggcggggtatcctcgccatgccgggacgagcccctggagtgcaggttctagaagcccatggccaagaccgacaaccgaccgctttcgccgcatctgcaggtctaccgcctgccgctgacggcgctcatgtcgatctcgcaccgcgccaccggcgtggcgttgagcgtcggcaccctgctgctcgcctggtggctgatcgccgctgcgacgggcgctgagtctttcgaaaccgtgcagggctttctcggctcgtggttcggcatgctgctgatgttcggctggacgctggcgctgttctaccacatggcgaacggcatccggcacctggtctgggatgcaggctacggcttcgacgtcaaacaggccgagaaggtgggccgcatcgttctggtcgccgccggcggcctgaccctgctggcctggatcatcggcctgtcggtctgatgggcgagaaaagactgcagaaactgcggctggttcgaggacgatcaagatgagcttgcgcaatcccctcgcccgcgttcgcgggctgggctcggctaaagaaggtgtccagcactggtggcttcagcgggtgaccgccatggccatggtgccgttgaccctgtggttcgtgatttcggtgatcgcgcatctgggcgccggccggctggagatggtggactggatgtcctcgccagtctccgccgcactgatgatcgctttcctggtcagcctgttctggcatgcaaaactgggcctgcaggtcgtcatcgaggattacgtgcacaacgaggcatgcaagatcgcgtcgctgaccgccatgaccttcgccgtggtcatcgtcggcatcgcctgcgtcgtctcggtgctgaagctcgccttcggaggctgaacgcgaaatgaccacggcttacaagatcatcgaccatgaatacgacatcgtggtcgtcggcgccggcggcgccggtctgcgtgcgaccatgggcatggccgcgaagggtctgaagaccgcctgcatcaccaaggtgttccccacccgcagccacaccgtggcggcgcagggcggcatctcggccgcactcggcaacatgggcgaggacgactggcgctggcacatgtacgacaccgtcaaggggtcggactggctgggcgaccaggacgccatcgaatacatgtgccgcgaggcgatcccggcgatcatcgagctcgaacatttcggcgtgccgttctcgcgcaccgaagagggcaagatctatcagcgccccttcggcggcatgaccacccgcttcggccagggacgcgcccagcgcacctgtgccgccgccgaccgcactggccacgccatcctgcacaccctctaccagcaggccctgaagaacgacgcggagttcttcatcgagcacttcgcgctcgacctgatcatggacgacgagggcgcgtgccgcggcgtgatgagctgggatctggcgaccggcatcctgcaccgcttccgctcgcatctggtcgtgatcgccaccggcggctacggccgggcctatttctcctgcacctcggcccatacctgcacgggtgacggcaatgcgatggtgctgcgcgccggcctgccgctgcaggacatggaattcgtgcagttccacccgaccggcatctacggcgccggctgcctgatcaccgagggcgtgcgcggcgaaggcggctatctcaccaactccaatggtgagcgcttcatggagcgctatgcaccctcggccaaggatcttgcctcacgcgacgtcgtcagccgcgcgatgaccatcgagatccgcgagggccgcggcgtcggcaagcgcaacgaccacatccatctgcacctggagcatctcgatcccgagatcatccatcagcgcctgccgggcatcgccgaaaccgcgaaggtgttcgcgggcgtcgacgtgaccaaggagccgatcccggtgctgccgaccgtccattacaacatgggcggcatcccgaccaatcatcgcaccgaagtcgttcgtcccacggccggcaatccggacgaggtcgtgcccgggctgatggcgatcggcgaggcggcctgcgtgtcggtgcacggcgccaaccgtctgggctccaactcgctgctcgacctggtggtgttcggccgcgcggccgcgatccgcgccgccgagatcgtcacccccggccagccgcacaaggcgatcggcgccgatgcctcggaacgggcgatcgcccgcttcgacaagctgcgccatgccaacggcaccgtctcgaccgcggaactccgcgacgagatgcagcgcaccatgcagaacaactgcgccgtcttccgcaccggcgaggtgctggaagagggtctggccgagatgcacaagatctacgcccagcgcgacaatctccgcgtcaccgaccgctcgctggtctggaactcggatctggtcgagacgctggagctggacaaccttctgggtcaggcgctggtcaccatcgccggtgccgcaaaccggccggaaagccggggcgcccatgcccgcgaggattatccggaccgcgacgacaaggactggatgaagcacaccgtcgcctactgctcggacgagggcgaggtcgccttcgactatcgcccggtgcatatgacgacgctgaccaacgaggtcgaggtgttcccgccgaaggcgcgcgtctactgacgccgccttaacgaccccacgtcgaccgaggacgagacgagcgatggcccagttccggcttcccaagaattcgcagatccgccagggcaagacctacaaggcggacggcgcgaagaacgtcaaggttttcaagatctaccgttggaaccccgacagcggcgaaacgccgtcggtggacacctacgaggtcgatctcgatcattgcggtccgatggttctggacgcgctgatcaagatcaagaacgaggtcgatccgaccctcaccttccgccgttcgtgccgtgaaggcatctgcggctcctgcgccatgaacatcgacggcggcaacacgcttgcgtgtttgaagccgatcgaggacgtgaatggcgaggtgaagatctacccccttccccacatgcaggtggtgaaggacctcgttcccgacatgagcaacttctacgctcagtatgcgtcgatcaagccctggctgcgcagccagagcccggcgccggcgcgtgaacgcctccagagccccgaagagcgcgagcagctcgacggtctctacgagtgcattctctgcgcctgctgctcgaccagctgccccagctactggtggaacagcgaccgctatctgggcccggcgatcctgcttcaggcctatcgctggctggccgacagccgcgacgaggacaccggcgaccgcctcgacacgctcgaggatccgttccgcctgtatcgctgccacaccatcatgaactgcgcgaagacctgccccaagggcctgaacccggccaaggcgatcgcggagatcaagaagatgatggttgcccgccgctaaggcgggacgatggttgcccgccgctaaggcgggacgatggttgcccgccgctaaggcgggacgatggttgcccgccgctaaggcgggacgatggttgcccgccgctgaggcgggacgatggtcgcccgccactgaggcacggcgcccttcggaccaatgaaaacggccggccctggtgacggggccggccgtttttcatctgcgtgctctgcatggcccctgtcagccggtgagagccgtccagagggcgcgatagcggccggacacggcgaccagatcgtcgtggcgcccctcctggaccacgcagcccgcctccagtaccaggatgcggtcggctccccgcaccgtcgacaggcggtgggcaatgacgatcaccgtgcggtcgcggaccagggcatcgatcgccacctgtaccgcgacctcactttcggtatcgagcgcggccgtcggctcgtccaggatcacgatcggcgcgtccttcagcagcgcccgggcgatggcgattcgctggcgctccccccctgaaagccgtgcaccgccctcgccaagacaggtctgccagccctcgggcaggcggctcacgaaaccgtcgcagagcgccgcccgtgccgctgtcatcaccgccgcgtcatccgcctcgggccggccgatgcgaatgttggccagcacggtatcgtcgaacaggtgcacggtctggaagaccacggacaccagccggtccagccggtcgggcgcgatgtcccgcaggtcgacgccgccgatcgtcacccgcccctctgccggatcggcatgacgctggatcagccgggcaaagctggtcttgcccgagcccgagggaccgaccagagccgtcaggctgcgttcgggcaggcgggccgacaccctgcgcagcgccggccccttcgccgccgcatagctgaaggtgacatcctcgaaggcaatgtcgaaatgctccggctgccgtggcttcatcgcgaccggcagaggcggaacggccatcagcgcgtcgatccggtcgagcgccgcctcgatcagatcgatcaccaccgtataggcggtgacggtggcgagcggttcggcaaagcgcaccgtcaccaccagcaccgccgcaagcgccgcaggatcgagcagaccggccgtcacccgccagagtccgaagccggctaccgcgagcagagcgagttctgttgcactcgccaccgtcagatttggccctgccgcccggcggtgatcctcgacctgcaccgcctccagtgccgtcaggctccggtctagcgccgcggcccgttccccggcgcagcccgccgacttcaggacggccagcccctgaaggtattcggtgatgtcggaagcgcttcgggcatgggcttcggccaggcggcgcatctgttcgccctgccggggccgccgccagcgagtcagccacaggatcagcgggaaaaccgcagccagcgccgccgcaaccggccagtccacaaaaaccagccccgccgccgcaaccagcggcgtcaccagcgcctgaagcagaagattggccaccgtcagcacgtagtgcagggtctcgtcgacattcccgagcagggccgcactgatctcgccggtccgccggtcctgaaggcgttcgagcggcatccgcctcagctgggctcccagccgggttctgagctcgtgggtcgctcgcgccatgtcgccgccatagtcgaagccctgggcccgccagcgcagcactgccgccgccgccgcaaggccgcagaccccggcgaaccagggcagcgcagcctgcggatcacccccaagcgccgccgtcagcagcggggcgagcaaggccagtgccgccccctgcagagcggcggccgctgcgagttccgccaatgcccggcgcagcgccggggcgtgagggcccatggccctgaacaggcgggtgaacgtgcgatgaaacggggatacaccgcccgatgaggctgcgctgtcgctcataccatgtctcccgcccggccatcgtcaatgacatcggggccgatggcccaggcgcgcgcccgttcatgcgcacgccacagccgggcatagagcccgtccgctgccaccagctgatcatgcggcccggcctcgaccagccggccgcgatccagcaccaggatccggtcggcgccgcgaatggtcgacagacggtgggcgatgatgatcaccgtgcggccacgcatcaaggcggccaggccggccatcaacgccgcttcgttctcggcatcggcaaaggctgtcgcttcgtccagcaccaggatcggccggtcgagcagcagggcacgggcaatggtgatccgctgtcgctcgccacccgacagggtcaccccccgctcacccacgggcgtgtcatagccacggggcaggacctggatgaaatcatgcgcacgggcggcccgggcagctgcctccaccatggccatgtcggccgccggccggccgagcctgatgttgtcggcgatgctgccggtgaacagaaaggcatcctgaaagacgaaaccgaccagagccgccagccggtccggcgacaggtcgcgaaggtcggtgcccccgatggtgattcgcccggcttccgggtcgcggaagcggcagagcagggccgcaacagtgctcttgccggcccccgacggtccgaccagcgccgtcatggttccgggggaagccgtgaaggacagccccgtgatcgcctgcatcgccgcctggccatagccgaaagacaccgcctcgaaccggatggtcgtgtcatgcggcagggtggagaaagcgacaggaccatcaatggtcggcagcggcgcctcggccagcacctcggcgatccgggccgccgagagaccggcccgggccaccatgtgacgcagcgccattgccggcatcatcgcttcggccagccccgtgccgacgagcagggccgcaagccaggcccccggctcttcttcgcccccgccccacagccccaccgcaagcaggacggcgagcgtcggcaaaggggccaggatggcgagcgaggcccgcgccgccagtccggagcggcgataccacaggatcaggacgtccagataggtttcgagcgcccgctgatagcgcccgaaactgtcctggccggtatcgaaggtacgcaccaccggcatggcctggacgaattccgtgaccgctgccgtcacctgttcgcgggcggcattgtaggcacggatgagcgccgtgccgtctcgcatggcaaagatcaggacaagaagaccgacgagcgccacagccagcgccgcagccgcataccgccagtccagcagcgacagcgccaccgcggttgctgccggcatgaccacggcccgggcgtagagaggggtcgcgtcggcgacgaagacatgcagcgccttcacgtcgtcctgcatcaccttggcaagggacgccgggccgatctgctgcacccggcccatgggcagggccgcgacatgcgccgccagccgccggcgcaggatcagctccagccggaaggcagcccggtgcgactgaccgaaggcggcaagccggagcgcgagggcggcaagcgtgcagccggccgcgatcaggagcggcaaccagggcgagccgccgtcagcggtcaggggtcgcacggccgcgaatgcgatcagaagcagcgcactcaacgccgacagggcggaaaggcccgacatcgccatggcgatgcgaatgcgcccgcgcaccggcgccagtaccggccagggggctgcactcacgaccgacctcccgacgggtggcgcagcagtaccgcgcccatcagggccagcagaccggcgataccggccacctggagcgtggcgcccgccccgccggccgcggcgatcgccgcccctgtcgaaatcgagcccatcccgacagcggcatggaaggtcgcttgcaggctgtagtccgtggccggtcgcgcagtcgaggcccggtccatcatcaccatcgccatcaccgtggcgccgggattgtagaacaggaaatacaggcagaccgccgcaaccggcagccagccctcacccgtgctcagcaccggtaccgccacgaccgcgatgccggccagctggaccagagccgccaggatcagtgccggccgccgcccgatccgtccggcgatccgccccgctgccagcgcccccaggatgcccgccatcggtcccgcgacattgaccaccaggccgatccgttccatcgaccagccggcctcgaccagcgccggcatgatcagtgcgtaggccatgcccgatcccgccggccagatcagcagcagcgccgtccagcccaggacgtccggccgacgcagcccggcaagccggcggcgcaatggcgggggcgtgatcacggcggtcacggacccgggctcacggaaggccagcagctgaaccaggctcacccccgtcaccgcggcgagcagggccatagcccccggccaccccagatgcgggtagagggcgagcacgccgcctgccccgaccatggtgccgagcagcccgcccgcgatctgcagggcattgccgctcccccgcgcctctaccggcagcagccggcaggccagcccgtccaccgccacatcctgcgtggccgacagcagcgccagcgccagacacagcacatagacggtactgaaatcatccagcggatcgaagcccgccatcacggccagaaccacgaccatcgcggcctgcatgatgatcgcccaggcccggtaatggccggcatggccgaagcgcacccggtcgaccagcggcgcccagagcagcttggccggccagaccaggcccagcatgtagacctgggtcaggcggtccatatcggcgccggcctcggccaggatcgcaatcagcgccgcgacgaaaaacatcagcgccagggtctgggtggtgtagagactgagcagcagcagccgctcgcgcccaccgacacggtcggcgggcgtggcggcgatactgcccggaggggaagatctgatcatccgggctttccctgtcagaactgccaggcgaaaccgacacccacggtcctgccacgggcaggagcgccataggccgtcaacggtgccgagaaatagccgtaaaggtcgcgggtctcgtcgagcaggttgtcgccccagaggtagagttcgccgccgccgctcatcacgcccagatgcagatcgatctcgtcataggcgccgaggtcgaaactgttctgcgggtcggcgctccgcgccccgacatgggtgtagtcggcacggatgttcagcgccggctgaggcaggctgcccagccgcacgggcaggtcgtggacccagccgacgctgaaccggccggcccagcgcggcacgtcgggcacgtcgttgccggactgcacgtcgccggcgccgagcccgatcagatcactgcggatccgggcgtcgatgaaggtcagtcccgccgacagcgtcagaccgttttcaagccgcagggtcccgtcgatctccgccccctggctgcgggtatcggcattgaccgcgttggtgacgtaggtgttcggatcgtagctcagcagatggttgttcttgacgtcgttgaagaagacggcgcctgccagttcgaaacgcccgtcggcactcagcgtcttgaagccggcctcgatgctgcgattgaccgcggccttgtagggcacgctgtcggccggctgattggaatagtcgctgaacccgcccggatcgtaaccgcgcgaggccagcagatgcagcgtggtctcgggcgtcaccgcccaggacaggccgatccggccggtggtgtaggcgtcatcaaggctgcgggcgtccggggtggccatgccgccgccatgatagaccgcgtcataggtcttctcctcccaggcctggcgcaggccggccgtcagcttccagtccggcgccacgggcacggtcgcctcgccataaacggcatagcgtcgggtggtgaagtcacgctccaccgcgctgcccgtgccataggtgttgcgcggcgtgtcataggaccggtcgccatgatgcaggttgatgccggccacccagaacaccggcgcctccggcagagacgacagccggacatcctggacgagaacggtctcttccgaagtatcgacgatccagtattcgccgccccgtcccatggcctgctggatcagccggtcataggcgaccagaccggtgaagtccgaccgcgccaccgatgtggttgaggtcagccgcatgtcccggaagtcatgggcaatctcgagcgcatagcgctccatggtcttctcgttgtcgtcgaacagccccggggtcagatcgttcaccggcgggtcgcgatagggcatcagcaccagcaggttggtcagttccttcacctgctggcgttcggcggtggcgaagatgctggtgccgtcaaaatcctcccagagcaggctgccgcgaaaggcgagatccgtgggcttgctcagcggatccccggttttcagatcgtcgacccagagatccgatccggaagagcgcagcgccacgcgaccgctcagattttcggtcagcggcccaccgaccgccccttcgacgagatgctggttctcctggccgtattcaccgcgcagatagccttccagctcccgggtcgggcgacgggtcgtgacgttgatcgcaccggccgcgccattgccaccgaacagcgtgccctgcgggcccttcagcacctccacccgctcgacatcaagtgtgccgaggcccgaatagtgcggggtaagcgccgtgccgtcgatgttcagcaccaccgacgcgtcgtccatgctcatctgatagagcgcgccgacgccgcggatcgagacgttgtagagattggggccgccggaggagttgaccgaaacgccaggcgtcgcgcgcagcacatcctcgatggtctgcaggcggcgggcctcgatctcctcgcccgtcgtcaccgaaaggccgaacggcacatccttggcgccctcctcggcccgccgcgcggtgacggtcatgggcgcgagttcaaccgccgtcgtaccgtcttcggcagcctggccggaggcaggcgtggcggcgagtgcagcggcaacaagcggcccgaatggcaggaggccgaatggcgaaagggcagggccccgcccggccttggtggcaggcggtcgtgtcgggtcgatcatcatcaacggttcctggcgtcagtgggtgcggctgtggcgcctcgcccgtcacacatgcggtcgcatccattgcgcgaccgggtctttcgtgatgataatgcgttgcattcgcatttccgcccggatccggtcgatctccacccggaaccgcgccaaatccggcccctcccggccctgaacttccggtccgccgatgatcaagagccctgccccttctgccgaaataccggtctcccggctgatcgccggccgcaatccggccaccacggcgcccgcctggcaggtgaccctgctccggctccaggatggggtggagctggtccattggtgtggccgtttcgaacggccggccagcttcgccctgcatgacgacagcgaccggatccatttcagcttcacgagccggctcgacggcgtcgcccgctgcagcttcccagccgaccggcgggaccatgcgatccgggcggagaccggctgcatcagcttcggtcagggccgccatggcagctatcaccagcagggcatgctcgagaacgtcaccgtcatggtccgccccgacatctttgccgcctgggccggcgaggccgatggcggactcgtcggtctgcttgccaccgaaggcggtttccttgctgatcatcgtggccgcgaactgaccgacacggcgcggggtatcgcccgggcgatgcgtctggccggcgaaatgtcaccagccgcccgccatccgctctggtaccgggcgcagggcagcgttctggtcgggctgttcctcgaagcccgccgccaggaaccggccctgccgaccgcagcccccgccgatcgcgcccggctgcgccgtgcccgcgatctgctgctggccgatctctcctgcgcaccatcgctcgccgacctcgcccgcgccgcggggctcagcgtcacccggctggaacgggggttccatgtgctgttcggcaccagcgtctacggcctgtttcagcaggagcgcatggcagaggcccgccgccggctgctcgatggcgagacgtcgatcacccgcgttgccgccgatctcggctacaccaacaccagccatttcgccgccgccttccgcaagcagcacggcgtcaacccctcggccctgaagtgccgccgctgatcgtcatccttccgtcgcacgcggggcttgcgcccccgcccctcttcggataaggtccgcgccgtcccgagcggagaggtgccagagtggtcgatcggggcggtctcgaaaaccgttgtgcgcgcgagcgtaccgtgggttcgaatcccaccctctccgccattcgctcccgccggctccggcggtgaacggacgaccagcttcgaacggcccggcgctgcagagtgccgggccgtttcgtgttggaaacctggctccgacggatacctcgtcacccacccgggcaaccggcctccttcaccacccgccgggtagaagcgggatgccggccgagcagcgccgtcggccgtaccggccgcgccaccagcccgcccccgcaattcgggcagatcccgccaagccggccttcggcgcagctctggcagaaagtgcattcaaaggaacagacgaaggcccccggcacatccgccggcaggtccacgtcacagcactcgcagcccggtcgcatgtcgagcatcaggcagcctcccttcgagcatggcaggaccaccggccccgctgccccagaatgcctccggtccgcgcaaccggacaaggcggcgcagcccacttttccggtcgcaggcgcctcagccgcgcaccagcgaaatcagcggctcgaaggcatagagcgccggccgtcgcccggctgctggctgtttgcatccgtgaagcgatacgacgcttcaaagtccgaatgacatccgcgagaagcaaaaggcgttgtctatcgaattttcccggattcgataggcaaacaggtttgcgtctggtttccgagaagcaaagatgtgtgggtctcacctgcgcccaaaaacgagagacaatcccaccacccgcaacaactcccgccttgcacaatccgccggccgcgcctagtcttgcctccccaaaaaccgcataagccattgatttccctgaaatcactctggcgacatgccggaacgggcccttcgacctcggagacaggaccatgcggcagatcacggacggggtgctcggcctcgatttcggcaccaccaacagcgtcgcggcactggccaccgcgcccggcgtgtcggagctggtcgagtttcagggagcgaaggcgaccggggccgtgtttcgttcggcgctgtgctattggcaggacgacgaggtgaagggcggcattgcccacgaggccggaccctgggccatcgccgagtatctggcctttccgcaggacagccgcttcatccagtcgttcaagagcgtggccgccaccccgctcttcgaacacgccaccatttttgacaagcgctaccgcttcgaagagctgggccggatgttcctgggccgcctgacggcccatgccggcggccggctcgaccggcggccggagcggatcgtggtgggcgtgccggtggaattcgccggcttccgcgccgatcccgccctcgcccgcgagcgatacgaccgcatgttcgagaccttcggcacccgcatccactatgtctacgagccgctgggcgccgccttcagctatgccgcgggtctcgaccacgccgccacgctgctggtggccgatttcggtggcggcaccagcgacttctcggtcgtgcgggtggccgaaccgggtgccgcgcggcgctgcctgccgctcggctcggccggtatcggcatcgccggcgaccggttcgactatcgcatcctcgatcggctggtgctgcccttcctcggcaagggcggctgctaccgctccttcgacaaggtgctcgacatccccttgagcttcttctcggatttcggcgactggtcgaagctcgccctgatgcgcaaccccaagaccatggatgcgctggagcgcctgcgccgggcagcgctggagcccgaggcagtcggccggatgatcaccgtgatcgagaacgaactcgggtacccgctctatgatgcggtcggccgtgtgaagcgggcgctctccaccgaaaccgaggccgatttcgccttcaacgcccccgggctcgacatcaatgcccgggtcacccgcgccgagttcgaggactggatcgccgaagacgtcgcccgcatcgccgccaccgtcgacaccgcccttgccaaggcgggggtggaggccgccgccatcgaccgggtgtttctaaccggcggctcgtcgctgatccccgccatccgccggctgttcgaagaccgcttcggccgcgaccgcatcgccacgggcaacgagctcacctccatcgcccacggcctcgccctgatcggccaggaagaggacgtgacggagtgggcggtctgacccgaccgcgacctgaccggttttacgcctccaccaagcccggccagaaatggctgtcgggcagcttccgggcaccgaagatcgcctggccgacgcgcaccacggtcgcgccctcttcgatcgcgatctcgaaatcgcccgacatgcccatcgacagctcgtcgagggacaacccggccggggcgtcctgacgcagccggtcgcgcagatcgcggagcagcacgaagcagcgccgcacccgggcggcctcggccgagaacagggcgagcgtcatcaacccgcgcaccttgagcgcgctgaaggccggcagctccttcaggaaacccgccacctcttccggcggcaggccgtatttgctctcctcgcccgaggtgttgacctgaacgaagacgtcgagactgcggccctcgatctgcaggcggcgatccagcgcctcggctgcccgcagattgtccagcgcctggaattcggcggcaaagcgcgccaccagcttggccttgttggtctgcagatgaccgatcaccgaccattgaagatcggccagatccgccatcgcctcccatttgcgcgcggcttcctgaaccttgttctcgcccagcagccggcagccggcggcataggccagacggatatgcgcctcgtccatggtcttgctgaccggcagcaggcgaaccgtcgccggatcccgcccaacccgtgccgccgcagcggcgatgcgggcatgcaccgccgccagattttcccggaaatcctcgaccgattcggcgcgcggccagcggtcgtgaagatcgtggcgggtctctgtgtcgagaacggaggtgtcggtcatcgctaaggcctcgtctgatcggcgcagcggcgcgccggcccggacatgccggacatgtccgggcgccatcatcgacccgaattcgcctcatgccaaatagaatattggcctaggccaatactcaatcctgtcggctgagcagtggcgccagggccgcgatcccggcatcgatccggtcgaagccgagcggacgggtcagccgccagaccggcagccgggccgccagattgaagctgaaggccctgagccccaccacccccagcagcgcctgggacaggcctggccggtaaagcgcgccatggatggcgcggatcgcatccagcccggtcagccggtccagacgcgccggcatctcgggatcgggggccgcagccagctccacaagggcaaccagcggcccgggtgcacggtcgggcctgcccctgccccccagcggcaacagggcgccgctcttgctccgtccttccaccggcacccagtcgccatgcccaagaccgaaagccgcgatcgcctcgtccgacaagcggagccgtggcacccccggccagccggcgatgatggtctcaggccccggtcgcgtcagcccggccacgtcgtcgatctgcagcagatcgtcggcgagcagggcgtggccacgcgcgagcagcgccccggccatggtcgacttgccggcccccgacggaccggtgatcgccagcaggcccgaggccgtgcgcaggctcgccacatgcagcggcatcagcccgcgctgcagcagcacggcggcgaagacgctgccgtaaagccagttgagcagtcgatccgggtggctgtcgtggtcgggccccggcgccaccccgatcgaccgtccgccgcggaccagatagcggcccgcctcccccagggaaaacagcacctcgtcgccggatgcctgccacaacaggccggtgttgtgggggtcgggcagaacctcgggcaccgcttccagccgcagtctcacggcggtcgcgtcgaaaccggcgggatcggcaggggtgacggcatcgctcaccagatccggcagggccagatccgaaaccagcccgaaggcgccgtgacgataccggtacatcggatcccgctcgtggttcttgtccggacagaggcttaacacgcaagaggggccgctgtcgacgcggcggcgccgatggcgtgtcacgatgtgcgcaccgggcgtgctagactatcggcaatccccgcagagaggagatgccatgcccgaggccgccttcacccatctcgtcgcctctcgcgaggggctctatgtcgcagggatcgccggctgcgagcgccgccgggacgggctctatttcggcgccaccatccgcgacggcgcggcctgggtgttcgaatcgctggacgctgatctccatgcccctaccagccggggccgtatcctgcgcctgccaatcgacccggccaccgccggcttcggcccggccgaggtggtcgccgacgggctcgacaatggctgccatcagatcgatttcgtccgcggccagctggtggtggtcgatacctaccgccagaaactggtggtcttcagcgaggatttctcgacctgcaccgtccactatcccgcgggccaggccgatgccgacacgggcgataccggctatgtccatatgaacgggatcggcggcgacggccgtgaactctatgtcatgctcagccatgccggcgttcagcctgcgcggccgtccgaagtccttcggctcgatgcgcagttcaatcaggtggagcgcttcacgctcccggggctgatgtgccacgatctggtggtgctggaagacgggcggctgatcgccaacggctcgatgggcggttttctgatcgaccgccagggcatcatcgcccagatcgacaatctgctcacccgcggcctgtcgatcgggacggacgatgtcgtgatcggcagttccaccttcggcgatcgcgaacgccggatcgccgccaccggccggctcaccttcaccggccgcgacctcgcgctccgcgcccgctatgacctgccggccgcccccacccagatccggcgcctggacggacgcgatctctcaatcttcgactaccgcgccacgatctgacggatcgtcggcgagcctccctcccgtttgcggaccgtcatccggcgcgaaacgggcaggcggcaagcagccggtccagatcgatccgacgcctgtggtcgcgatggccgtcgcgaatggtcttcagccgtgccgcatcgccgaccacgaccggcccgtcgatctcttgtccgatcgaggaatagaagtcgtgaaacttgaagccatcgccgagcggccggtccgaaagcttcatccaccgtgccggaatgccataggcctcggcacagatcaggccgtgcagcgaggacgaggcgatgaaatcgcaggcgcagatctgatcgacgacggcgaaaatgccgccggtgatgtcgatcagcaggctgtcctccggcatctgctctgccgtcagcagatccagttcccgacaatgcgggatcacgcccaggccgtagcgccggcccgccgggctcggggtatagaatttgggcagcagcagagcgggatcacccaccacatccgggcagtcgatgcccagatcacgcagccgttgccgggaaagatggccgcgcacggcgtgtatgcgggcacgcaccggtgccgccggcacctcgcccgtccgcaggaagccggtgccccagatgtcgtagggccgggtcagggcatgaagaagcgtgctgccgatggcgctgtagacggggagatccgtctcaccccggatgtcgtcgacatggagcacgttcttctgagacaggctgcgtgccagaaccgggttgagcttgtccccccacgttggccgacgccgccccgtcccgcacccaggacaaaagaagcaggctctcgcgagctgccagataaactgctcgcgaggcctgccccggtacctctccaatcatcaacatacgggatgtcggagccatctaccggaacgtcatctgctcaggagtagcccgtgccgtcggccgccggcgcaccgaatcccccttccgccgccttggcggaaagctttgccagcgtcgggatctcccactcgatccgggcctcggcgtcgtccgcgatcatcttgtccatctcgttcataagtccatctcctgtcgtctgatcagcaaccaagttgcactataatatatgatgttcagcgtggatggttcaggtttctatgctctctgtcggaaggccctgaacacacgctgataaacctcgatatccctgtcctcgttccgtataccttttgcccagagatatcgccaccgccgacgcatgcggagccgggcctccctgtccggcgggcaaaggcggtcggtgaacagccggacggcggcctcgatacccgaccggtccagcggtgcgctgccggctcccgtgatcgcggcaaaagtggcctgctccgcaaccgtggcgtcagggaacatccgcgcaaaatgctgctggcacagctgcgcatgacgataggcgatcagcggccggaagcgcccggtcttctgacggtcgtggaagcggtagtcgcaaagcacccgcggcagattggcgaagcgataatgcggcagcaggcgcacgcattgaacgagttcctgccggacgatcgcatccggcggataggggttgtcgcgcagcaccgcgccccggaacagggtggccgaatccaggatcgggcaggtgaagagggtttcgtagcggatggcctcgtgcccgcgggcaaagcggatggtaccgctggccgcgccgaagcggcgggcccaggcgccgcagatgtcgatcccgtgccgctccatccagttcagttgacgttcaagacgttgcggatgccagaggtcgtcatggtcgatccgggcgatgaaactgccctgggcagccgcaatcccggcattcaaagtctgggcatgcccctgatgtgggcggcacaaaagccggatgcgcggatcacgggcggcatggcttcggaccacggccacggtgtcgtcggtcgagccgtcgtcgaccacgatcagctccaggtgccgatgggtctgcgcaagcaccgaggcgatggcctcggcgacgaaagcggcgccgtcatagaccgccatgacgacagaaaccagagggggcggaggcacctgccgggccatgatgcacccgtctattccgtctcaggcacgatcagcagcatgccttccgcgaccagatcatcgacataggcgagggtctggctggtgcagctggcctcgtcgatcctgtaacggcgctgcagatgcgtgcagatgtcgcggatccgcaccggcgtttcggccgcctcccagatcacggcaccactgccgcccatggcgaaacagttgccggtctcctcgtccatcgcgaggatctcgcgctcggcgcgcgccgacaggatatcgggtttctggaccacaacgtggtcgagcgtcactctggccatggtggtgtctcgttttcaggtgaacggtcagaggaagcgggacgcgccgtcgcccgcgccgtcccgccgccagcttgaggaaaggtgatccgcaagcgcggagagcgacgcggagcctcggggtcgggtgacaagaatgacgggcgtatcggccaccagagccagccaccggcgccggatcaccgatgtggcgccggatgccgccatccagtccggtcggcgcaggcaggcaggcagaatctggcaggcttcaagcgacgacatccgtcgaagttccagctcagctccccaggcaagcagatagatcgtggtcaaccggcgcgggaccggtatggcatcggcccccaccgccaccaccgccttcccgtcccgccgcaacggcggcgtgaggcatcgtaccggcgcttccagcaggtcgatggcctctcgggtgagcctgggccgtgaagcggagggccagacgacgggccccggggcagcatcatgaaccaccagaagatcgtcgctgaccagctgatggccggcaagggcaagggccgcggcgagggtcgacttgccgctgccggtttcaccgcagagcgccacgcagtccgtcccgatcgcgaccgaggcggcatgcaacggcagaagaccgcgccgataggcgatcccgttcagcccggcggccgcgaccgcctgccccaccgcatgcggggccgccgcctcggacagccagaccacaacctcatgcgcatcgatggccgcgcagccgaaggtgtccaggcgcagaaccgggccgtcggcgggcaatggtccctgtcgaaacacgacatcagccggccccgccgagggggccggatcagtgtcgatctgcaggaaatcgatctcgctttgaatggtcagcccggcgacccggtaccggaacatccgcattttctttcgacaggggccgcacggcgacacatccgtcaatgaataggtcgaatccgtcagaatgtctaatctgcgggcgtgccactttcagatgcagcttacagcctcacgcccagccccaggcgtccagacgcagcacccggccctccaccgcccggtgaagcaggcgggggcttcggccggcgccggcgccggcggccaccatcagtggcatcagatgctcgtcggtcgggtggttgtcggagccgtggggcgcacgcttccgccagtcggcaagggcgtcgaggtcgccggctgtcaccacctccgccacccagtccgcgaaggcggcggcataatccgcctcgccgccgccggccgcgcggtggcggaagaagccgcgcaggtcgtgggtcaggctgccgctcgccagcaccagcacgttctcgtcggcaagcggcgccagagcctcaccgatcgcgagatggccggcggcatcggtctcggccagcgacaggccgaccaccggcacatcggctgcgggccaggccagcatcagcggcgtccaggccccgtgatccagcccccgctctgcgtcttcggcgacgggcaggcccgcggtcagaagaaggtcgcggacccgcgccgccagagcggcatcgccctgcgccggatagtgcaggcggtaaagcggttcgggaaagccgtagaagtcgtgaatggtcgcaggcctcgcggcggtcccgaccgtcggcaccccggcccgccaatgggccgagaccaccagaatggcccggggggccgccggcagcagcccgccgagacccgtgaggaaggcccgggtcgggctgcgaccgagcaccatgtccggggcaccatgagatacgaacagaaccggctgacggggggcgggacgatcggtcatgggcggggcgctccggacggacgagaggggatagtcaggaacgctgtgatcaggcccggacggggctgcggctgccgccggtcgcgcggccatagagcttcgggcccagcgccgcggcgccgtcgcccagcagaacctgcacgcccagggcggcgatccagaacaccgggaactcccagccgccattgggcgccgagaacacccagccgttgccggcatggaccagcgccgcaccgatcagaaccgggatctggccaagcgccaccagccgggtcgcgatgccgaggatcagcagcaggccgccaccgatttcagccgcgatggtgagataggcgacgatcggcggatagcccaaagaaccgaagaaggcgacggtacccggcacggtgaagataaagaccttcatcaggccgtgggcaatggcggcgatgccgagggtaaggcgcagcagcagggctgcctgggacgggttggaaccgctgagcaaagacatggcgaaacctccaggacgcatgagacgagcggcggcggagacgatggcttcaggcttccgtcttcccgtcgccccgggtgtgacatgaagctgccatcgggcgcctcataactcaaatcacctgcttgaagattcgatattgccgatgggaatatcgtggtgaagcccacggacagagggacaagcccttggacacgcgtgatccggatcgcatcgatctcaacctgctcaaggtcttcgcggcggtgatgaccgaacgcaatgtcggccgggcagcgctgcggctgggcatgacccaggccggggcgtcgaatgcattgcgtcggctgaggcggatcttcgatgacgagctgttcctgcgcacgccccggggggtggagcccaccacccgcgccgccgagatctggccgggcatttccgccgccctcggccagatgcgcgccgccctgaccccggccactcctttcgacccctgcacggtgaccggcgaggtcggcatcggcgtcaccgagattgcggaactggtgatggggccggcgatcgtccgtcatcttcaggcggaggctccggggcttgcgccccgcttccaccacatcgatcgccgcgatgccgcccgggcgctggatgacggcgagatctggctggcgctgggcatgctgcccgacccgccgccgcgcatcacccggatcttccttcgccgagacccgctgctgaccctggtgcccgacgggctcgacatcgacaccgtgccgaccggacccgaagacgggccggaggtgctgccactcatcaccctcgacgccttcgccgaagccccgcatgtcctggtttccgccaccggcagcgcgcagggggtgatggaccgggcgctggccgatctggggcgggaacgccggctgctcgccgtggcctccaccctgccgggtgctgccgagatcgcggcctgcgcaaaggccctgctgaccgcggtcggccccaccgccttcaccatcgcgcgccgcggcggcttcaccgtcatgcgccccccggccgagctgaacccgcagccggcacggctggcgctgatgttccatcgccgcgacgaggggctgcccgcccatcgctggttgcggacagaaatcacccggctggcgcggacgatctgaagcgggcagcgatctcgggatgaagcctggcatcgaagacggtgaccgccgggcccgccacccgtacccgcgtgggctcgacggtgcaggccaaccggccgccgcgcggcgaggcctggacggcctccagcaccgtgcgccccagacgttccgcccaccagggcgccagcgtcgcatggatcgatccggtcaccggatcctcagggatgccccagccggggcagaagaagcgcgagacgaaatcgatgccgctgcccggctcggccggcgcggtgatcaccagcccctcgggatggatgcagccgatcaccgtctggtcgggcacgaaatcccgcaccaggccggcctcggccaataccacgaacaggttttcgaaattgcgacccacgaagaccggcggcacggggaagatgccggccagcgcctcgggcagagccgccgccgtcatgtcgaagcgcggcagatcgagttcatagccggccggggtcgccgccacccggatcggcccgaccgcggtctcgaaggcgagtggccccgattcgcccagttccgcgatcaggacatgggcggtggccagggtggcatggccgcagaagggggcctcgtcgacgggggtgaaccagcgcagccgccgcacccccggccggcccggttcgggccaggtgaaggcggtttcggccaggttgttctcggccgccagcgcctgcatcgccgcaaccggcgccggcccgtccagcaccagcaccgcggccgggttgccggcaaagggccggtcggtgaaggcgtcgacctggaacatccgcatccgcgggcccccttacgtcagcgtgcaaccagcggtgtgaagaacagatgcgccccgccatcgaccatcagcgtctcgccggtgacatggggcgtgtcgaccagcgccaggatcgcgcgggcgacgtcttcgggcgcggccacccggcgcagcggcgtggtcttctcaagcttcgccttctgggcgtcgtagcggtcggcccccatgccctcgcgcagccaccggccctcgatgaagccggggcagaccgcattcacacggatctcgggccccagcacccgggccagcgacagggtcatggtgttgagcgcgcccttcgatgccgcataggcgaccgacgagccgacacccgcaatgcccgcgatcgacgagacattgaccacggcgccgctgcccgactgcttcagcgccggggcacaggcccgggtcatctggaaggcgccgaccacgttgacggcgtagaggtccaggaaatcctgcgcctgcagcccgtccagatcggcatggtcgcagaagcgggtggtgccggcattgttgatcagccggtcgatgcgcccgaaggcctcttcggctccggcagcgatccggcggcagtcctcgtcggaggcgatatcgcccatcaccaccaccgcccggccgccggcggcccgcaccatcccagccgtctcttccgccgcatcgcggctgcgcgcggcattcaccaccaccgccgcaccgcgggcggcgaaagccagcgccaccgcgcggcccaccccgctgcccgatccggtcacgacggcgacctcggcaggcgcgccctggttgctggtctcggcaggtgtggtcatggggtgcgtctcctccggtacggcgcgcggtctggtcgccgcgtgcgctttgtctgcaccttccggttatcgcgcggccaggggggcgggtccagtgcgacgccatgccggccgcactgcgggatttgccgtcgccagggccgccagcagcagcatggcgcctgcgacctgcaccaggctcggcatctcgccttcgatcggccagccgaacgccgcggtgatcaccggctgaatcagcagcagcagcgaggctgccccgaccggcaggcggccgagtgccgcggtggccaggccctggcctccggcatgggccaggatgcccaatgccgcgacggcggcccagccggcaaggctggagggcatcagaacctcgcccgatgccacggccagcaggcccagccccacagcggagaccgccgtggtgaccagcatggtggttccggcggcgatgctgcgccgggccgccttgatcgcgatcagataggcggcatagcaggccgccgccgccacggccgacaggtcgcccatgacgtcggccccggcacggtcgccggtgtcgcgaaccagcagccaggcgccggcaagggccagccccaggccggcgatcagcccgcggcccgggcgctcgccgccgaagatccacagggctgccaccaccatcaccggcgccagctggcagagcagggccgcgttggcgacggtggtggtcccgatggcgcgatggaagaagaacaggtcgccggtgaaggcgagcccggccgcgatcgcggcaagaagaccacgccggcgggcgccggatgcaggtatcgcgaccggctgccgccggtcgaccgtggccgaccacgcggccagcagcggcagggccaggaccatgcgccagaaaccggcggcaccggggccaacatcggcagcgcggaccaggaagggaacgaaggcgaggcagacgacggccgcgatcatcatcagccaggccatgccggtaccggcagccgtggcgacgacgaggggcccgccgccgggaacggcgggggaggaggagatcattggcgggggaacttcgcgtgcgggggagcgggggagtgcgaagcgccggatcgcgccggcatccgtcaccggagcgggggccgggcggcggatgcggatctgcgggggagagggggggagggcggcgcaatccggcagtggccactctgccgtcgcttccgctatgatgaaagtgaatgtttctgatggcagcatcacggattgtgatgctgagacggagatgacctcgatgggcacagccgaactcgcccttgcccgtgccggcctgcccggccgcccggatcccgtgctgccggcgctggatatcgatctgctgcgcgccctggtggcggtgatcgaccagggcggcttcaccgccgcggccgagcggctgaacctgacccagtctgccgtatcgatgcagttgaaacggctggaagaccggttggatcgccggcttgtggagcgcgaccggcggggcgtgcgccccacggccgatggcgaggtgctgatcggctatgcccggcgcatgctggcgctgaacgacgaggcggtgctgcgcctgctggatgccggtgcccgcggccgggtgcggatcggtgcgcccgacgactatgccagcgtcttcctgccgccgatcatcgcccggttcgcggccgccaaccccagggtcgagatcgaggtgcgctgcgccctctcccgcgagttggaagccgagcttgcccagggcggccacgacctgatcctggtcacccgccgcgacggccatggcggcggatccctggtccggcgcgagccgctggtctgggcggcagccgccgatcaccggcccgagacggcagaaaccgtgccgcttgccctcttccccgagggctgcgccttccggccccatgcgctctcggcgctcgaccgggcgcagaaaccctggcgggtggcgctgaccagcggcagcctgtcgggcatccagtccgcggtggcgagcggccttgccctcaccgccctcgcccgcagcacggtgccgccggactggcggattctggggtccgaggacggcttccccgccctgcccacggtggatatcgccctcaagaccgccgagcgtccgtcagagccggtgcggctgatggtccgccacctgctggacgcactgggcgcgccgaccatcgtgccgccggtgccgattgcacggccgatgacactccccgatccggtttctggttgacgaccgggggggcttgcgtgttcaggatcacgagattccccaccgtcaccggaagcccctgcccatgagccagctcggcccgctcgtcgacatcgtcacagcacttgccgccgccgtggtcatcgtgcccgtgtcgatccgcatcggcgcctctccggtgctgggctatctggccacgggccttgcggtcggcccccatggcttcggcctggttgaagagggcccggcgctgcatctcttcgccgaattcggcgtggtcttcctgctgttctcgatcggcctcgaactttctttcgaacgtatccggaccatgcggcgcctggcgctggggctgggggccgcccaggtggtggtgaccgccgccgtcatcgcggtgatcggcacggcactgggcctggcgccgatgaccgccggcattctgggttgcgccctcgcgctctcgtccaccgccgtggtgctgcaattgatggtggaacgcggcgaacaggtcacccgcatcggccgggtcgccatcgccgtgctgctgttccaggatctggcagtggtgccgatgctggcagccctgcccctgctcggcgcaccgggagaggatgcgctggtggcgctgggtctggcggtggccaaggcggcggtggcgctggtcggcatctctctggccggccgctatctgtcgcagcccgccttccggcggatcgcggcgctgcgcaacccggatgtcttcatgggggccaccctgctggtcgtgctgggcaccgccctgctgaccgcgcttgccggcatgtcgctggcgctgggggccttcctggccggcgccctgctggccggcaccgccttccgtcatcagatcgaaggcgatatcgagccggtgcgcggcctgttcctgggcgtgttcttcctgtcggtcggcatgggtatcgatctggcgcttgtgatccgcgagctgccgctggtgctggggctgacgctggggctgatcctggtcaaggcggtggtgctgggcggccttgcccgcggcttcgccctgccggtctctctgtcggtgcgatcaggcctgctgctcgcccagggcggcgagttcgccttcgtggtgatggcaaccgccggcagcttcggcctgatcgccccggccgaggcggcgccgatcgtggcggccgtggccttttccatggcgctgaccccgcttctggatgccgccggccggcggctggaacagcggctcaccccgcccgtcgccacgccccagacggcgctgggcgacgaggcggccgatcttgaggaacatgtgctggtgctgggcttcggccgggtcggccggactttggcccatgtgctggaaaacagccgccgcccctatctggcgctcgatctggacagcgagcgggtgacccagggccgtacccagggccacaacgtctttttcggcaacggcgcccgccgcgacgtgctgcgcgccgccggcatcgaccgcgccacggcggtcgtggtgaccatcgacaatgccggcgcggccgagcgtgcggtcaggaccatccgccatgccgcaccgggggtgcagatcatcgcccgcgcccacgacacccgccatgccgaccggctgcgtgtcgccggcgccgatcgcgtgctgcccgagaccatcgaggcgagcctgatgctcgccgccgcaaccctcgacgccgtcggccagtcggccgaagagaccgaagcctgcctgggccagctcagggccgacggctacgcccagctgctgccgctggtggtcggccgccatcaggatgacggtaccgaccactgatctgccgctccgcggagcacaggcttacatcggcttgaagtcgtcgctcgcagcgtcataggccatcagctgggcgcggccgatatcgtagtaccagccatggagctgcagtgtcccctgctccagccgctcggcgatccaggggaaggtcgccagattcttcagcgacaccttgatcgattcgagttcgcagatgtgctggtgctcgtgggcatcgacatgggcatgatcatgcagcacctgctcacgcacgccgtcgatctgcgacatccagacatcgatgaaatcggtgctgggctgggtcggatcgcgctgcagcagggcccggatgccgccgcagccggcgtggcccatcaccacgatgtgttcgaccttcagcccgtcgaccgcgaattccagcgccgccgaggtgccgtggcgagcgccgtcgggctcgaagggcggcaccagattggcgacattgcgcaggatgaacaggtcacccggatcggccgaggtgatgatcgcgggatcgacgcgactgtcacaacagccgatcaccatgaccttcggggtctgctggcgcgccagcttttcgaagaattccggccgggtctgcatggcatcgtcgcggaagcggcgaaagccgtcgatcaccttctcgagcgcgttcaatatcgtctcctcgggcatccacggcaccgcatgcggcaccgtctggctctggacttcccccatctctccagccttctagatagcatcgccccccaggcggcgaaagtccccgccttgcgcagtggtgcaacgccatcggcgggcgatatcacgctgcggtaacatcgccgccacgaaaccgtcaaaaggccacggtagaaccgcgaccagtcgacggttctgcaccctcgtctcaaccgtcgatccggtgatccatcatgagcacatccgacgccgtgtcccgtcctgcttcacgcgccagcctgcctgccggcttcgtcatcggccatcgcggcgccagcggtcatgcgcccgagaacacgctgccggcaatccgccgcgcggcggaactgggtgcgccgatggtggagttcgacgtgaagctcacccgctccggcgtgccggtgctgctgcatgacgaccgggtcgaccgcaccaccgacggccgcggcccggcggcaggcttcgagctggcggcgctgaaagcgctggatgccggcgcctggttcgcccccgctttcgcccgcacccgcatccccaccctggccgagaccgtggcgctgctctctgaaaccggtctcgatgccaatgtcgagatcaagccctgcccccatcgcgagaccgaaaccgcggcggtcgtggcggaagagctgcgccgtttctggccggcgggcaagcggccgccgctgctgtcctccttcgagatggcctcgctccgcgaggcactcagggtcgcccccgatctgccgcgggccctgctgttcgagggcctgcccgccccccataccctggatgcgctgatcggcgagctgcgccccgtcgccctgcatctgtgggagcgggtgatcgacgaaggggtcatctcctgggcgcgcctgcgcggcctggagctcagagcctggacggtcaacgaccctgcccgtgccgcgcatctccatgccctcggcgtcaccgccgtgttcaccgatttccccgaccggatcctgtccggggcaggctgatcccgcccttcgccgcagacgatccggtcgacccgcacctgtccccaagaccgacaccggaagacagcacctccggaccctcagggagcgtcgtcatgaacaagacctggatcgtcgccgcggccgtggccgccggcttcaccgtcggcggtttcgccggtgccgccgatgccgccaccaaggtggaatggtggcatgccatgggcggcgagcttggccagaaggtcgagcagatcgccaaggacttcaacgccggccagtccgactacgaaatcgtcccggtctacaagggcaattacgccgagaccatgaccggtgcgatcgccgccttccgtgccggtcagcagcccgcgatcgtgcaggtgttcgaagtcggcaccgccaccatgatggcggccaagggcgccataaagccggtctatcaggtgatggaagaggcgggtgagcccttcgatcccaaggcctatctccaggcggtgaccggctattacagcaccaccgacggccgcatgctgtcgatgccgttcaacagctcgaccccggtcatgtatgtcaatctcgatgcggcgcagaaggtcggcatcgactacaagaccgatctcgcgacctgggaacaggtcggcgactacatcaagaaggcgcaggctgccggctctacctgcggtctgaccaccggctggccgtcctggacccagctcgagaacgtctcggcctggcacaaccagcccttcgccagcaaggaaaacggcttcggcggtttcgacaccgagctgaccttcaacggcccggtgcaggtgaagcacctggagacgctgggcgaatggcagaagaccaaggccttcgactacggcggacgccgcagcgatgcgcgcccgaagttcatctcaggcgaatgcgtgctctatatcgacagctccgcctcgctcgccggcatccgcaacggcgtgaaggacttcaccttcggcgtgaccatgctgccctactggaagagcgcggtcgaaaagccccagaactcgatcatcggcggtgccagcctctgggtgctgaacggcaagtcggccgaagagtacaagggtgtcgcgaagttcttcagctacctgtcctcgcccgaggtccaggccgactggcacctgttcaccggctatctgccgatcaccacggccgcctatgactatgccaagcagcagggtgcctatgacaagacccctgaggccgaggtcgcgatccatcagatcaacctgaacccgcccaccgccaactccaagggcctgcgcctcggcaacttcgtccagatccgcgacgtgatcgaggaagagatggagcaggtcttcgccggcaagaagaccgcgaaggcggcactcgacgatgccaagacacgcggcgacgagctgctgcgccggttcgagcgcaccgccggcaactgatcgcccgaagatccgtgctgccggcccgtgcgggggcatgtcccccgcacgggccgcatcgcttcgcctcccatccgcccggaacccctccgccccatggccacacgctcgctctttcgcggcagagccctgccgcttgccctggtcgcgccccagatcgccatcaccctgatcttcttcgtctggcccgcggcccaggcgctgaaacagtcgatgctgatcgaggacgccttcggcttcggctcggaattcgtctggttcgagaatttcgaaagcgtgctgaccgatcccggctatcacaacgcgatcgcggtcacggcgctgttcagcatcggcgtgatgctggtctcgctgagcctggggctgctgctggcggccctggtcgacggggtcacctcacggcgggtcggcgccatctaccgggcaatttcggtcgcgccctacgccatcgccccggcggtcgcgggcgcgctctggttcttcatcttcaaccccacggtcggcatcgtcacccattggctcggcctggtcggcatcgactggaaccatgtccgcaacggtgatcaggccctgctgctggtgatcctcgccgccgcctggaagcagatcgcctataatttcgtgttcttcctggccgggctgcaatcgatcccccgatcgctgatcgaagcggcggcgatcgacggggccgggcccgggcggcgtttcgtcagcatcgtcctgcccctgctctcgcccaccgccttcttcctgatggtggtgaacctgacctatgcctttttcgacaccttcccggtgatccatgcggttacccagggcggccccggcaatgccaccgaaaccctggtctacaaggtgttccgcgacggcttcatcggcctcgatctcggccggtcggccgcgcagtcggtgatcctgatggtggtggtcgccgccatgaccgtggtccagttccgctgggtcgagcgcaaggtccactactgagcgaggagtcctcccatggccatggtcgaaggcggcacccgctcgcgtctcgtccgtcatgccctgatctgcggcctgctcgccgcgatcgtctttccggtctatatcgccttcgtgacatcgacccacgaggcttcgaccatgctgcagggcgtgatcccgctcctgcccggccccgatctggtcccgacctatgcccgggtgctcgccaccggcattccgaccttcggcgacctgccggtggcgaccatgatgctgaactcgctggtcatggcgctcggcatcgccatcggcaagatcgtgatctcgctgctctcggcctatgcgatcgtcttcttccgcttcccgctcaggatgctgtggttctggatgatcttcgcaaccctgatgctgccggtggaggtcaggatcgtgccgaccttccaggtggtgtcggatctggggctgctgaacagtttcggcgggctgatcgtgcccctgctcgcctctgccaccgcgaccttcctgttccggcagttcttcctgaccatcccggacgagctgatcgaagccgcgcgcgtcgacggtgccgggccgatccgctttctggtcgacgtgatcctgcccttgtcgcgcaccaacatcgcggcactgttcgtgatcatgttcgcctatggctggaaccagtatctctggccgctgatcgtgaccaccgatccgcagatgaccacgatgctgatcggcatccagcgcgccctgtccggcagcgatgagctgaccccctggaacctggtgatggcgatgagcctgctcgccctgctgccgccgctcgcggtcgtgctcggcatgcagcgctggttcgtcaagggcctggtcgacgcagagaagtagttgttggcgggggagtcttttagcccctcgccgggcgggtgctgccgcacccttggccgccgcctcaatggcggctgttggcgaccctcggcccaagcgggtgctgccgccgcctcaatggcgggagtgttttagcccctcggcccaagcgggtgctgccgcgcccttggccgccgcctcaatggcggcttgttgaccaccatcgtccgtatgcggaatcccgtcttaatccgaaggcagagctgtcccatgagcacgctgaccctggccgatctgcgcaaatcctatgccgacaccccggtcatccatggtgtcgatctcgatgtcgccgatggcgaattcgtggtgctggtcgggccgtccggctgcggcaagtccactttgctgcgcatggtggcggggctggagacggtcaccgccggccggatcctgatcgacggccgggtggtgaacgagctggagccccgggatcgcgacatcgcgatggtgtttcagaactacgcgctctacccgcatatgaccgtgttccagaacatggcctacgggctcaagatccgcggcatgaccaaggccgagatccgccggcgggtggacgaggccgccgccatgctgggcctgggggccctgctcgaccgccggccggcggccctgtcgggcggccagcgccagcgcgtcgccatgggccgcgccatcgtgcgcgagccgaagctcttcctgttcgatgagccgctgtccaatctggatgccaagcttcgggttcagatgcggctggagatcaagcgcctgcatcagcgcctgggcgtcaccagcctctatgtcacccatgatcaggtcgaggcgatgacgctcgccgaccggctggtggtgatgaacggcgggcgggccgaacagatcggccggccgctcgatctctatctccggcccgccacccgcttcgttgccggcttcatcggctcgccggccatgaacttcatgcccgcagccctgtcgtccgatgcggttctggttcagggcgaccggccgatccgggtcgatccggcggccatgggccttcagggtctgaccggtacggccgggaatggtgcggccggggagggcgccgtgctggggctcaggcccgaagacctgcaccgcccgggcgccagcgcgcttgccggcgcgccggtcatggagctggggctggaggtgatggcggtagagccgctgggggccgataccctgatccatggccggccgaccgccccctgcggcacggcgctcgccgatgcggcgggcgaggcccgcggcctcgtcaccgcccgcctggccggcgcggtcgaggcggcgcccggggcgcatctggccctccaggcgcggctcgaccggctgcatgtcttcggcggcgacggccggcgcctcggcgcctgaccgcccgcccaagatgatcagccgacctgcggcggcgccgtgcgcgctctctcggtcccattctctggggcaagccccacggtgacgcccttgggcgcgatcagatgcacgtcgcgctgcgggaaggggatgctgcagccggcggcttcgaccgccagcttggcgcgcttcatcatgtcccagcgcaggctccagtagtcgccgatcgccgcattgaagcgcatggtgatgtcgaccgagctttcgcccagattggtcaccatcacctgcggtgcgggatccttcagcacccgttcatccgccgccagaaccgccgacagcgcctcgatcgccgtgtcgatgtcgtcgtcataggcgatgccgaccacgatatccatgcgccggatcgggttgcgggcatagttggtgatcggctgcccccagacctggctgttgggcaggctcatgaacaccccgtccgccatcttcagttcggtggtgaacaggttgacgttgatcaccgaaccggcgcggccgccggcatcgatgaaatcgccgatccggaacggcctgaggaagagcagcatgatgcccgccgccacattcgacagcgtcccctgcaacgccaggccgatggcgaggccggcggcgccgagaatggcgatgatgctggcggtctgcaccccgaactggccgaggacgatgatcaccgtcaggaccaggatgccatagcgcaccaggctggcgatgaacggccggagcgtcgggtccatgtggctgacccggccgagggagcggtccacccccttctccagccagcctgcgatcagccagccgccgatcaggatggcgatggcgcccagaaccgccatgccataggtcaccgccagcgtgctgagagccgcaatcacggcatcgatttcggtcgtcacctgatccatgcggacgaggtctccttatcggtccatccacgccgatgtcgtccgggtcgggcgactgaccagatgtcagcgggtcaggcggccgatcagctcctcgttacgacggcggaccatgcctggaatcaggaacaggtccaggaacagccacagagcaagcagcgcatagccgagatatccgaccaggaaaaacaccagcacggcagatatgccgttcaatgccagcatgatcaaccccgagacccaggatccaagatacatccggtgcacaccgaaccatcccaggaagaaccagaggagataggcgagcagcgcgctcttcttctcgttgtcatagcgcatcatcatgacggtctggtcggttccgccggtgcggcgctcttccggccggagaaaatcttcgtctctgctcatgggatggtccatcctgaacgcggccgcgggatgctgccggggggtttcacatggaaccatgcccccttgcgcaccgcaacctcggccccggatacaagggtccggtcctaccggtcggaccgtgtcagaccctcaagcgctacggccagttcctgccccagccgctcgacgagcccggcgaccggcagcgaccgggagagcccggcccccgcccccgcccaccaggcctgggcctcgggcacgcccgccgcctcggcgcgggcgcggatcggtttggtcagaccgtgctgggccggaaatgccgccagcatcgccggttccgccggcatggcctctccggccgccagcagcttgcgggcctgacgcgcggtgaaggcgcgggtcagcacggtccgcccctcgccggccgccgccgcctcggccagaagccggcgatggccgggcttcgtgccggcctctgcggtcgacagaaaggccgtgcccagctgggcgccggcggcacccatggcgagcgcgccggcaatgccgcggccggtcatgatgcccccggccgcaatcagcatcaccccggcggctgccgcctctgcggccagcgcttccagcagggccggccagccgaaggccggggcggcccgtccgcatcgaacatgccgctatgcccgccggcatcggcgccctgcagcgcgatcatctccacccccgccgcgatcagcgcccggccttccagcggcgtggtggcagtgccgatcagcgcgatgccgcgcgcccgcgccgcctcgaccagccctgccgggggcaggcccatggtgaagctcaacgccgccggcgcctcgtcgagcacggcacggatctgggcatcgagcggcggcgcggcatccgagacatcctcgggcagtaccgcccccacccgcgccgccagcggttccagcgcctggcgtgcggccgcgatctcgtctgccccggcgatccgtccctgatggaagaacaggttgaccgcaaacggccggtcggtctgcgcgcggatcgcccggatctctccggggatgtcctgggcgcgggtataggcggcccccaatgaccccagaacccccgcctcgcttgcaccggccaccagatcggcggtggtcggcccaccggccatgggcgcctggatgaccggcaggcggagaccgaaacggcgggtcagggcggtggcgatgaggggacgggcagacatggcgacaacctccgggggcttttgaaccgctttcagcttacgtcgcaccaatgcttgcacaccagcgacgatgagtggatcatgttttcagtttttttgaaaacatgagccttccgatggacctggccgacctggcagcagtgaaagcggtggcagagctcggcggggcgaccccggcggccgagcggctgaactgcgtgccctcggccgtcaccgcccgcctgaagcggcttgaagccgaactcgatgtcgccctgttccgccgccgctcccgcggactggacctcaccgaggccgggcagcggctgaaagactatgccgaccggctgctgatgctggccgaagaggcccgccacgcggtggccggtggcggtatggccggtctgccggtccggatcggtgcgatggaaaccatcgccgccacccgcctgcccggcattctgggccgcttccgtcgccaggccggcagcggcgcccggccgatcggccttgccaccggcaccaccgacgaactggtcgcggatcttctgcgccatcgcctggatgtggcgctgatcgcgggcccgctcgaccaccctgccctggccagccgccgcgtctggacggaacggctggtccaggcggcccctgtcgccggggcagagaccggcagcgacgggctgcccctgccgctgatcggtttccggtcgggctgcgcctatcgggcgcgggccgagaaactgctgcgagaggccggccgcctgccggtccgggtgctggagctgggcacgctcgacggggtgatcggctgcgtggcggcagggctcggcttcaccatcctgccggaacgggtcttccagggtcataccggccccggcatcgccctcacccccctgcccgccgccgccgcggaggtcgaggtgctggcggcctggccgcgcgggcgcggcgacggtctggccgaagccttcgccgccgcggcagaggcggcctaggcgcgatcaatcctgcggcagccgctccatcaggaagcgggccgccgcctcggcgccctgctggtcgatgccatgggcaaggccgggccggcggatcagcgccgcctggatgccggccgcctcgagcttggcaagcgcatggcccgaggcctcgaccggcacgaccgggtcgttggtgccgtggatcagcagcacgtcgggccggcgcgcgccctcggccatcggcggcacctggccgagcatggcccccgaaaagcccacgatcgccgccggcggctggtcgagcgccagccccacccccagcgacatcatcgtgccctgcgaaaagccgatcagggccagccggtcggcgcccagcccgtggatcttcagcttcccggccagaaacgccctgagcggcggcgcagcacgggcaaccccggccgccatccttgcatgggccgccgccatgttggccgggtcgcggcgcagcatgtcggggtcgtaatcgtccaggccgaaccactgccggccgaagggcgacatttcgcacggatacggcgcatccggcgcatagaaggcggtgtgcggcagcgcctgggcaaagaacggcgccagcccgatcaggtcctggccgtcggcgccatagccatgcaggaagaccacgatccggcggacgatgccgtccttgggcagaagatcggggccggtcagggtggcgggcgcggtcatgggtctggtctcccgaaaagacaggcggtcggatgggtcactgcggcaggtgatcgtcgaggaaagcggtcgccgccgcaagcccggcgaaatcgacccggtgatccagccccggccgggccagaagctccacccggaagccggccgccccaagccgcgcctgcacccagcgtgccgcggcgaagggcaccacgtcgtcggcctcgccatggaccagcatcaccggcggccgggatcccccctccggcagttccggcaacgcccccagcagcgtgcccgagaaccccaccaccgcagccggtgccggctgccccgtggccagccgcgccatcatcatcgccagcgacatcatctgcccctgcgagaagccggcgaaggcggtcgcggcggccggcacctccagggacccgagcagaccacggatccgggcatcgagtgccggacagacggccgcggcattccggcccatcagggcatggcccgcggcatctgcgggcagcatcgccgccggatcgcccgccacccagcccgggcggaagccgggggtggagaaccactgccggccactcaccccctcggggcaggtctcgccgccatcggggcagaagaaagccgccgtggtcatccgccgcgccatgcgccgggcgagcgccatcatttcgcgaccatcgccgccatagccgtgcagcagaacgaccagccggcgcacggggccatcctcgggcagaagcagttcatgagcctggacgggacttgtggcctggacgggactggcggatgacatgcgggctccgtggcgtcaggatcatgcgggccggggtgcagcgatgccgccgagcctggatcagatcccctccgagtgcaatcatccggtggcgtcaggacgcctcggacatcacgccggccaaggatacccaagctgatgagcgacgacacagagacccggcagcgggctgatatccaggccctcctgcgcgcccacgccgccttctatgaagccttcgtcacccgcgatttcgccgccatgcaagcgatctgggcggcgcggctgccgatcgcctgcattcatcccggctggggcgccctggtcgggcgcgaggcggtgatgaccagctggcggacgatcctggccaacccgtccagccccacgcttgcagtcgacctgatcgacgtcaccgtctatgacagcaccgcccgcatcctggcctatgagcggatcaacgatgcggtgctgatcgcgaccaacctgctggcgcgcgaggacggggcctggaagatcgtccaccaccagtcgggtccgaccccgccgcccacggaatacgcgaccgtcccgccgcatcgcctgaactgaccgtcctgctgcacccgcggcggggttgcgaccgtcacacggcccgtgacatcgtcgacggaagggtgcggtggccgtgcccgtcgaagggagagtgcgatgctggaactggcgatcagtgccttcgtcaccctgttcgtggtgatcgatccggtcgggctggcgccgatgtatggcgcgctcacccgcgagcataccgaggcgcagcgccggcggatggcctgtcgcggagtgatcgtgggcgggctggtgttgctcggcttcgcgctgggcggcgaggcactgctgaatgcgatcggcgtctcgctcgatgccttccgggtggcgggcggcatcctgctgttcgtcgtcgccttcgacatggtcttcgagcggcgcacggaacggcgcaagcgtcaggtcgaagccgcccatgccgccgacacccaggccggggccgcggcgatgctggcggctgaatccgccttcgccgcccccgaacttctggaagaggctttcgagcacgaacacgaggatgtctcggtcttcccgctggccatcccgttgatcgcggggcccggcgccatcacctccaccctgctgctcaccacccgggccgggggtgattgggtcgcgacgctgctggtgctgggcatcctggccctggttctggcctcgacgctgggcgcgctgctgatcgccggccggctgaaccgcctgatcggcgaaaccgcggccgcggtgatcagccgggtgctgggcatcctgctggccgcccttgccgcgcaattcgtgctcgacggggcggcagagctggtcgtcggggtgatccgccagggagcctgatagctcaggcggcctcggccgtcatccgccagcggcggcgcatcaccttggccacggcctccagccggcgttccaccacctcgcccatcagatcgcgcccgcccgggcgggcgcgcagggtcagcgcctggggcgtcagctccagctctccgcggtcgagcagggcgggggcgcagcccgagaaggtatcccccagcctcagggccagcccgatcagccgggcgcgggcctgggccggctggtcgagcagatcccgcgccggccgggcatgcagcccggtgatgttgccggcatagcgcgcatagaccgccagcgccagaaaggcgcgctcgcgatggcgcagcggcaggaagggcatggtcaggatctcttcgatcgcatgatcggcccgccggtcgggatgggcggcgacggcgatttccgacagcagacaggcggcatggcgcaggcgcagatcattgggcgtctcgccggcaaacagcggcgcgatccagtcatggacccggtcgccataggcgccgaagcccgaatgctgatcggcgatgtcgcggcaggcggccatcagcggatcggcggccctgagcgccgccggcaggttctcgtagagcacgccctcgcgcaggccataggtggagaacaccacctcggacggcttcacccgtcgtaccagcccggcaagcgccgccgcggcatgggggagggtcgccagccgccgggccggtgccgccttgagccgggcaagatcggccgccttcatacccatcactttgtcggccagtgccagggtctggggcatgtcgagcgtgtagcggtggatggcggcgatcggatggcgggtttcggcgatatgaacccgcgcgatggcacgccagccgccgccgaccagatagagcccgcgcgcggccgcctctgccgcccagggggcgtcgtcgagcgccttctccaccgcctcggtccaggcccgggcgtcggagccgcgggcggccaggcgcagcgcgcccaccggcagggtgatctggcgacccacggccccctgctccacccgcaccagttccagcgaaccgccccccagatcggcgaccagcccgtcggcctcgggttccgaggacagcacgcccagggccgagagcgtcgcctcttcgacaccggtcacgatccggatcggaatgccgcactcccgctccaccctctggatgaaggcggggccgtcggcggcatcgcgcacggccgcggtcgccaccgcaatgatcgcatcgccggcaagctcgcggccgatggcggcgaagcggcgcagggccagcgccgcggcgtcggcccgttcagggtccagccggccggtatcggccacgccggcgcccagcgcgcacagcgccttttcattgaagatgggctgcggcatgcgcttcagcccgtcgaagatcaccagccgcagcgagttcgagccgatatcgatcacgcccaggcggcgcgggccgttgccgggaagacgcagatccggcgccgcatcggtgccggccgtggtcgggaatacccgttcgctcatccactccgtccgcttggggtgtgcggtccgtccatcctgtcaccagccacgggcaacgcggccgacccgtcaggtcagcgacaggtggggcacttccccccgcttccgcagcgccttgccccggcccgacaggctgggattggtcatgaaatatgtatgcgccgagaagccctcgccaaccggggccatgcgcttatacacgccgtcgggaccgagcgtccagctctggagcgtgtccttcagattggcgaccatgatctgatccagcacctgctggtgcacggtcgggttctcgatcggcaccagggtttccacccgccggtcgaaattgcgcggcatccagtctgcggaagagatgaacagtttcgcctggggcgagggcagcgcctggccattgccgaagcagacgatgcggctgtgctccaggaagcggccgacgatgctcttcacccggatccgctccgacagccccggcacgcccgggcgcaggcagcagatgccgcggatgatcaggtcgatctcgacaccggcctgagaggcgcggtagagcgcatcgatgatcagcgggtcgaccaggctgttcatcttggcccagatcgccgccggccggccggcctgggcattggtgatctcgccgtcgatatgctccagcaggcgcaggcgcacgccgcgcgggctgaccgcgatcttctcgaaatgcgacggctcggcatagccggtcagatagttgaacagataggccgcatcgcggcacagcgccggatcgtcggtgaagaaggacaggtcggtatagatcttggcggtgatcgggtgatagttaccggtgccgaaatggacataggtcgtcaacccctcgccctcgcgccggaccaccaggctcagcttggcgtgggtcttgagcgagatgaagccatagaccacctgcacgccggcgcgctccaggtcgcgcgcccagcggatattggcctcttcgtcgaaccgggccttcagctcgaccagggcggtcaccgacttgccggcctcggcggcggcgaccagcgccttcacgatcgggctgtcgttgctggtgcgatacagcgtctgcttgatcgccaccacattcggatccatcgccgcctggcgcaggaactgcaccaccacgtcgaagctctcatacgggtggtggacgatcatgtccttctggcggatcgccgcgaaacagtcgccgccatgctcgcggatgcgctcggggaagcggctgttgaagctctggaacttcaggtccggccggtcgtcgatgatcagctggcggatgtcggccatgccgggcatggcggtcaccaccaccatgtcggggctcttcacgcccagttgcgccgacacgaagttgcgcaggccttccggcatttcatcgtcgatctcgagatggatcacgctgccgcggcggcggcgcttcagcgcgctctcgaacagccgcaccaggtcttcggcctcttcctcgatttccagatcgctgtcgcgcagcacccggaactcgcccgaggcgatgacgtcatagcccgggaacaggccgtcgatcagcagcaggatcgtgtcctcgatgccgatcatccggacctcgtcggtctcgggcaggcgcacgaagcggccgacctgggccggcaggcggaccagcgcgttcatcatcgtgccgtcggccttgcggcgcagttccagcaccagcgccagaccgccattggggatgaaggggaagggatgggccggatcgacggccagcggggtcagcaccgggaagatctggttgcggaaatgctcgtccagccagacccgttccttcttggtcagctcggacggcgagaccacccggatgccctgctccttcagctcccggcgcagcatgcgcaccgaacgctgctgctcgcgcatggtgtcgtgggtgcgctggcggatctggcgcagctgctgggccggcgtcagcccgtcctggccgatcagctcgatgcccatctccacctggctccacagccccgccacgcggaccatgtagaactcgtccagattgttggccgagatcgacaggaaccgcacccgctccagcagcggatggcgggtgttccagctctcttccagaacccggttgttgaaggccagccacgacaattcacggttgatgaagcgctgcggcgaggtgatgtcgatccgccgctggccgcgggcgggccggcttgccgccggggccggggctgccacgggttccaccgcaaccgtcgccgccgccaccgcccgggcctcgacctcggccgcactctcggcggaactcggcacgacgcttgcggcaccggccgccgctgcggcctcggccgcagccgcctcgctgaaggtggtggaggtcccggcctcggcggccgtttccaccgccggggccgcggcggcgtcggtttcggtggcaggctgcgcggcgcggggggtggtcggcaagatggctctcctgggcgggtatcaggcgtgaaaacaatgttcacgatagcggatctttgttgcggatgcatgatcgagatgccatttcgcgcctgagcccgcggatcggaccgcgcccctcacttgcccgggagactgcccccgaatgccgcgcctgatcctgctccgtcatgccaaatcggcctgggacgaccccgccctcgccgatcacgaccggccgctcaaccgccgcggccgcgccgccgcccggctgatggccaaacctgtggccgaggcggccccggacctggtgctctgctccaccgcccgccgcacgcgggaaacggtggagcatatggtcgatgccggtgccttccccgccggccgcgtggtccacgacgctgcgctctaccatgccgccccggccgccatcctggccgtggtcggcatccatgcggccggccacgcggcggtgatggtggtcggccacaacccgggcctgcacgagctggcggcatcgatggcgaccgccggcgacgaccgggcccgcacggccctcgccgcgaaattccccaccgccgccctcgccgtcctcgatctggcggggcccggatggcggccgggcgacgcccgcctgacccgcttcgtcaccccacggatgctggaggccgccgccggtcagtgacggccaatcaggctgtcctccggcgcctcggcacgctggtgcaggccgtaatccctgagcaccgtcatcacccgcacatggtaatcatggaaaatccggtcgcgcccggccttctgagccgaaagatgagggtccagattgcgccagcgcaggacggccgcctcgtcttcccagatcgtcaccgacatcactttggccggatggagcgtgctctggaagcattcgaccgaaatgaagccctccatcttctgcaacatcggctgcagccggttcaccatgttcacataggtctgattctgtccgggcacggcttcgagttcaaaggtcacgacgatcactgaacgactcctcgccggtttaagtgaatggcagggcgatagaccgggtggcgccggcaaagggtcacgacctgctcccggacccgatcgcgaacggcgggggccgcaccggtccccagcgcgtcgagcacatcggccagccagccggccagagcctcgcagtcggcgatgccgaagccgcgggtggtgacggccggcgtgccgatgcgcaggcccgaggtcacgaagggggagcgcggatcgcccggcaccgcgttcttgttgactgtgatccaggcatcggccagcgccgcatcggcatcccgaccggtgaaggcgcggtcggagagatcgatcagcatcatgtgattgtcggtcccgcccgagacgatccggtagccgcgatccatgatcacccgcgccatcgcccgcgcattggccagaacctgtttctgataggtccggaacccgggcgagagcgcctctctgaacgcgaccgccttcgccgcgatcacatgcatggccggcccgccctggatgccggggaagaccgcgccgtcgagcttgcggtagaacgcctccccctgccccttcgccaggatcaacccgccgcgggggccgcgcagggtcttgtgggtggtgctggtcaccacatgggcatgcggcagggggtcggggtattcgcccgccgccaccaggcccgccacatgggccatgtcgacccagaagatcgcccccacctcgtcggcgatcgcccgcatgcgggcccagtccttgcgccgggaataggccgaaaagccgccgatcagcatccgcggccgggtctcgcgggcgatgcgggccatgtcgtcataatcgatcagcccggtttcgggattgagcccatagggcacgatccggtagtgccggcccgagaagttggccgggttgccatgggtcagatggccgccctcggacaggttcatgcccatcaccgtgtccccgggccggaccagcgccaggaaaatcgccgcactcgcctgggcaccagcatggggctggacattggcatagtcgcagtcgaacagggctttcgcccggtcgatcgccagccgctcggcgacatcgacatgcgcgcagccgctgtagaagcgccggccgggatagccttcggcatatttgttggtgaagaccgagttctgcaccgccatcaccagcgggcttgcataattctccgaggcgatcagctcgacatgatcttcctggcggtcttcctcggatgtgatcgcccgggcaagctcgggatcgacatcggcaaggcggatggacggatcatacatggcgggaagctcccatctgtccggaagaggcggggtcagtcgagggtggccagcaggcgggtcaggcgggtgaccacctcgtcgatctccgccgtgccggcgatcagcggcggcagcaggcggatggtgttggcgcgggtgacggtgatcagcagccgttcctccagcagcgcccgaccgaccagatcgccgcaggggcgatccagttcgataccggccatcaggccgatcccacggatggcgaccacccgcggatgcccggcaagcgccccccttaacccggcgagcagtcgcgcgcccagcatcgccgcccgctcgggcagccggtcgcgggccatgacgtcgatcacggtgcaacccacccggcaggccagcggattgccgccgaaggtggaggcatgatgaccgggggagaacagcgccgccgccgggcctcgggccaggcaggcgccgatcgcaaccccgttgcccagccccttggccagcgtgatcacatcgggggcgacgccggcatgctgatggccgaaccaggtgcctgtgcggcccatgccggtctggacctcgtcgatcatcagcagccagccgtgccggtcggcaagggcgcgcagcgccctcagatagccgggagaggccgggtgcaccccgccctccccctgcaccggctccagcaggaccgcgacgatgccgggctgttcgtcggcaagcccgcggacggcatcgatatcgtcatagggcacgcgcaggaagcccggcatcagcggctcgaacccccgctgcaccgccggattgccggtcgccgccagggtggcgagggtgcggccgtggaaggcgccttccatcaccaccacctgcggggcggccacccgcatcgccgcggcatgcagccgggcgagtttcagcgccgcctcgttcgcctcggcgcccgaattgcagaagaaggcccgggtcatccccgacagggcgcagagccggcggcccagctcctcctgccagggaatgcgaaacaggttcgaggtgtgcagcagctcagccgcctgcccggcgatcgccgcggtgacctcgggatgggcatgaccgaggccggtgacagcaacgcccgagatcgcgtcgagatagtcgatgcccgcctcgtcctgaagctgcatgccccggccgcgcacgaaggcgacgggcaggcgcgcataggtctgcatcagacaggcggtgtcgggatggatcaccgggcggctccttcgcgcgagggccggggggcgaccggccgcgccgacgggccgcggcggcagagcgccagatgcgccagaagaccgatcagcaaaccccagaacgcgccgccgatgccgagcatggtgatgttggcggcagccgccaggaaagtgatcagcgccgcctcgcggccggccgggtcggcgagcgccgaggccaggctgccgccgatcgtgcccagcagggcaagcccggcaagtgtggtgatgaaggttgcgggcagggtcatgaaaacggcggccagggtcacgccgaacacgccgaccaggatataggcgacccccgccgcgatgccggcgatccagcgcttcgacgggtcctcgtgtgcctcgggcccggtgcagatcgccgccgtgatcgccgccagattgaaggcgtgggagccgaagggcgccatcagcagagagccgagcccggtgacggtcacgatcgggctggcgctggtcttgtagccgtcattgcgcagcaccagcatgcccggcatgtactggccggtcagcgtgatcaggaacagcggcagggccaccgacagcagggcgttgagcgaaaacgccggcagggtgaagacgggggctgcgaccgcaagctccagcccctccagatccacccgcccctggatcagcaggaagcccagccccagcaccaggatgcccaccaccgcatagcgggcggtgaagcgcttgatggtcacataggccaggatcagcagcccggcgagcagcggatcgatgctcatgccaccgaaggcgccgatgccgaactggagcaggatgccggcaagcaggccggccgccacccccggcgggatcagccggatcacccggtcgaaacagcccgaaaggccgagcaccacgaagcccgcggccgagatcagataggcgccgatcgcctcggcatagggtgtggtctgcaacgccaccaccagaaaggcggcggcgggcgtcgaccaggcggtgatgatcggggcccggaaccgccagctgagcagaagcccggtaatgccgacgccgatcgacaccgaccacacccaggacgccgtcagcgccgggtcgagcccggccacacgggccgcctggaagaccaggatgaaggtcccgccgtagttgacgatgaccgagacgaggccggccacgaccggatggataaggtcggtggggccgatggcgcgcggttgagcggctgagcgcatggcgtcggggatcctccgtagcgaggggaccgcccgctcccgggcggcgcgctacgtgatagcgcgccaatggctggttgagcccggacactttccgcagcatgaccagaccacttcgcccgaccgccgcggacgtgcatgccgatggcgccgatcgcggtggctgcatagaatggccgggtttcgccctcccccgtcagtgaagccgcacaccctgaagaccttcgaactcgacacgctgaagatccggctggcggatgccgagatgcagcgcctcgacctgcatcagcgcatccagcgggcgttgagcgggttgatcctcgacggcgcgctggccccgggtatgaagctgccggccagtcgccggctggcggcctcgctcggcatcgcccgcgacacggtggaaaacgcctatgtccagctgcaccgcgacggcttcatcatacggcgcgaaggctcgggcagctatgtctcccccaccctgggcacggatctggaaggggtcgcccgccgccggctccgccggcgggcggaggcgcgccacgacccggccggcggacaggggttgagccggcgcggccggatggtgctggacagcggcggcatcgccgaccagcgcgcggtccgccccttcgtgaccggtttgcccgagacctgcaccttcccgaccgagatctgggaacgtctgcaacgccggatgatccgcgaccatcgcgacggcattctgctgcatggcgacccgcagggggccgaagccctgcgcgaggcgattgccgcctatctcaccctggagcgcggcgccggtgtggccgcggatcagatcctggtgctgagcagcacccgtcaggcgctctatctctgcgcccagcttctggtcgatgccggcgggccgatcctgatggaaaatcccggctatttcggcgcccgcaaggccttcgaggcggccgaggcgcggatcgtgccgatcccggtcgatgcccggggcatccggaccgatctggtcagggccgatcagagcggcgcggcctgcgtctatgtcacgccatcccaccagtatccgaccggcgccacgctgtcgctggaccgccggatcgacctgatcgcctgggccgcagagaccagtggctggatcatcgaagacgattacgacagcgagttccactatgacggcctgccgaccgcctgcgtccagggcctggaccgcgaccggcggacgatctatatcggcaccttcgccaagacgctctatcccgggctgcggctcggctatatggccctgcctccgacgctggtcgaggccttcacccgcgcccgcagcatcatcgacggccacacgccgcagctgcagcagctcaccctcgcccgcttcatggccgacgggcattacaacgcccatatccgggccatgcgcaaactctatgccggtcgccggcaggtgatgctcgatgccatcgcccggcatctggacggcatcgccaccgccacccgcccgcccggcggcctgcagatcccctgcatcctggagcccggctggccagaagccgataccatcgcccgcgctgccacggccgggcttgtgctgccgggcctcggccgcctgcatatcggccccggcgcccgccccggctggctgctgggctacgcctccctcgccgcccacgagatcgaggccgccatgctccgcttggggggcgtgttgcgccaggggcacagcgacggggtgccgtaaggcataaggctctgtcgtcccgccccctgccatgttcttatatccgacaggatcatatccgcagcggctcgacgcagaggcaccgcatgccctttccgacactgaacaaagatgatgaggcaggcaccgccacaacccggtcgcgccgcactctgctccagacacttcgcgtcgcagcttcagcaaaagcaacagtaggaccgaccgcggctcgcagtcaggattttctgtacgatgaagcgggtctcccgcggtctgatggaaacaacaccgcctgacggcaaccccctggtcctcaacctttccccgaccaccggttccgcagccggcgcagccagaccggcagaagcggggtgggcagcggggcgcccaggatgcggtcgggggcgtcgacgatcgcggcggcggcgccggcgcggatcagccggcgcaggcggcggcggctgtcggtgccgtagaccagcaccagcggcggatcggcgcggctgcggagcgccctgatcgcgcgcgggccgaagcggcgggcgttcatcaccaccagatccgccgtcgtgatcaccccggccatcgtggcggcatcggccggccggcgcagcaccggcccgaccggcagggtcggcaacaggcgtgcggccaggctcaccaccgccgccgaggtcgaggtcaccaccagccggccagggggcaaaggcgcggcctcgatcacgcgcgcgacggcggtcaccagcccgagtgccgcgtcttcccccgcctccgccggcggcttcagttccagattgaggccgagcccgatccgggcggccagcgccagggcgcgggccagggtggccggcggctctgccaccgcccctgccccgaaccagagcgccgcatccatgcgggcaaggtctgccgccgccacggccgcgagcggcccgcggccgctggtggtggcatccagatccggatcatgcagcagcaccggcgtgccgcagccggtcagccgcacatccacctcggcccagtcggtgccgagcatcggcacgccggccagggcctgaagcgtgttctcgggcgcatgggcgcccccgccacgatgggcgatcagccgcccgcgcggcagcaggaccggccggcgcgccaccggttcagcgcgaggccgggggcgcggggctctctgcggtcttgcgcaggtccagcaccacttcgaccacgtcgtcttccagcgaatcgcgcacggtgaagcccagcgtcaccatcagcttgcgcattggccggttgtcgcgcagcacctgccccacgatccgatggatgccgcgggcccggcaataggcgatcaccttgttcatcaaccggatgccaagcccccggcccttcaggtccgaccgcaccaccacggcgaattcggcatccaccgcatccggatcgaacaccacccgcaccacgcccaccgtctcggccccggtctcgtcgggcagcacgccgggcttcaccggcgggatatcgccgccgtcgaagcgggtgcgggcgatgaaggccatctcgcggtcgtaatcgatctgggtgaagcgggccatttcggtgtggctgaactcgcgcaccacaccgaagaagcggtatcggatatcctcgggagtcagatggcggacgaaatcctgatggcccggctcgtcctcggggcggatcgggcgcagcaccgcatggcggccgtcggccatcgtcaccgtttccaccagatccagcggatagggccggatggccagcgggccgcgggcgccgccgccggggaagacctcgacatgggcatccagcaccagcacgcccatgtcgtcggcgatcagcgggttgacgtccaggccgcgcatctcgggcaggtcgaccaccatctgtgccacgcggatcagcacgcccgaaatctcgtccagatccgccgccggccggtcgcgatagcccagcagcagcttgtgcacccgggtgcgcatcatcagctcgcgcgccagcacggtgttcagcggcggcagggccaaggcccggtcgtcgaccagttcctcggcggtaccgccctggccgaagctgatcaccgggccgaagacggggtcgtggatcaccgcgatccgcagctcgtgcgcccgcggtcggcggatcatccgctgcaccagaaaaccgtccagcggcgcaccgggcgcgcgggtgcgcagccgctcggccaggctggcggcggcaccgcgcacctcgtcggcattctgcaggtcgaccaccacaccacccacctcgctcttgtgggtgatgccgctggaggcgaccttcagcaccgccgggaagcccagcgccgcggcggcggccacggccgcctcggcatccgccgcaagacgggtctcgatcgtcgcgatgccataggcaccaaggatgcggccggcctcgatctcggtcagccggctgcggccttcggcacgcgcgccggcgatcaccgcccgggcggccgcgacatccggcgtgaaggtctcgggcaccgaggacggcgtctccatcagcatgtcctggatccggcgatagccgacccggtgcatgaagccgcgcacggcgtgatggggcgtgtcataggtggcgatgccggcctcgttcagcacccggcgggccggggccgcgccctgcccgcccagccagctggtcaggatcggccggcgggtgcgctccgccgccttggtcaccacccgggcaacgtcggcgccgtcggccacgccggtcggcgcatgcagcaccagcaccgcatcggcgcccttgtcttccagcagaatgtccagcgcctcggcatagcgcccggcatcggagtcgccgccgatatcgaccggattgccgccagaccataccccgggcagcacgccgtcgagcttcgccacggtctcgggtgccagctccgccaggctgccgccggcggcgatcaggctgtcgaccgccatcacccccggcccgccgccattagacaggatggccagccggtcgccacgcggcggctgcagccggtgcagggtttcgaccgcgtcgaacagctcgccgatctcgcccacgcgcaggatgccggcacggcgcagcgccgcctcgtagacctcgtcctcgccggtcgcggcgccggaatgggtaaaggccgcgcgggcgcctgccggcacccggccggatttgatcgccagcaccggcttgttgcgcgccgccgcccgtgccgccgacaggaagcggcgggcggaatcgatcgcctcgacatagagcaggatggcacgggtggcggggtcaccggccagatagtcgatcacatcggcgaagccgacatcgcggcagtcgcccaggctgatcatggccgaaaagccgatgccatgggccaccgcgtggtccatgaccgcagtgccgatggcgcccgactgggtgaggaaggcgatgcgcccgcgcggcacccgggcgggcgcgaagcttgcgttcagccccaccttcggcaccaccagccccagcgtgttggggccgaccaggcgcagccccgtcggccgcgccgcctctaccgccgcctgggcgagcgaggcgccgcccgcggtataggtccgccccagcccggccccgatcagcaccgcggcacgcacgccgcgctggcccgcctggcggaccatctcgggcacctgttcgggcggggtgcagatcagcgccagatcgggcgtcaccggcagatcggcgatggtgcgataggccagcacgccttcgaccgaattgtagcgcgggttgaccggcatgatcgggccggcgaaaccgccatccagcaggttgcgcatcaccatgcgccccacgctgcccggccgggtgctggcgccgatcacggccaccgccttggggtcgaagatcgcgtcgagatttcggatggtcatgtgggtggccgctccggtccggtcgccgcggatgtgatgcacatcaccctatatcaggatggcgtcgatcgcgagacggtgcgtcgtcgtggcgcggctgcccccgggctacggcgtccgtcagcgcgtccagacgaaggccggcagcatggcggtgggcatgaagccctcttcggcgcagacccgttcggcccggcctgcgtcgggcaggtcgccatgggccaggcccagcttctcggccatgatgccgccggcgataaaatagcccgggatgccgaagccggtggccccctggatatcggtatgggggccgtcgccgacggcggccacccgctcgcgcggcaggtccagaatggtcaggcagcgctcgtagaccgaggcatagggcttgccgaacgagatcaccttgccgccgagccgctcataggcctcggccatcacgcccgcgcagggaaaccgcgagccgtcgatgcgcacgatcaccatgtccggattggcgcagatcatcggcagaccgcgggcggccgccgcttccagcgccggcatcagcggttccagccgcggatcctcgtcgtcgaagccggtgttgagcaccagatcggccccggcggcatcgtcgacgtcgacgaagggcaggtcgtcgagcaggccggcatcgcgcggcggacccagatgcagcacccgccggccgatctcccccgccgccagcatggcggctgcggcatcgcgcgcggtttcgcccgacgacaccaccccgtcatagaggccgcgatcgacgccgaaacggtccagctgctcgatcacccgcgaggcccgccggggcgcattggtcaggaacacgatccgccggccggtttcgcgcagccgggtcaggcagtcgacggcgccgggatagagctggcggccgtcatggatcacgccccagaggtcgaggatgaaaccgtcatgggcgggggcgatggcggcgacgccatcatatacggtcatggacatgggaagggcggatccgttctcggagcggaagaaggcagcggcggaagaggggaagggcccggttcagcccaggcgccgcggttcgccgaacagatagcccgcaccgtattcgatgccaaggtccaagaggtcgatcagccgctgctcgtcgtcgatatggtcgaccaccacccggatgctgcgggcgcgcagctcgcgcagcaggtcgcggaaggcggccgccccgtcgggcgtgcgggcgccggccaacgccaccgcggccgggatcttcacataggcgagcagccggccgcgggcgaggatatcggtgctcatccgcttggggtcgaccccgtcggccaggaagcggcagcccaaccgtgtcagccgctgcagcgcctcgatctgcggatcgccgagcgccatccaggtcgtggccggggcggcgacgatcaccgaggacggcacccccgcatcctcggccagataatcggccagatcctcgtgcaccagcgggtcggccaggccgtggccggtgacataggccaccaccggcaggttcggctcccccgccctgggccgacggccgacgcgcagtgcgcgcagcagaagatggttgtccagccgctgggccagccccggcaccttcgcccggtcctccaccacatccaggccgatcacacggccgtcggggccgtggaccacggcgcgggcctcgaccagcgccgggcgccggctgggcaggcggacgatggaggtcaccatcacgtcgatcgccccggcaccgaccgcggcatccagcaccgcttcggggtcgagcggcggcatcggcggcggcgggcgcgtgtcggcagggccggcctgggccgtggcccgggcggtcgcggtggcgcgggcgggccccgtcgccggctcgcgccggttgcgggccagttcgggcagcaggcgctgcaggctgcgcagctcgtcgaccagatcgcccgactggccgccgctctcgatccgggcgacccggtccgacagcgcgcgaaggtcgatggccagctgcatccgctcccgcttttcgaccgcaagccgggagagcagggcgacgaccagatgggccagcgccaggccgcccgaggccgccgcccagacgatcagccggaacagcacgccttcggcggggatcagggcggcgggcagcagacccacggcggcatagccggccatgtacagccggtcgcgccggtcgagcgcgaagggctccaccggcggcggcaccggccggccggttacgtcgacggcatcgacatcccccaggacatcgtcctcgaccaggtcttcgggggcgatccgtggttcacgccgcccggccgacgatctccccaacatcccttaccccctcggcggcgatgcgccggttcaggccttcgacgatccgcccgaccagccccggcccctcatagaccagcgccgaatagagctggagcaggtcggcgccggccgcaagccggtcccaggcatcgtcggcggtctcgatcccgccgacgccgatgatcggcatggtgccgtccagcgcccggaacacctcgcgggtcagcgccagggcccgggccttcagcggccgccccgacaggccgccggtctggccgcgatgggggctttgcagcgtgtccggccgggcgatggtggtgttggcgaccaccatgccgtcgatcccggcatcgcgggcggcatccaccgtgtcggccaggcccgcctcgtccagatcgggggcgatcttgaccaggatcggcggccgtgccttgccggcgatcccctggtcgcgcgccgccttcaggccgccgagcaggcccgagagatgcgcccgcccctgcaggtcgcgcagccccggcgtgttgggcgacgagacgttcaccaccaccgcgtcgaccagcggccccagcttcgcgagccctgcggtataatcggccagcgcatcctcgctggtcttgttcttgcccagattggcgaagaccgggccggtcgcccgccggtgcggggcgcgggcggccagccggccggccaccacgtccagcccgtcattgttgaagcccatgcggttgatcaccgcccggtcctcggtcagccggaacagccgcggccggtcgttgccgggctggggcctgggcgtcacgccgccgatctcgatgaaggcgaagccatagccgaacagcgcatccacggcgaccgcgttcttgtcgtagccggcggcaaggcccagcggatgggcgaaatccagcccccagagccggcggccgagcgccggtaccggccgggccgggtgcggcggcacgaccagccgggcaagtccgctggtcaggccgaacagcgacaggccgtgggcacgttccggatccaggcggtagacgagcggcgcaagccgcccccaggcatcgctcatgcccccgctccgtcggccccggcatgggcggggaagatatgcagcccgtcagggcccagcggcagcgggtcggtgcgcaccaccgccaccgacggcagcggcccgtagatatgcgggaacagctgccccccccgggacggttcccagcgcagcagcgcgcccagccggcggacgtcgatcgtcagcagcagcaggtcgtcacggcccttcagatgcagccgggcggtttcggccagctgaccggcggtggaacagtggatgaaaccgtcggtctcgcacagccggccgccccgataggcacccggatttgccgccgcccagcgtgccgcctcggcgaaatggaagatccagcccttgtcctcgcccgcctgggcgggccggtcggtgatgtcgctcatcggtcgtctcccgccatggtctctccccgtcgcatggtctccgccgcccggatcgtcatgcaatccgcgccgcaaggcgcctgtccagcccgtcgaccagccagccgtccagcttgtccaggaaggtgatgcactggtccagctgttcgcgggcgacgaattcgtccgcccgatgggcctggtcgatgctgcccggcccgcagaccaccaccggtacgccggcgcgctggaaaatgccggcctcggtggcgaaggccaccacatgggtgcggttgctgccggtcagcgccagcgccatcgcctcggccgggctgtcggcctcgggcgtcagcggctcgacgttcacgtccaccaccgtggtcacgccggcctcgtccgacaccgccttcagccgcggcagcacttcggtctccacccgcgcatccaggcggcggacgatgtcgtcgatcgaatgaccgggcatcagccgggccgaccagtccagctcggcatcgcgggggatgatgttgacggcggtgccgccccgcaccatcaccgcggtgacggtggtatagggcggctcgaaaccgctgtcgggctggccgatcccggcatattcggcctccagctcctcaaggaagccggtgatgcgggccgcggccgaaatcgcattggcacccagatgcggctgcgaactgtgtgcctccaccccggtcacccgggtgcggcacaggcagacgcccttatgcgccgtcaccacccgcatcgaggtcggctcccccacaaccgccagccgcggccgggcggcaaggccccggatgtggcgggcaaggtcgggggcgcccatgcaggcgacttcttcgtcataggtgaaggcgaaatgcaccgggtcggtcagcggcagggccgcccagtcgggcagcttggccagcacgcaggcgatgaagcccttcatgtcgcaggtgccgcgccccagcatcagcccgccgcgttcggtcagccggaacgggttggtcgtccagggctggccgtccaccggcaccacgtcggtatggccggccagcatgacgccgccccggccgtcggggccgagggtcgcgaagatgttcgccttggtgccgtcggccgagggaatgcgctcgtgccgcaccccatagagatccagccagctttcgacgaaggcgatcagcggcaggttgctgtagcggctggtggtatcgaaggcgatcagccgcgccagcagcgcatcgcgccgggcggtagccgtcggcagggcggcgatcagggccgcggcttcggcatccggtaccgccgggtcggccgccgggccgatccggccggcgaggtcaatcgaggcgtccatggcagacggcgaccttcagggagggaggctgacagagaaggaagctggcagagagggcggccatcacggcgacatgtgcacctgcgaagaccgttccggtttctcaaaccgtaaacaggtccgggctccggcgcaacggaggcgcagggtcacccccgccagtaggcgcgggtgaacaggaccagcacggtgaacagctccagccggccgagcagcatggcgaaggccagaaccgtcagcacagggtcggtcatggtggcataattgccggcggggccgatgatcggcccaagcccggggccgacattggccagcgcctgggaaaccgcggtggcggcggtgatgaagtccacccccagcagcgccaccacgatcgagagcaccacgaagaccgcgaagaagacggtggtgaagctcaagaccgacagcagaatggcttcgggcaccggccggcggttgtaggtggggacgatcaccgcattcgggtggaccagctggcggagatggcgccgggccgccgtcaccaggatcacgaagcggaagaccttgatgccgcccgaggtggagccggtgcagccgccgaccaggatcagccagaaaaacaccgcgaaggggaacgtgccccacagattgtagtcggccgtggcaaagcccgtggtggtgatgaccgagaccacgttgaacagcgacacacgcagcgcctgcaggggcgccacatgttcatgcagcaccagccacaggctgagcgtcacggtccagaccaggatggcgaggaagaaggcccggacctgggtgtcgcgccacagcgcatcgcgatcctggccgagcacccgtatgtagagcacgaagggcagggcgccaccgatcatgaacaccacgatgatcatctcgatcagcgggctgtcgaaatggccgatcgaggcgtcggaggtggagaagccgccggtggagacggtcgccatggcatggaccagcgcttcgaacccggtcatgcccgcggcccagagcaaagccatgcaggccagcgtcatcaccacatagacccggccgaaggccgcggccagctgggcggcccgcggcacgatcttttccgaattgtccgagctttcggtccggaacagctgcatgccgccgatgcggagcatgggcatgatcgcgaccgaggtgacgatgatgccgatgccgcccagccagtgcagcatgccgcgccagatcaacaccccgggcggggcggtgtccaggcccgacagcaccgtcgatccggtggtggtcagccccgacatggattcgaagaacgcgcccgcataggtgatatggggcgatgcgaacagcagcggcagcgccgcgaaggccgccaccgacagccaggaaagcgtggtggtcagaaaggcatggcgcaggctgagcgaggttgggtgcgcggtgcgcgtggtcagcaccagactgacgccggcgaagatggtcaccagcgacgacaccacgaagaccgaccagtcgggactggccgccacggcatcaaaggccgccgggaccagcatggtggcgcccagcagtgccagcagcacgccgatgatgaacagcaccggcttgacgtcgatcacggccgcggacccccgagcagtgcggcgcccctgatcaggcgcacggaacccaagccgcacccccgatcgggcatgcggcgccgcccgcgatgatcagggaaagcgtcgcagctgtccacgcccgaggtgacgccaccgtcagggaaggttccgtcaaacacgacacccctgcccatccgtgaacaggcaggggtgtctcgatagccgggttgagggcaatgccccgcgccgttgtcagaacccggccggattgccgatcagggtcaggaattcgcggcgcagcgtcgggttgtggcggaattcgcccagcatccggctggtcaccatgctcacccccggcttgtgaacgccgcgggtgctcatgcactggtgttcggcctcgatcaccacggccacgcccttgggctgcagcacttcctcgatcgcattggcgatctgcgaggtcagcttctcctggatctgcaggcgcttcgagaaggcctccaccacgcgggcgagcttggagatgcccacaacgcggctgcgcggcagataggccacatgggcgacgccgatgatcggcaccatgtgatgctcgcaatagctctcgatccggatgccacgcaaagcgacgacctcgtcatagccgtcggtctcttcgaaggtccgctgcaggatctcgaccggatcctgaacatagcccgcgaagaattcttcgtaagaccgcaccacgcggtcgggcgtggacagcaggccctcgcggtccgggtcgtcgcccgcccagcggatcagggtccgcacggcggcttccgcctcggcgcggctgggacggccttcgggggcagcggccttcggcgcctcggatgcgccgacctctgccgggcctcccattctcacggccacgacgttttcacgtgtcatctgacgtgcaactcccagggtgcggccggcaggtgcgcagcgggcccacgcgaacggcgggggacggcgcatcgggcttccggccgtgtgcggattccgtttcgtctacgcaagccctcgatcgatggatcaccgcgatggcacgcgtatcgcgacggagccgcgatggtgtgggccggtgaaccgcgatacggcggatcatcctgcccacgatccgaagcacatatcaacccttgattgctgattatgcgctcgacgtaactctgactataggtttcggcgcaggcacctgcaagcgcgggccacaaggcccggcccatcgctccggacctgatcagttgatcgtgtgtgtggcatgagggctgtccagcgagaaggtcgggatctggacctcgaaggtctcgccgcccgcgctctccatctgatagctgccgcccatgatgcccgagggcgtggtgagcggcgcgccgctggtgtattcgaagctctcgcccggcgccagcaccggctgttcgccgacaacacccgcaccgcgaacctcctgcagccggcccaggccgtcgatgatccgccagtggcgggcacgcagctgcaccgtttcgtcgccgtggttctcgatccggatgcgataggcgaagacgaactgcccgtcctcgggcgaggactggtcgtcgacgtagaacgggcgcaccgccaccatgatcgagcgggtggtcgcgctgtattcgtggtccgccgccatgggtcctacctgctgcaacgtggatcgacgggcccggaaggggcccggacagggaatatcgcgacccatgcaaccgatttccagggcggagcgcaagcggtgatgcccccaagatgtcgggacggggtgtcccgacacccgtttcaggggcagcaatggcctcaggcggcgtcgagtgccgccgccagatcggccgccagatcctcgacatcctcaagcccgatcgacacccggaccaggccgtcgccgatgcccaccgccgcccgcacctcggccggcagccgctgatgggtggtggtggcgggatgggtcgccagcgtcttggcgtcgcccagattgttggagatgtcggcaatctccagccggttcaggaagcggaaggccgcttccttgccacccttgaaatcgaaggccagcagcgtgccgccgcccgccatctgccgccgggccagatcatgcccgggatgggaggcaagccccggatagaccagccggttgagggcgggatggccctcgaaacggcgggcgagggtggtggcgctgcgggtctgttcccgcaccctgagcggcagcgtctccagccccttcagcagcacccaggcgttgaaggcgctgagggtcgggccggtatggcgcaggaagtcgcgcagcgccccgtcgcagaacgcctcgctggccaggatcgccccgcccagcacccggccctggccgtcgatatgcttggtggccgaatagaccaccacatcggcgcccagcgccatcggcttctgcaggatcggggtcgcgaagacgttgtcgaccaccagcgtcgcgccatgggcatgggcgatctcggccactgccgcgagatcgatcagctccagctgcggattggacggcgtctccaggaagaacagcttggtctcggggcgcaccgccgccgcccaggcgtcgagatcggcaccgcgcacgaagctggtggtgatgccgaagcgcggcagcagttcggccaggatgtactggcaggatccgaacagcgcctcggccgccacgatatggtcgccggcgcgaagctggcagatcagcgcattccacaccgccgacatgcccgaagcggtcgcccggcaggcctcggcaccctccagcgccgccaggcgggcctcgaaggtccgcaccgtcgggttgccgtagcggctgtagacgaagcccggctcttcgccgcggaaccgcgcctcggcgcgggcggcgtcgtcatagacatagcccgaattcaggaacagcgcctcggcggtctcgccatgggggctgcggtccagcccggcgcgtaccgccagtgtcgcaagcccgcgtgttgcagctccgcgctctgccgcggcttccgttccggccgctgcagcagtggccttccacaatccgtcgccacagcccgcgtcgacgtccgtccggtcttcggtatcccgcatggtcttcggcccataaaaaaacccggcctctggccgggtctgcgcgtgaagggttcggtgcgcggcccccgaccttttagcggcgtgattaacgtggtccgcaagccggccggcccaaatccccacgatcgccgcacaggccctgcccggcggtgcgagaggcacgatacgcccgcccgccacggagggtcaagtgccgatcatgtcaggaaaattccccatccggcgcgtggagatgcaggatcggcccgcccgcctcggcggcctcgtcgggatcatgggtcacgatcagcgccggcacgccacgccgccgcaggcggtcgaagaccagcgccctcaggcgcgcggccagcggccggtccagtcgggcgaagggttcgtccatcagcaccgcccggggatccgccatcagcatgcgcatcagcgccacccgcgcccgctgaccgcccgacagggtcgccggatgtcgcccgcccagcccgtccagcccggcctcggccagcgccgcggcgatccggtcccgccgcgccgcccggcccagcccggcgggcaggccgaatccgatattggcggccaccgtcagatgcggaaacagcaggtcgtcctgcatcatcagccccacccggcgccgctcgggcggcaggtcgtcgatcggccttccgtccagaaggatgcggccgcgcatggccacgatcgggtcggcgatgccggcgatcaccgcgagcagggtcgatttgccgatgcccgacggccccagcaccgccccgatcaccccgggcggcacgccgaggttgagcggccccaccagccggcggccgccgatcgccaccgccacttcctcaagcgccaggctcatcggcgcctccggccgccggccggctcggggatcaggctcgccagcagaaagcccgccgccggcagcagggccagcagcagggccgccgccgccgccgcacgacggtccagcccggccgcagccgccaccgcttcggtcgccagcagcgggatccggccgccaccgatcatcaccgccggcagatactgcgccaccccggccgaaaaaccgatcgccgccgccaccgccagcggccgtgcggtcagcggcagcatcaccgccgcccaggcgccgaagccgctgcggcccaggctgcgggccagccggcgcggccgcggatcggtccggcgatagctttcgcgcagcgccagaaagacatagggaaacaccgtcgccagatggcaccagaccagggcaagcccggtaccgtccaggccaagccgcagcacggggccctgcaacccggccagaaacgccgccggcggcagcagcagcggcagatagatcagcgcgtcgccggcgtcgtgggcagggcggctggcggcagggcggctggcggcagggcggctggcccggccttccagcagcagcagggccagcggcaccgcgatgatcaccggcagcagggcatagagcgcgcttgcccccgccgcaggggccagaccggccgccatgcccgtcagccgcgccgtcgaccagccggcgggcagcgggtcggggaagcgccagaccgcggccccggcccagaagaccagcgtcaccacggccagcaccgccatcaccagcaccagcagccccagcccggcggcaaggcgggaggcaaagggcgccagcggccggcgggggcggacggtcagccggtcagccccgccgcaccgcaccagccgttcgatgcaaagcccggccaggatcaccccgaccgccagaaccagctgaagcagggcggccgcggcaccggccgccgcgcgggccggatcgggatcgaacagcagcgacaggctgcgcgccgccagcaccggcggcaggctgggccccagcaccagcgccatgtcgaccgtgccgaggccatagaccgccaccgccgcgaccggcaggcgcagcagcggccagatctgcggcgccaccacccgccaccaggcgctggcggccggccagcccaggctgcgggcgcggtcgagggcggcgcgcgcgcccacccgttcctgcgccgcgatggtcagcgccagcaggaagggcatctctttcaccaccagccctgcgatcagcgacagcccccaggcatcgccgggcagcggcagatcgggcggcagcgcccgcccgtcggcgcgcgtatagacccagccgcccgccaggcggaacagcagccccgtgggcgcgatcaggaaggcgagccccaccgccacggcggcatggggggcagccaccaggacaagggcaagccgctcggtcgccccggcccggcccgggcgtgccgcgaccagggccgcgatcgccccggcaagcgccgtcgagatcagggtcgccgccaccgccaccagaaccgaggtcaggatcgatcgtccgatgcccggctcggccgccagcagccgccaggcggacagcggggccgcggcgaccgccccgaccagcccgcccgccagcggcggtgccagcaccacggccgcgatccagggggcggcggccagcagcggcgaccgcgcgggcggcgccgccggccgccagtctccggcacccggctgcccggtcacgcccggctcaaccggccagatagcgccgcgcccattcagcctccagccagtcggtccagctgggatgcggctcggggatggcggggcccagctcctcttcgctcggccaggcggggcccagatcgatgtctcggaacaccgcccggtcctctgccgacagtcgcccggccgtgagcacggtcatgtcgccccagatcaacggatccagcttggcggcctgaacctcgggcgagatcagcatgttggcgaagaccatcgcccccgccttggcatcggcattggcgggaatggcgatgaaatgggcattggcgatgctgccgcccgaccagccgatcacccgggtagaggccggcatcagccccgaggcgatggccgaggccgcctggcccgggtggaaggtgaaacccagatccaccgcgccatcggcctgcatccgctccagcgccgggccgttgggcgggaaggcccgcccctcgcgccacatcgccggccggatccggtcgagccaggcccacagcggcgcggtcaggcccggcgccttggccggatccgccggccgtgccagagcgggccgtttttccttgggcagcagcatgatcagcatctgcttcagaaaggcgctgccgatgaaatccggcggtgcgggataggtgaagcggccgggatgggcctcgatccagtcggccagggcggcggggctgcgcggcggctcgggcgtcaccgcccggtcgtagaccaggccgaactgcgacagcccccagggcacctcgtagccgtcgaccggcaatgacccgtcgcgggcaagtgccggattggcccccagatcgatgaagcgcgcattgggcagccggtcgagcatcggcccccagagcagatccgccgtgcgtagcgccgcgaaattctcgccattgatccagatgagatcgaccgaaccgccctcggtcttgcgccccgccgccgcctcggccttgatccgggccaccgcctcggcggtgtcggccagcttcacaagctcgacgacgacatcgcagcagccctcggtctcggccgccacgcgttcgatgaattcgttgatgtcgggatcaccgccccaggcattgaaacgcacggtctggccgcgggcctcgtccagcaccgcctgccagtcggtctgcgcccgcagctgggccccctggggcttcggtgccggctgctgctgcgaagcggtggtggtctccgcagacaacgccgctgtactgaccacgatctgtgccgtggcacccagcaccgccagagccgcagtcatcctccgtatccgcgtccagaccatcatgcgtcggcatcctcattccaggctgtcggatgctccagcatatgacggatcgcaatcggacgcacaaatcacgtcggcgtgcgcccggatcgggaaggtcagcgggtcagtgccgaccgcgcctcggcctcgcggcgtgccgccgcctcgcgctccgccgcggcgcgatccatggcctcacgcgtggcgcgttcgcgttcggctgcctgacgctcttccagccgctgccgttcgcgggctgccgcctcctccatcttttcgcgcagcgtgtccgcatccctcacctcaccgcgggcgatccgggcttcctgatgatcgcggtgcagttccagcttttcttccagcgcctgacgctgcatctcatgcgtctggtcgagatcggagcggggcggcggcgccgtcggagcgggtccatcatcctgtatccgcgtgggctcgggcggttgagagggcgcaggctcgtccagaatgtcgtcgcgattctgcgcgaagtcgtccatgcgttcgaccagaggtgccgtctgtgccaggatttcaggtgtcagggcaccgggagcgagaccgctatgctcactcgcaatctcgatgaccgtcgccgtcgaggcagcctccgcccagagtctggcctcgtcgggtgtgggcagggcttctatggcctggccgaccacctgcattgagggaccgtccagatgggcagcctgctcgatcgccgtcgacagcacctcgtgccccaccaccaccagcggatcaccctcacgcaccggcccgtctgccggcggaataccggcctcaagccattcggcccgctcgggatgggtctgtgccacctccagctccagggccgaaaccgcggcccgggcagcaaccatctcctcgcgcaggcggtcgacctcgccggccttcgccgcccgatcttcgggccctgtcgcaagatcgcgcgccacctcggcctcacgcagagcctgcaccgcacgttcggcttcggtctgccgtgcctgatgcgcttcccagacctgccggtattccggatcccatcctgccatcgcctgctctccctccgccgtcaggaagcccgggcgccgtcgccggccggcacgaaatcggcagcccccatccgggcactcagggtcgcgtccttccaggcgagatccttccgcacccgggccgggcggctccccaggccgaagaccaccatctgctcgcggaaggcggggccggccagttccgccgcttccaccacccgtcgccgctgaccgtcgaccaggctgtcagtatagccgatctcctccgacagccgctcggcgagcccgtcggcaccggtcggattcatataggcgcggactgcgcaggcactcatcatgccgtctgcgttcttgtacgcctcctgcatctggccaacgctctgagcgaacatccacaggcgcagcccgtatttcgcgccgatgttcagcgcctcgtcgaccggcggcatggtcttcaggcgcggcagctcgtcgagcatgaacaggatcggcggcgaaccgcgcggtggtaccgggccgccggtgagcatgcggatgtgctggccgatgaatacgcgcagcagcgacagataggcatcgacctcgttgggacgcagatagatgtagatggtcgggttcccgccgccacgcagatcgagcgggctccagtcggaccgtgccgtaaccctcgaaatccgctcgccggcccaggcgccgaggctggaacgggcagtctgcagcacgctcgacagcgtcttctcattcatgtcttcgaaggccgtggcatgctgcatcatcacccgcacgtccaccgccatgcgcaggcccatcagcatgttctgccaagcctcaccaccatagacgatgtcgagcaccgcgtgcatcggccggttctcgggcgggttggaatagcagacatgggcaatggccgccgtcagcacggtacgggcctcattgtcccagaacgcctcgctggtattcgagggcacgatcatcatctcggcgagaagcttggcgtcttcccagatgtagtcgggatggccgcgtacaaaggtgagcggattgtagcagtggctggcatccggttcgagcgggctgaacttccagaccggccccacattctcagcccgccacttgctcgtcgtctcgtagatgtcccccgagatgtcgagcacaacggccggacccgtccaggtcagcagattggggaagacgtggcactgggtcttgcccgagcgtggcggtgcgatggtgatcatcgacccctcgccggaataggtcagtgcctcaccggtcgggaagctgccgatgtgcagcacatgcggcgactgcggcgcaaaggtcgtctcggccacctgttcaggtttcagccagccctggccgcccggcgccagacgatccgaagcgtctgccaccgcgcggccgagggccgcgggtagcacacccgcccggcgcttctcggtcagatgattgttgatggccgataccacccggtcgacgctgccgcccttgtgctcaaaggcagtggggaccggcctgccggcatccacgttctgatattggctgcgaccggcttcacccttgccgtcgccccagatcagcgccgcgcgccagaagcggtagagttcctcctggccatcggtggcgctgttgagcagttcgacgatccggagatattcccgttcgcggttgtcaataacggccagattgcgctttacgctgaatcccacgtaactggtcgtcttctccgggccggaccacgtatcccaggtaaggaactttaccgcctccagggtttcggtccgttcagcaaacatcgcctcgatccgcgcagcccgtgtgtcatggtcaggcccgaggctcgcaagccaggcctgattcgccccgacctcgtcccggttccattgcttttcgctcttgtagaccatcttcccgctcttcgcggaccgggagaagaagatcgtgagcagcgctgcacagccgatcagaggcatgatcagagtgaggatagccgagatgatcagccggatccgatacctgcgcagaaagaccggaacataagcgccaagagacagggtctcgttgggtttgtcgccctcgtcgtcggtcatacggtgccggatggccagcaccaccagggcgacgacgacatagagcagaaacccaccaaacaaccagccgatcaccgcgtccatcgtgccccctcctgctccgatctgcatatcggtcaacgatagggcatattgtgcaaacgcaacaagtcgctttcatgaacagaaacggatttcttccaaatgatctggtgtgtggtgaggatcagctccgccagacccactcaatggactgatcgacacgaaatcgacttcaaatacaggcctcatcaccgacgacaacaacagccggccggccggaaattcatgccccgggtgcgactgccgcctggcaggtcatggtcgacatgtgatggaccatccgcgtccgctcggcgccgtcgaccgcatcgatggtcaggtccagctgctggcgcagcggcaggccggttgcggtgtcgtagatctcttccgtcacatagtccgacgacagatagcccgcgcgcaccaccccgggcgccacctcggtcatctgatgcgacacggtgcggatcatcaccgccgggcggccgtcgatctccatgccgcccgccaccacccggctgccttcggcggcctcgggccggcgcacatagacgctttgcgccggatcggccaccagcgcctgctggaacagggcgatcagcggcggatcgggcggcaccggcagatcgtcgccctggtcgagcggccggccatagacgccggccccgcccagaaagcccagatagcccgacagcagataggccgggcggagccccggctcggtgtcggtgccctcgtccatccgcaccaccacccggccctcggccggcaacatccgcgcgcctaccgaggcgttgcggaaagcggcggcaagccggaccgcgccatcctccagggggtgataggcgaccccgaccgggccctcgctgtggctttcccgcgcgccgatccgcggatccagcgtcgcctgcatcgccagccggcagtcgagttcggtctcagccccaggccctgccagcgtcaccggcccgtcgaagggccggaccggttcatccgccaggaataccaccggcgccttcgtcgcacaggcggcaagccccagcagggccagaacggcgaggtggcggctgatctgcggcatcaggggccctcctgcatcatctgtgttccagcttcggtcccatacacgcccggaacgacctgaaggtcaaccatgcagaatccatgcgccccgcgggcggcggccgcatctgcggccttgatcgcggcgggacgcccggctatcttgcctgcaccgcgcgggcgtagttcagcggtagaacgtcagcttcccaagctgaatgtcgtcggttcgatcccgatcgcccgctccagtttcagaaaaacaccccgccaggactgccctggcggggtgttttcgtctgcggcggatgcggtagtgccggggcggcggtccagggggcggcgcccccttgcacgggtccggatcaggcttcgccctggtcgcggctgaagccgtcggcgccatcggtcaccagcagcttctcgacatgcatccagcgatggcgcgcgcccaccttgccgatcagggcaagggccgcggcatcgtcgaaaccggccgcggcatcggcgcggcgcacgaaacgggcgcgccagtggggggtgagttcggtgcgcgacaccgcccccggccagatcgcggtgccgcggttggacaggtgcttcagccggaagggagagccttcggccagcgccgtgatctcggcaccgagtgcagccggatcggccgtctccacctcgaagaacaggtcgaagcccacatcctcgcgggtggtgacggtgatccggtcgggcagggcaggggccagcgcggcttcagcctcggcggtggccgccgtctcgggcaggctcgccggatccacccgctccagattggcggccaccgcctcggcgaaggccatggtcgatgccgcctcgaccttgccgcgggccagatcgccggtcagcacccggccttcggacagggtcagcgccagcgccgcctcgatccgcgccgccgcacgggcctcgcccagatggcgcagcagcatcaggccggcctgcagaaaggcggtgggattggcaaggccgcggccggcgatgtcgggggccgagccgtggaccgcctcgaacatcgccgcatggtcgccgatattggcgctggcggcgaggcccaggccgccgaccaggccggcggccagatccgacaggatgtcgccgttcatgttggtcatgaccgcgacgtcgatctgctcgggtgccaccaccagcttgtgggcgcaggcatcgacgatcatgtggtcggtagtgatgtcgggatagccggcgcccaccgcctcgaccgtgcgcttgaacaggccctcggtcagcttcaggatattggccttgtgcaccgcggtcacgcggctgcggccctcgcgccgggccagttcataggccgcgcgggcgatcttggcagagccgcggcgggtgatcagcttcagcgcctgggcggtatccggcgtctgcatatgctcgatgccggcatacaggtcttccacattctcgcgcacgatcaccatgtcgatgccgcggcccgagaacggggtggtgatgccggccagttccttcaccggccggatgttggcatacatctcgaacagcttgcgcagcgtcacattggcgcttttgccgccatggccgaccggggtttccagcggcgccttcagcaccagacgggcgcgttcgatcgcatcgaccgtctcggccggcacgccggtcgcgacgccggccgcaaaggcgcggccgccggcgatcgccggtgtccatctcaccggggcggccgccgcctcgaagatcagccgcacggctgcagcgatctcgggtccgatcccgtcgccttcgatcaacaccacttcgtgggcgacgggcttgacggtctcagtggtcgtggacggcatgttccggctctcctcgatgcgggacgggtgcatggcccccggcatccccccgacaccgctcaggtcacgcgcccgcgcggcatttgggcacagatccgccgtttgtaaagttgcttcaatcacagtttgccgccgatggaccaaagtcgggggcagattgaacccccgggcgcagccgcatcgccccccgtccgaccctcgcgttcatgatgcggcgcggcaaattgtcgctcgatgtcaagtgaccgggcgccgaaggccccaggctcgtggatgaacatcgcaaacgacgccgaccacggcgcaaggcatgtggcacgggacacgcggggagcgcgtcgcccggccgcagacgggggtctcatgtccacgatcacggaagcaaccggtgccaagggcccggctgcgccggcggccggcgcgctgcgccgcgacgccgtcggcgtctcgcacatcgtcttcttcgtcctggctgctgcggcgccgctgaccgcagtggtcggcgcctcgcccgcggccttcgccttcggcaacggcgccggcgtgcccggcacctatctgctggtgggcgcactctatctgctgttcgccgccggcttcaccgccatgaaccgcttcgtcggctcggccggcggcttctatcccttcatcgccgccggcctcggcaagccggtcggcctgggcggagcgttgatcgcgctcgccacctacaacgccatcgacatcgcggtcttcggcctgttcggcttcttcatggccgacaccaccggcggactgctgccctggtgggccttcgcgctggcgctgggcctggccgtccatgtctgcggcatgcgccggatcgagttcagcggccgggtgctcggcatctgcatggcagcggaaatcctgatcctgctggtgctcgatctcgcgatcgtcgccaccggcggcggccccgaaggcttcaccgccaccagtttcgcccccgccaccatcgcaggcgaggggttgggcgtcggcctggtcttcgtcgtcgcctcgttcatcggcttcgaagccaccgtcatcttcggcgaagaagcccgcgatccacggcggaccatcccgatcgccacctatgtggccgtggtggtgatcgcctgcttctatgccttctcgacctgggcgatcacccagtattacggcccgtcccatatcgtcgccgccgccaccgaacacaccgccacgctgttcttcgatgcctcggacgcgttgctcggcccggcggtgaccacgatcatgaacctgctgctgatcaccagcctgttcgcctgcgcgctgtcgttccacaacaccatcaaccgctatttcttcgccatcggccgggaaggtctggcctgggccggccttgcccgcacccatgccgatcaccagtctcctcatgtggcagggctggtgcagaccgggcttgccatggctgccgtcatcctgttcgcgctgtcgggtctcgaccccttcgccgtggtcttcgcctggatgagcactttcgccagcatcggcattctggtgatgcagatcctagtctcgctgtcggtgccaggcttcttccgcagcgatacgcgcggcgtccggctctggaaccgggcgatcgcgccggcactctcgggcctcgggcttgccgtctgtctctggctggtgatcgcgaatgtcgagctggtcagcggatcggattcgggcctggtcgccgccttcccgctgctgatcctggcgatcggcgccctcggcatcgccttcgccctgggcctgcgcgcccgcaggcccgccgtctatgcccgcatcggcaaggcctttgaagagatcgcctgaccgatccttccgcccccgcacctgcccccgccgcccccgcacatcttcagacgtcacgccttcaggagttcgccccatggattgctgccacggccaggccacccgcaccctcgacgtgctgcacccgctgcgtccgctgtcaccggaagagatccgcaaggcggtctcgatcgttcgtacccggccggaactggccgagttcgccatcgaaaccgtcgagttgaaagagcccgacaaggctgcctatcgggccgggagcccggtcccgcgtgaggcgcgggtcaacctgttcagcctgcaccggctgggcgtcacccgcaccgtggtcgacctggatgcaggcaccgtcaccgcggtcaccgaagcgccggacgcccggccgatgatccagctggaacagttcatggcgatcgaggacatcgtgaaggcgagccccgatttcgtcgccgcctgcgcgaagcgcggcatcaccgacatggcgatggtctgcgtcgacccctggtcggcgggcaatttctcggtgccgggagaggaacaccgccatctctgccacaccttcgcctggctgcggctgcgcgagaacgaaaacttctacgcccatccgatcgagggcgtgaatgcggtggtcgacctgaagacgcaggaggtcatccgggtcgacgattacggcgtcgtgccggtgccgatgggggagcacaactatgaatcccagttccgcgacagcttccgcccggcgctgaagccgctcgacgtggttcagcccgaaggcgtcagcttccgcctcgacggccccgtgctcagctgggacaagtggtcgctggtggtgggcttcaatgcccgcgaatcgctcaccctccacgacatccgctatgatggccggccggtcatccaccgcgcctcgctggtcgagatggtcgtgccctatggcagccccgacaacggccatttccgcaagaacgtgttcgacatcggcgaatacggcatcggcaagctcgccaattcgctcaagctcggctgcgactgcctgggcgccatcgaatatctcgacgtccatctcgccaccatgagcggcgaggtgatgaccatcgagaaggcgatctgcatccatgaagaggattccggcctgctctggaagcactgggacttccgcaccgaacgggccgaggtacgccgggcgcgcaagctggtggtgtcgtgcatctgcacggtcggcaattacgaatacgcgctctactggtacttccacatcgacggcacgatcgagttcgagatgaaggcgacgggcatcatcaataccgccgcctgcctccccggccagccgcccaaatacggccgcgaggtggcgccgggggtggtcggccatatccaccagcacattttctgcgcccggctggacatggcgatcgacggcgacgccaacagcttcgtcgagtgcaacacctatgccgaggcgccgggccccgacaacccctatggcaatgccttctacgaggcccagacggtgctgaagaccgagctggaggcctgccggcggatcgagcccgcaacccatcgctactggaaggtgatcaaccccggtcggctgaaccatgccggcacgccagtcgcctacaagctggaacccggccattgcgtcacccccttcgtccatcccgacagcccctcgggaaagcgggcgggcttcgtgcagaaccatgtctgggtcaccgcctatgatccggaagagcgcttcccggcgggcgagcacatgaaccattcgaccggcgccggcgggctgcccgatttcgtgaagcaggaccggccgatcgagaatgccgacatcgtgctctggcatgtcttcggcctgcaccacccggtccggatcgaggatttccccgtccagccctgcgtgatgaccggcttcaaactgatgccgtcgggcttcttcaacggcaatccctgcatcgacatggcgcccgagaccaacgccgccagctgctgcgcccacgcctcggcctgaggcgcacaaaggtacgacggacagcgggagagggagggggagagggtcatggccgtgctgccgaccttcatgggcgggctgctgctggggctggccggcagcctgcattgcgccggcatctgcggcggcatcgcttccgccaccctgcttgccgcccggcccgtcgccaccgcccgcggccgggccggggcgcttctgcgcatccagtcggggcgggcgctcacctacaccctggccggcgccgtggccggaaccggctcggccggggtcgccgggctgctcgacctggccggcgccaaccagctgctcagggtcgcggcggcgctgaacctgctttgggtgggggccgccctggccggcatcggccgggggccccggctgctcgacggcctggcacgccgggcgggggccgccgcagccgggctgctgccgcagccggttccggccggccccggcgtccgcgccgtcgcactgggggcgatctgggggctgatgccctgcggcatggtctatgccgccctgctcaccgccctgctcgccggatccgccaccagcggcgcgctggtgatggcgggcttcgctctcggcaccatgccggcggtcgcagccgcggcactcggggcgggcgggctcatcgcccgggcccgccacggcgcaccacggctgcggctggcagcgggtgtcggtctgggtctgatcggcctcgtcaccctggcggtgccgccggccctgctcaccgaaatctgcctgttttagatgcatgattcctggaatcattctgattgactaaaaacagggcagaaaaagccgaagaatcgccccgcccgccggctttatcccgcagatcgggccgctctctcgctcttcgaaataacggtacgcatcttgctagacgaaagggcccccgactccgagtaaacgagagtccggcccatgatctcgccccatcacttcggtaccatcacctcgggcgccattgacggactgacctcgatcatcaggtcgaagggcggcaggccggaagaggtctatgcccgaatcggcctcccgcccgagccgggcggggccgaggttctgccgctcgccagcttcaccgccaccctggaagccgccgccgccgataccggctccaccaccttcgggctcgattacggccgggtcttcgacatccgccggctgggcggggtgggggaggtgttccactgcgacctgacggtcggcggcgcgcttcagaaattctgccgctatctgcccaccgcccaggacaacacccgggtccggctggaggtctcggacgatcttgcccggctgtcctacgagatcgaagatccgacggtgcatgaacgggcccaggacgccaatttcaccctggccctgcagcatcatgtcgtggcctggctggccgggccgcgcttccgggcaacgttggtcgagttccgccaccagccacaggacgacgcccccgactaccgccatcatttcgattgtccggtccgcttcggggcgcgcgagaacgcgctgctcttccccgctcactggctggatgccgtgatcccgaccgcggatccgggccgctgccggcgagtggaggacgatctctccggccgcctggcccaccacaccgcccgcatcgacttcgtggccggcatcgaggcctggatcgtggaagcgctgcatcgcggcacgccggtcgaactggtcggtcttgccgccgatctgggcatgagcccgcgcaccctgcagcgcaagctcgacgccgcgggcgtggccttcgccgatctgcgcaaccgggtccggctgcgcctcgcccgggcgatgctgaccgaaacccggatgccggtcacccagatcgcgctgcatctgggctatagcgaaaccagcgccttcacccgtgccttcaaggcgatgaccggccggtcacccgccgccttccgggcggcataactccagatcgcgggcagccgggcttgtcaccggcagccgggtccgcgaagatcggcgacccgttcccgccggagacgccgccgatgaccgaccgcctgcgcctgatcacctggaacatcaattcgctgcggctgcgcatgccgctgctgagccgggtggtggaggagacccgccccgacgtggtctgcctgcaggagaccaaggtcgacgacgccaattttccgctggaagccgtgcaggcgctgggcttcgcccatgtctcgttccgcggcgacaagggctataacggcgtcgcgatcctgtcgaagcggccgatcgaacctgccggccaccgcttctggggcggcgtcgaggatgcccgccacatctcggcccgcctgcccgacggcatggtcgtgcataatttctacgtgccggccggcggcgatgtccccgaccccgaggtcaacccgaaattcgcccacaagctgcgcttcctggacgatctcaccgcctgggggcccgagatcgccggcagcacggcgccgcggatcatggtcggcgatctcaacatcgcgccgctcgaaaccgatgtctggagccacaagcagctgctgaaggtggtcagccacacgcctgtcgaggtcgaaaagctcgacgccgtccaggccgccggcgcctgggtcgatgtggtccgccaggtcatcccgcccgaacagaagctctattcctggtggtcctaccgtgcccgcgactgggccgccgccgatcgcggccgccggctcgaccacatctggaccgacgcaaccctggccccccgggtgcgcggcgccctggtcctgaaagaagcgcgcggctgggaacagccctccgaccatgtgccggtgatggtcgatatcgatccggcctgatccggcggggctgccggacgggaggtaaaacgcccgtccggcacggatccgagggatgccctcaatccgcccaatacatgtcggtcagcggggtgatcagctccggcgcgttcttccagtagccgcgcagcttcgcgtcgtagacgccggcctgggccagctggaacaggaagccgtgcacggcatcgtcggccagtttggtctgcaggccctccagcttttcgatctgctgctgcgggtcgacggtcttgcggaaatcgtcgtacatcgcgcggaactcggggctgtcatagccgtagaagtactccgtgcccttgatgtagttcgacaggtcgcgcggcgagacatgcgcgatgatcgtcatgtcgtagagcttcttcttgtagacctccgacagccagaacgggaattccacgttcaccagctggacgcggatgccgccggcggccagctgctcgcggatgatctcgcccgagcggcgggcatagggcggcggcggcagctggagggtggtctcgaagccgttggggaagccggcctcggccagcagttccttggccttggcgacgtcatgcggatagcggccggtcaggtcgacataggccgggttgtggggcgggaaatggctgccgatcggggtgccgtagcccgacatcgcgccgtcgatgatctcctgacggtcgagcagatggttgaccgcccggcgcacgcggatgtcgttgaagggcggcttggcgttgttcatcgccaggatgacctcgccctcggtcgtgcccgagaccacgacgaagcgcttgtcctgcttgaactgctccagcgtctcgggcgccgggatcaccgggaaggcattgatgtcgcccgagaacagcgccgccgcggcggtgttgggatcggggatcacccggaagctcacctcgcgcagcttcgcggtcgccgccagccggttggcgtcgttacgctccagcaccacgcgatcaccgcgcacccattccttcaccttgtaggggcccgatccgaccggcgtggtcttgttgttggcagccgtgtccggatgcacgatcgcggcatcgcccatcgccagattggccaggaaataggcgtcgggctccttcagccggatgaccaccgtggtggcgtccggggtttcgatgccggtgatcagcgcgaagatcgtcttgctgggattggtgctgtccggcgccatcgcccgctcgaaggcgaatttgaccgtggaggcatccagcggcttgccgtcggtgaaggtcacgccctcgttcagcttgaaggtatagaccttgccgtcgggcgacacctcccacgacttcgccagcagcggctgcaccgtgccggtctcgtcggcggtggtcaacgtctcgaacacgttccgggtcaggatggtgtcgatcgacgcggtggcgtccgaggtcgggtccatcgaggtcggctcctgctggatgccgatcacgagggtatcgcggggggcgcctcggccgccagggctgcgccgaacaccgcgaaggcggcgatcacggcagctttgagcgtgcgacggtgcatgcggatgcgatcctgttcttgtctgcagccgaaaggcggcggcaatgccgggagagtgccggtgagccagagaatggtagcggatcgcgacggaagttctgcaaaaatgtgacagttacatgacagcgcccgcatcgatccttacgatgcgggcgccgttccggctcagaatattacgcaccggttgcgtccagtgctctcatccgtatcagaggatgaacttcgacagatcggcatcgcgcgagatgccgcccagctgcttctccacataggccgcatcgatcgcgaccgtctggccggaatggtcggtcgcgccgaagctgacctcgtccagcagccgttccatcaccgtgtgcagacggcgggcgccgatattctcgacgccgcggttgatctcggcggcgatgtcggcgatggcggcgatgccgtcggtctggaagtccagcgtcaccccctcggtgccgagcagggcggcatactggcgcaccaggctcgcctcgggctcggtcaggatccggaccagatcgtcgcgcgacagcgcttccagctccacccggatcggcaggcggccctgaagttcgggcaaaaggtccgagggcttggcgacatggaaggcgcccgaggcgatgaacaggatgtggtcggtcttgaccgcgccgtgtttggtcgcgaccgaggtgccctcgatcagcggcagcaggtcgcgctgcacgccttcgcggctgacatcggccccgctgcggccctcgcgggcgcagatcttgtcgatctcgtccaggaagacgatgccgttctgctccacctgggccagggcggttcgggtgatctcttcctggtcgagcagcttgtcgctttcttcggtcagcagcagctccatggcccgcttgaccgtcagcttgcgtcgcgcctggcggccgccgaacatcttcgacatcatgtccgacaggttcaccatgcccatctggccgggcggcatgcccggcacctcgaaggccggtgccgcgaccgaggcctcggcgacctcgatctcgatctcgcgatcgtccagcgtgccttcgcgcagcatcttgcggaacttctgccgggtgtcggcattggcggtctcgccgaccagggcgttcagcagccgctcttcggcgccgagttcggcccgggcgcggacatcgcgccggcgctgctcgcgcacctggaccagcgccacctcgaccaggtcgcggacgatctgttccacgtcgcggccgacatagccgacctcggtgaacttggtcgcctcgaccttcaggaagggcgcgttggcgagcttggccagccggcgcgcgatctcggtcttgccgacgccggtcgggccgatcatcaggatgttcttgggcagaacttcctcgcgcagcccttccggcagctgctggcggcgccagcggttgcgcagcgccacggccacggcgcgcttggcctggccctggcccacgatatagcggtcgagttccgagacgatctcgcgcggggtaaaggcgggggtgtccatcacgcggtctccaggctctcgacgacgacttcgtggttggtatagacgcagatctcggccgcgaccttcatcgacttgcgggcgatggtctcggcgtccagcccctcgatatcggccagcgcccgggcggcggccagcgcataggtgccgcccgatccgatgccgatgatgccgtcctgcggctccagcacgtcgccattgccggtcagcaccagcgagaccttggcatcggccacagccatcatcgcctccagccggcgcagatagcggtcggtgcgccagtccttggccagctccacgcaggcgcgcgccagctgcttcgggtgccgttcgagcttcgcttccagccgctcgaccagcgtgaaggcatcagccgtggcgcctgcgaagcccacgatcacgctgccgtcgccgatgcgccgcaccttgcgggcattggccttcatcaccgtctgaccgagcgacacctgcccgtcacccgcgatcaccacccggccgcccctgcgcaccgaaaggatcgtggtgccgtgccatgtcgtcgtcgtctcgccgttgctcatcgtctgcagagcctgtcctcgatgggaggccggcggtgacggatcaccgccggaatgcccgctcatgtggtcgagatcgaccgggcggtcaagagcaaccgcccggggccccgtcagtcgtgatgatcatggcccatggcgggcaggggttcgtcccggggatccgcccccaccagatgccggaccacgggcggggtctcgcccctgtggaaccggttcaccccggcctgaagcccggcatcggcacgggtgacccggcggtgatggcgcagatgctccagccacgaggcggcgaagaagatttcttcgaaccgggtcggatcttccgcatcctccagcacccgccagccgaaagcgccgtcgcgccggcggatgcgggccagctcccgaaccgcgtccagaaaggcccggcgatcggccgggtcgatccgataggtgatggtgaccagcaccgggccgcgatcgcccgcaaccggcgcggccgaagccgggtccggccagtggcgcgagggggtgagatcgtcggtgcccgcaggcagcttcaccagccgggcgagggcgaggcccgcaaggctgccgccgatggcggcgccgaccagcgccacctcgatcccggcgctctgggcgaccagaccccagacggtggagcctgcggtcatcgcgccgaagaacaccatcagatagaccgcaagaccgcgggcccgcacccagtcgggcagggtggactgggcggcgacgttgagggtggtcagcaccgcaatccaggcggcccccgccaccgccagcgcgccggtggccgcccagcggtcctggacgagggcgaggacgagggtgaccagcgccgtgaccagggtcccgcccaaaaccagaagatgacccggcagtttcagccggggcagggcgatcgcgcccgccaccgcaccggcgccgatcgcggccaggagcacgccatagcccgcggcatcgaccatcagccgttcccgggcgatcaggggcagcagcgcccaataggccgaggcgaagaggaagaagccgccggcgcggagcagcacccggccgagcgcgcgggagccggcggcatagcgcagccccgcccgcatcgccggcagaaagctttcgggcggcaggtccgaggtccgggccgggcgccgccagagcaggaacacgccgaccacggccagatacgagacggcgtcgaacagataggcggcggccacgccggcagtggccacgatcaacccgcccagcgccgggccgaccgcccgcgagatgttgagcccgagcgagttcagggcgacggccgggcgcagctcggcgcggccgaccacctcggacacgatggcctggaaggcaggacccgacagggcggcaccggcaccggcgaccaggatcagcgcgagcagcagccccggcgacatcagcccaagatgggccgacagggtcagcgcggcgcccaccaccagcagccccgactgcacggtgatcagcagccggcgccggtcgacgatgtcggcgagcgcgccggccggcaccgagagcaggaagaccggcagggtggtggccgcctggaccagcgagaccagcagcggcgagggcgaaagctcggtcatcagccagcccgaggcgacgtcgcgcacccaggtgccggtattggagaccatcaccgccagccagatggcgaggaacacccggttgcgcagcggcgcccaggcactggcggcagctggcccggtttcggcatcggatgggtcggtccgggtggtggtcatggtctccgtctcccttcgggaagaagacgggccggccggggcccgaaggctccggccggcccggggtggatcaggcggcgtcgggcaaggggagcatcacgccggcttgaacggggtggcgggcacatgggtcgccggcacaggatcgagggtggggccgtgggtcacccgttcgggcgcgccatggaccatggtgtaggcatagtcgacacccatgccataggcacccgaatgctccttcacgatcgagatcaccgcgtcataggtctccttgcgggcccagtcgcgctgccattccagcagcacctgctgccaggtcaccggcaccacgccggcctggatcagccgctgcatggcatagtcgtgggccgccttgctggtaccgcccgaggcatcctcgaccatgtagatctcgtaaccgccgtcgagcattgccgagagggcgaaggtggtgttgcagacctcggtccagagccccgacaccacgatctttcggcggccggcggcggccagcgcgtcacggaccttctggtcgtcccaggaattcatcgaggtgcgctccaggatcggctgttcggggaagaccgagagcagttccgggtaggtgtggcccgaaaaacccagggtctcgaccgaggtgatggtggtcggcaccccgaagaccttcgcggccttggcgaggccgacgacattgttcttcagcacctggcggtcgatggactgcacgccgaaagccatctgcggctgctggtcgatgaagatgagctggctgttctggggggtgaggacttcgagcttcgcgttcgacatgaccgtggtctcctgatttttctgtttgataagggtcgggaagggccggatgggaagtcagctctgcaggaaggcgagcatgtcgtggttcaggcggtcggcatgggtgtcggtgatgccgtgggggccgccttcgtagaccttcagctccgcatggggcaccaggcgcttcgaggcccggccggcggcgtcgatcggcacgatctggtcgtcgtcgccatgaacgatgagcgtcggccggtcgaacttcttcaggtcttcggtgaaatcggtttccgagaaggccttgatcgagtcgaaggtgttcttgtggccgccggtcatgccctggaaccagaaggcgtcgatcatgccctgcgacggcgtggcgcccggccggttgaagccgaagaaggggcccgaggcgatgtcctggtagagcttcgaccggtcggccaggctgccggcgcggatcccgtcgaacacctcgatcggcaggccgccggggttcgcgtcggtcttcagcatcagcggcggcaccgccgaaatcaggcccagcttcgcaacccggcctgtgccgtggcggccgacatagcgggtgatctcgcccccgccggtcgagaagccgaagagcgacacctcgtgcaggtccagggcctggatcagctgggcgaggtcgtcggcataatggtccatgtcgttgccgtcccagggctggctggaccggccatggccgcggcgatcatgggcgatgacccggtagcctgcatcggccaggaacatcgcctggcggtcccagctgtccgcgttcagcggccagccatggctcaggatcaccaccggcccgtccttcgggccccaatccttgtagtggatctcgacattgtcgcgggtcaggatgctgggcatgacacgttttcccctgaagaagcgcagaccggtcccgttgcggccgtgaagattctgcggccggaggcatgatctggatgatgtttcgttgagcggagaggccggatccctgaagtctcggccatgttcccggccggtcgggatcaaaaatcttctgtgcgagaggcagtcccggaagaagtctgcgtaggttttgtttcagcttcgggtctgtctcgtcgtcgttccgtgtcttcagaatagccgggtggcatgaaactgcaaattgcgatgctgcaagacgatccttgcagaaatgccgtcgaactccgctcccccattgcccgaacgcaaacggcccgcacccccatgatcggggacgcgggccgcagaaggaccaccggctcagacgtcagagacaggccccgcacccgcacacctcgtgcgggtgcaagccgccattgaggcggcggccaagggcgcggtagcgcccgcccggcgaggggctaaacctaaagactcttcctgtactgcacgaagcccgaccggtcggcgaccttgtcgtagagctgcatggcggtggtgttggtctcgtgcgtcagccagtagacccgggcacagccggcggcccgggcgatatcgtagacatgggcaatcagccggcggcccgcaccgctgccgcggatgtcggcggcgacgaacaggtcctgaaggtagcaatagtcgccgctggtccagcaggagcggtggcggatgtgatggaccagcccgaccgcgcgatcgccctgccaggcgagggcgccgcccatgggttcggccgggtcgagcagccgcgcccaggtgacggccgagacctcgtcgggaatgtcggtctgataaaaactctgatagccgcgccagagcggcatccaggcggcgtgatcggccgggccgatcggccggatgacgatatcggtcgtggtcatggggtcagggcctcgaacggaagcgtgaggggagggttgcgggggccagggccgccagggccgcaagcgagatgagggcgaagccggcaaggtcggtggcggcgggccgctcgccgagcagcagcaccgaggcgaccacccccaccgccggaaccagcagggtgccgagcccggcaacgctggccggcaaccgggcgaccgcctggaaccagagcaggtaggcgagggccgagccgatcagggtgttgtaggcaaggcccagcgccggcagcagatgcagcccgtcgcccatatccgccccgtcgagcaggaagcccagcgtcaccgccgcggtgccggccaccagctgccaggcggcgatcgcgatcgggtggccctggatccgcgcccgtttgagccagaccgtccccgccgcccagctgacggcggaaccgagcgcgaagatcacgcccgacggcaggccacccgccatcagcggctgcatcagtacgccgagaccggcgatgccgagcagaagggccacgatccgccgccggtccagacgctcgccaaggaacaggcaggcgagcgccgttgcccagatcggcatggtataggcacagatcgccgtgcggctggtcgaggtgccgagctgggcgaaggccgcgaggatgccgaagccgccggtgttgagcaggccggcgatggcaagatccaggcgctggcggcggccttcgatcctgaggctgacgccctgcctgcgggccaccgccatcagcacggccgcggcgcagccgaacgacaccacacgcagcgcccagggtgagagatcctgaagcgccagccggcccgccggccagttcagcccccagaccaccgtcaccagcagcatcgaggcgcgggcggcaagatcggtgcgctggcttccggccccggccgccgtggtcacgagacgccgagccgggtgcgctgccggccctccgcatcgaaattggcggggtcgagccaggccagatagcggggcttcagccgtgaccagtcaccgtcggtcatgccgaaccaggccgtgtcgcgattggcgcccttcaccaccatgtgctggcggaagatgccttcgaaggcgaagccgaagcgttcggccgcccgccgggacggggcgttgtcggcattgcacttccattcgaagcggcgatagcccatccggaagatcaggtcggcgaacaggaacagcgcttcggtcgcaacccggctccgcgcgatcgtcggcccccacaggatgctgccgatctcgatcacgccatgggtggtgtcgatccgcatcagcgcctgccggccttcggcgcggccggtcgcgcggtcgatcaccgcgaagaacaggggatcggtcttcgcctgcgccgcctctgcccaggcctgaaaggatgccgcgtccacgggcggttcctcgaacagatagcggaagcgcgcctccgcccccggggcggccgaggcctcgaacagcgccgccgcatgggtggcggcattcagcggttcaagccgggcatagagcccctcgatcggtgcccgatcggggcgcggcacgcccgcccaggccgaaagatcgcgggagcgggaaagatcggggccggtggtctggtcggtggcggtggtctggtcggtggcggtcatggcgcaagcgttccacagaatgatccggttcctggaaattgcgccgccaacaggtccgatgtaaacgtccacttccggaatatctggcagaccaatcgtgaaagggagggcggcaatggcggcgataccggcctggctggcgctggaccgtgcggccggtgatctggaggggcagatctatcgcagcctccgcgaccggattctcgacggccggttgaccgcgccgcaaagcctgccgcccagccgggcgctggccgcggcgctgggtgtcgcccgctccaccgtggtcaacgcctatgaccggctgaaggccgagggctatctggaggggcgcgccggctccgccacccgggtcgcggcggtggtgccgcgcccggcagcaccggcggccatgacggccatcgcccccctcccgggggccggcgcaccgcgccgccgcttctcgcccggtgtgcccgacctcggatccttcccctatgccgattgggcggcctgtctcagggcggcggcgcgatcggtccgcgccaccgatctgggctatgccggcaccgccggtctgccggagctgcgcgccctgatcgtcgaccatgtcacggcggtgcgcggtgtctcggccacgcccgaacgggtgctgatcctgccctccacccgggcggcggtcgacctgctcgcccgggtgctgctgccgccgggcggcacggtctggatggaagagccgggctatgcctcggcgcgggcggtgtttcaggcggcaggcgcccggctggtaccggtcgcctgcgatgcacagggtatcgacgtcgccgccgcagccggcacggcgccgccccggctgatctacaccaccccctcacaccagtacccgacgggggtgaccatgactctgccacgccggctggccctgctcgaagccgcacaaaccgccggtgccgtggtggtcgaagacgattacgacagcgagttccactatgccggccaccccatcgccgccctgcagggcatcgaccgggcaggcgtcgtggtctatctcggcaccttctccaaaaccctggccccggggcttcgcgtcgcctatctgatcgccccgcccgccctgctgccggcgctggcagaggcccatcgccgtggcggtgccgcggtgtcgggccatgtccaggcggcgcttgcccgcttcatgcgcgacggaaggctgcgcgcgcatctgaggcggatgatcccggcctatgccgaacgccgggccgcggttacggcagcccttgaggcccgcctcggccatctgctgacgaccggccccgcggcagagggcgggctgcagctcgccagctggttccacgaccccgccaccgacgataccgccgccgcccgccggctcgccgccgaaggctacggccccgagccgatgtcgggctttcatctgggcccgccccggccgggcctgctgttcggcctcgccgatgtcgaccccgcccgcatcgatgccgccatggcccggatcgcggcgattctcgacggccgctagctgccgccatgcccttcgatgccacgcccctcgataaacggccggcgcttcgtcagcgctgccgcgcaatactccaggaagacatgcacccggccggatttgcgcagatccggatgggtcagcagccagagcccgtcagacagcgcctcgtcggcggggcccaggcgggcgagatcgggcagggcatcgcccaccaggcagggcagccagccggcgcccagccccgcggccagcgttgccgccatgccctgcaccgtgttggtccggaacacgatccgttccgccggcacccgggtctcgagatgacggttggctttcagcccggccagctcgtcgcaataggcggcccaggcaagatcgtcgggcatgtggccgcccgcctcgtcatgggcgcggcgctggcgatagggcgcccaggcgatgcgcgccacgcgccgtccgaccaggttttcgggcgggtcgtcggtcgcgcgcagcgccacgtcgctttcgccgcgggcaaggttgagcgcgccgttgccgaccaccacctcgacccgcgcgcccggatgcagcgcggtgaagccggccagcaccggcggcagcagccaggttgcgaaagtgtcgctggtcgcaatccggatctcccccgcctcgtcctggtcctgaccggtgatccggcgggtgaccgagacgatgtcgacctccagacgctgggccagcgccacaagttcttcgcccgccggggtcgggacatagccgctgcgccggcgttcgaacagcggccggtcgagcacggcttcgatctcgcccaggcggcggaaggcggtggaggtgttgatgccgatccggccggccgccgccgccaggttgccggcttccccgatcaccttcacgatgcgcagatcgtcccaggacagttttttcagcgggtcgttcaagggcgggtctcgcatcgcagacgggtcacccgcatcatagcgcgccctgcggctgcctgcgaatttgcaccgcaacgaatttcaattgggttttcccgcggaatttcatacatctacaccgcacctgcggcgacgatcccagtggagacgagatgagcgagcgcaccgccacgatcacgcgcaacacccgtgagacccggatttccgtgaccgtcgatctcgacggccagggccgctacgacgtgaagaccggcatcggctttctcgaccacatgctggaacagctttcgcgccatggcctgatcgacctcaccctgcgtgccgaaggcgacctgcatatcgatttccaccacaccaccgaggataccggcatcgccatcggcgaggcggtggcgaaggcgctgggcgaccggcgcggcatcacccgctacgcccatgcctatatcccgatggacgagaccctgacccgggtggcgctcgacctgtccaaccggccctatctgatctggaaggtgaatttcacccgcgacaagctgggcgagatggacaccgagctcttcaaggagtggttccaggccttcgcccaggcggccggggtaacgctgcacgtggaaaatctctacggcgagaacaatcaccatatcgtcgagtcgtgctataagggtctggctcgggcgctgcgccaggcgatctcgatcgacccgcgcgcggccggctcggtgccctcgaccaagggcgtgctcggcggctcgctctgacctcttccgtccgtcacacccttccctcatcccgaagcccatgcgcatctattcggtccatgtcccccctctggtcagcccggtcgaccgcgcccgcgtcgtcgccgagggcttttcgtgggcggccttcgtgctgggggtgctctgggcgctctggcaccggcaatgggcggcagccgcggcgatcctggtggcaggcatggtgctggcggggggtctgggggcggtcggcgccggggaggccaccgtcaccatcgccgccgtggcggtaaatgcgatctacggcgtcgtcgccaacgatcttcgccgccggcgctacgaccgtctgggctggcgcgagatcggcccgatcgccgcggatgacgccgacgaggcgctgtacaaggccgcgatcctgcatcgcgacgccgccatccgccgcgatgcacgcggctacgaccagggagggcggggccccgcgcccggtgccttcggccacgccgggggcctcggcgtctgagggcctgacggccccggcgcccgggccccgaaaccagaccggtcgcccccacccggaagcgacctcggcctctgtgccggcccccgcccggctgtctgatccggccacgacccagtctggcccctctacccggaagcacctatgaacatcgtcgtcatcgattacggctccggcaacctcaggtctgccgccaaggccttcgcccatgccgcagacgaggccgggatggccgccgaggtgctggtgagtgccgatcccgcccgcatcctggcggccgaccggctggttctgcccggccagggcgccttcgccgattgccgggcggggctggacggtgccgacggtctggccgaggcgctgaccgaggcggtcaccacccgcggcacaccctttttcggcatctgcgtcggcatgcagctgctcgccaccagcggcttcgagcaccgcgtcacccccgggctcgactggatcggcggccgggtggaggcgctggcgccgtcggatcccgcgctcaagatcccgcatatgggctggaacgcgctcgatttcgaaccgggccgccatccggtgctggccggggtggagccgggggcgcatgtctatttcgtgcattcctatgccatgaccgtcgatgatccggcgcatctgctcgccaccgccgactatggcggccgggtgacggcgatcgtcggccgcgacaatctgatcggcacccagttccatccggaaaagagccaggcggtgggccagaggctgatcgccggctttctgcgctggcggccctgagcggcccggcctcgcatctgcaggcaaagcttccttccgacttccgcgacttcgacaggacgacagccccgtgatcatctatcccgccatcgatctgaaggacggcgcctgcgtgcgtctggtgcagggcgacatggaccgtgccacggtcttcgccgacgatcccggcgcccaggccgcccgtttccgcgaccagggtttcgcatggctgcatgtggtggatctgaacggcgccttcgccggccggccggtgaatgcggccgcggtagaggcgatcgtgaaggcggtggatctgccggtgcagctgggcggcggcatccgcgatctcgccaccgtcgaggactggctgtcccgcggcctggcgcgggtgatcctcggtacgatcgcggtgcgcgatccggcgctggtgcgcgaggcctgccggctgttcccgggcaaggtcgcggtcggcatcgatgcccgtgacggcatggtcgcggtcgaaggctgggccgagacctcgaccatgagcgcggtggatctgggcctcgccttcgaagatgccggtgccgccgcgatcatctacaccgatatcggccgcgacggcacgctgcagggccatgatgccgaacagaccgcgcgcctggccgagcggctgaccaccccggtcatcgccagcggcggcgtcgcctcgatcgacgacatccgcgcgatcaaggcggtggaacatcgcggcgtcgccggcgtggtcaccggccgcgcgctttatgacggccggctggatcccgccgcggccctggcggtggctgccggccgcgcctgatccgaccctgccttcttcccacgcggacgtccctttcctgccaaggacccggccatgctgaagacccgcatcattccctgcctggacgtgaaggacggccgcgtggtcaagggcgtcaacttcgtcggcctgcgcgatgccggtgatccggtcgaacaggcccggctctacgatgccgccggcgccgacgaactcaccttcctcgacatcaccgcctcgcacgagaaccgcggcaccatcctggatgtcgtcgcccgcacggccgaacattgcttcatgccggtgacggtgggcggcggcgtgcgggcgctggaggatatccgcgccctgctgctggccggtgccgacaaggtctcgatcaactccgccgccgtcgcccgccccgaactggtcgccgaagccgccggcaagttcggcagccagtgcatcgtggtcgcgatcgatgccaagctgggcgacagcggccgcttcgagatcttcacccatggcggacgcaagcccaccggcatcgatgcggtcgactgggcggtccggatggcggagtacggcgccggcgagctgctggtgacctcgatggaccgcgacggcacccgggcgggtttcgacctgccgctgacccgcgccatggccgatgcggtcacggtgccggtgatcgccagcggcggtgtcggcacgctcgaccatctggtcgaaggggtgcgcgaaggccatgcctcggcggtgctggccgcctcgatcttccatttcggccagcacaccatcgccgaggccaagcagcatatggccgcggcgggcatccctgtgcgcctgccgggccagtaagcctgcgccgaaacctcgcgctcttgatgaatatcccatgacggcggcgtatctggttggaaccagattgcaactgtcataattttccctctgttgttccaaggaaccgcatcccatgtgctccacccacgacaccgatgcgaccgtgccggccgctgccggcgctgcggaccgcttcgacgcggcggtggcgcgcatccatttcaacggcgacggtctggttccggccatcgcccaggatgccgcgaccggcgaggtcttgatgatggcctggatgaacgaggcggcggtgcgcgagacgctggccacccgccgcggcgtctattggtcgcggtcccgcaaggggctgtggcgcaagggcgaaagttccggccagatgcaacacctgaaggcgttccgtatcgactgcgacggcgatacggtgctgctgctggtgaaccagcagggcgtcgcctgccacaccggccggcggagctgttttttcgacgaggtgaacccggagaccggcgacatcaccaccatcatgaccccagagatcgacccggagacgctgtatggccgacggacggactgacaccatcaagacaaagaacgacaccgccggccagaccgactgggacgtgctcgaccgccttgtgaccaccatccggtcgcgcaagggggccgatccgtccagctcgtatgtcgccaagctgctgggcaagggccggctgaagatggcccagaaggtgggtgaagaagcggtcgaggtcgctatcgccgcggtcgcccaggacaaggacgcgctgatcgacgaaagcgctgatctgcttttccacctgatggtgctctgggccgatgccggcctcgacccggccgatgtgatggccacgctcggccgccgcgagggccgttcgggcatcgacgagaagaagaaccgcaagaactgaagacgccggggccaggccggacacccgggcgtggcggccggggttgacgaaccggggcggcacaccggaacatggcggccgacctcagaccgtccatccggagccgccctcccatggcctatgatccgaacaacatcttcgcccgcatactgcgcggcgagctgccctgcaagaccgtctacgaagacgagcatgtgctcgccttcagcgacatccggccgcttgccgatgtccatgtgctggtgatcccgaagggcgcctatgtctcgctcgacgatttcaccgccggggcaggccccgaggtggtcggtcacttcttcaaggtggtgggcgaaatcgcccgcatcaccggtgtcgccgaaaccggctatcggatcatctccaacatcggcgcccatggccatcaggaggtgccgcacctccatgtgcatgtgatcggcggccggccgctgggccggatgctgcccgacgcccgcggctgacggtgcgaccggcctgacgcaacggcggatacccctggtgtccgccgttttccgttcggccgaccggagatgatggcaaaagagggaatgacggggatgaggatgggattgcagaccatccggcaccggttggtcgccatggcgccgggatggtggctgacgctggcagctctcatcatcaccaccctgctctgggggctggggcgtgcggccatctccgatgccgatcctctgcctgccggccctcttcccgactggcgcccgcccagcctgctgctctcggcctggtcgatcaccctgatggcggtgctgctgctctccactgcccgggcccgcagcatagaaccgctgttcggcgggctggaccgcgcggtccggctgcaccggcagctcggccccatcgccatcggcctggtactggtgcatgtcgccctctacatcccatccgaattgcggccgggtggctcggtggcggggctgttgatccccttctggtccggcggggccgcaggcttcaacgccctgatcctctgggtggtgatcctctggaccgggctcgcctatagcggccggctgcgctatgaacgctggctgtcgctgcatggcctgctggggccgatcttcatcgccaccgccgcccatgccctgggcgccggcccgaccatccgggcctatgaaccgctgcgcttctggatgtgggtgctggtgctgaccggcgctggggcctgggtctggcgggtgctgctctaccggcggctggcgccgcgctacccctatcggctgcgggccttgcggcaggtctccgacgacacgctcgatctggtgctgcgcccgaccgcccggcggatgatctacgaaccgggtaccttcgtgttcatcgcccggcccggccttgcggaactgcacccgttctccatctcctcctcgccggcagagcgcgatctcagggtctcgatccgcatggcgggtgatttcacccgcgggctggtcacgctcgcgcccgaggatccgatcgatgtcttcggccccttcggcggcttctcgccccatcgccatggccggcaccggcggatgatctggatcggcgccggcatcggcatcacgccctttctcggcatgctgcgctttgaaaccgtcaacgacgatttccgccgggtctggctgtggtatctggcccgcgatgccgcccacgccccctatgacgctgagatccgcgagaccgtgcccaaggccgagtcctggatcgactacgagctgtggaccaccgccgatcgcggccggctgaccgccgcccgggtgctggaaaccgtgcggccgctcgacgacggcatcgccgtcatgctctgcggcacgcccgctttcgttcgcgacatgacccgccagttcctggccgaaggcctggcccccgaccggatcatcgccgaggatttccgcttccgttgagcggccggacgggtcagcatccgggggtcggggcgcgtgccctgcctgcctgacccagcggcatggtgaccggatgcatgatacagccttcatcgccctcgactggggcaccagcagtttccggctctggctgatcggccatgacggccgggtgctcgccgaacgccgcagcgccgaaggcatgaccacggccgccgcgaccggtttcgaggcggtgcttgaaggccacctcgccgatctgggcgtgcccgccaccgtgccggcactcgcctgcggcatggtcggtgcccgtcagggctgggtggaggccggctatgtcgacaccccggcccggctgaccgggatcgcggccggcgcagtgcgcgtgcccggcatcgcccgcgacgtccgcatcctgcccggcatcgcccggcgcgacccggccgcccccgacgtcatccgcggcgaggagacccagatcctgggcgcccttgccgcccacggccttcaggcggccacgctctgcatgcccggcacccattcgaaatggggccgggtcgccgaggggtgcctcagcgccttcagcaccttcatgaccggcgagctttttgccgccgtcaccggccacaccatcctcgcccatgcggtggccggcgcccccgacgacgaggatatggaggccttccgccaggccgtcgccgcggccctcgccgcaccggcgcggatcgcgaacctgctgttccaggttcgcggcggtcagctgctgttcggccggggggccgccgccgcgcgggagaccatctcgggcagcctgatcgggctggaaatcgccggcggccacaccgccgacggcagcgagctggtgctgatcgccgcgggccgcctcgcgcggctctatggcgtggcattcgacgtggcgggcctgccccatcgggtgatcgatgccgatgccgcggtgctgggcggcctctcgcttgccgcccgcagcatctggccatcccggacctgactgccacacacctgactgccacatacctgaccgggcccaccgacggagacctgcctgatggatcgcattccctttccgccgatggcgcggccgctgatcgccatcctgcgcggcatccagccccacgagaccgaagccgtggtgtcggagctgatcgaggccgggctgaccgcgatcgagatcccgctgaactcgcccgaccccttccgctcgatcgggatcgcggcacggctggcgcccgagccggtgatcgtcggtggcggtacggtgctgaccccggccgatgtcgcccgcctgcaccaggccggcggccggctgctggtcacccccaattgcgacccggtggtgatccgcaccgcccatggtctgggcatggtctcgatgccgggcgtgttcaccgccaccgaggcgctcgccgccgctgccgccggcgccaccggcctcaaattcttcccggccagcgtgctcggcccccagggcatcaccgccatccgcgcggtcctgccgcccgagctggtgatcgccgcggtgggcggcgtgtccgaccgcaatttcgccgactatatccgggccggcatcaccgccttcggtctcggcaccagcctctacaaaccgggcatgagtgccgccgatgtccgcgcccgggccgatgccaccatcgccgcctatgatgccggcctcgcggcctgatcagagcggcagatcccgccagccggggaaatgatccagcgaccggctggtggtcgtgaaccagccgaagggggttgccgggtcgggcagggggtcttccagctccagggtctcgatctcgcgcccgctttccagatcggcgggcttccagcccaccaccagcggcagggccccgcgatcggcgctccgggtaccgatcaccagccccaccgccgggctccggtcggtcaccgcccagcgtgccgccgccgccccgatcagggtcaggcgcaggtcgtcgtccacccggtcgcgaaaccctgagccctgcagccagacatccacccaaagataatacgtccagtcgaaactgagcccgcgctcggccgcaaaggccatgaaggggcggaagatactcatgccgtccgatggttggccgtccgacggttgaccatccgacggccggccatcctcgccgtccagcctcaacagtcccgggcagatgtcgaacagggtgtgccagtagatcctgaggctggtatcgaccctcacccaggcccgcgagccgacgcccagttcgtcatgccgggccggaacggtcagatggtcgagcaggtcgctgtcgatccgccgctcagacatgggccggctcccgacccatcaccgcacgcagcgtatcgatatcggcgatgatccgatcctcatccaggtcgtcgtcgcgctcataggtgatggtcgcatcggggtcggtcaccagcgcacggcaaagggccagggccgcgcgggtatcggccgccagcgcccggtcatgggtatcgagcacgatcggcggctggccgaccgagtggtcatagccggcgacatgaaactgccgggcgctgcggatcacctctgtccaggcctcgaacggcaggccgcaattatgggtcgcacaaaccgcgttcgacacgtcgaacagcaccgtgcagccggtccgtgcggtcaggcgccggaagaaatccggcgcatcccgcccgccatccatgatcgagggatagttttcgaaagcgatggtgcagcccagccggtcctgccagcgcgccacccggtccgccacccgctcgaactcgcccgcatagtcgatctcggccagatgcagcagatgccggccctgatgggtgaagcgggcgatgtggtccgacacatagatcggccgggtttcgcggatgatcgccgtcagccgcagggccagctcgtccagctccgcctcgggccgttccatgaatttcgaaaacatgatgtgcagccccaccggggcatcgaaggcggccgcgatctgcgccggcggcaccgccaggaaattgtcgaccagcagttcgacatagtcgatccgcccggccgcaatcagccgccgcaccatcggtgcggttgcccccagggtgaagttgaagccgatccgcaaggcggcacctccgtcgtcgggcatatcgtcaggaatggtgtcggggatggggagcggccggacggccgctccccacatgcccgcacccgctcagccggcgacggcgcagatggtggcgcagcgcgcaccggcgcggccggcgatctgcagggccttgcgggcgctgatcttgatcgacatgagagcgtctccttttgacaataatcatggggtccgaatgatgtattcatccggtcttcacatatgcatcacacccgtatcgggcttacgatgctttcatgactctatgtttatcctgatgttgagtcgactcgtattttcatcataccgcgagtatttaaatttgactcaatcctggggcgcggcatgccgtgggtcggtcagaaactgcgcatcggtcagggtcttcaggaaggcgacgatatcggcgcggtcgcgcgcatccagatcgatgcgcacgatcagatcgctcttccatggattgcggcggccgtcgccggcatccgggccgccggtgatctgccggccgccggcggcgtagatctccagcacctcttccagcatcccgacgctgccgtcatgcatatagggggcggtcaccgccacattgcgcagcgacggcgcccggaaggcgcccatatccccggcgcggccggtcatctcgatcagcccccgatccgtggccggataggcgccggtcccgtccaggtcatagagcccggtgttgtggaaggcgcggtcgaccacgcggctgcgcgcgtgcaccacctgatcgttgaagttgaagctgccatggcagtgatggcattcggccttttcgccgaaaaacaggtcatggccgcgccgttcggcctcggtaaaactctcctcgcccgccagccagcggtcgtagcgcgacgagaacgagaccaggctgcgctcgtaactggcaatcgcgcggatgatcgaggtcaggctcaccggcgcggccatctcggggaaagcggtccggaaggccgcgaccatttccggatcggaccggaagcggttcagcaccgtctcgcgattggcatcggtcaggcccatctccaccggatcgatgccgaacagcggcacggccatctgcgcttccagcgtcaccagcgccgggttggcccaggtcaggctggcattccaggcgacattggccagcccctgggcattgcgccgcaccacgtcgcccgtggcgcccaccggatgggcgcggccatcggcgaagcccagcgcctggagatgacagtccgaacaggcgagcgtgccgttgcccgacagtctggggtcgtggaacagccgccggccaagctccaccttggccggggtcatcggattgtcggccggcacgcgcggcggcgggacatgggccggcagatcccagacccagccctccgcacgggcgccgccggcaaccgccagccagaccatggtcagggccagcagcagccggatcatttcgccaccacccgaaaggcggtggcgacgccccctgccagccccagccgttcgaaaaccgccgcacaatcggcatcgtcgggcgcgctcatgcaacccaccgccccgccctggtcgcgcgcaaggtcggtggcggcgaacagcaccgccagatccagcaccacctgcgcgcgggcgggatcgaacgctgcggtcaccacgcccggccggttgggccggtcgcagctgacgatctcgccggtgaccggattgccggtgcagccggtggcgcccagatgcaggaaccaggtgccggcgcggccgccatccggccgtgccaccccgccctcgggcacaagttccagcttcacgtatttgcgccccgcctgccatccccagcccatcgccgccaggtccagcggcggcggcgccagatcggtggcggtatggttcagccgctgtggcacgcccagggtgaaggccaaccgccaggggccggccccggccccgtcatccacccggcccgtgacgcgggtattggtctcagatgtgccctcgcggcatgcgccggtggcgtcttcggcatcgatcagggcgacgccgtcatgctgccagagcgtttcgtccagcatgaccggccaggctttgccggccgcatcgatcagggccaggtcgtggacatagaagcggccatcgcgcaggccggctgcaaccgcaggcagccccagcgccgcggcaggggcggcgcagccgaccgccaccgccccggcaacgatgccgaagccgatggtgacgctccgctccgccgccaggacaggcccggcggcaagcagaagcagaagggtggcgaggcgggtaaggcggcagatcatcatcggcccctccgcctcagaaccgtgccgtcaggcgcagattgacgctgcggccttcttcataggcataggtctcggccagcgactggcgataggtgacataggcctcgtcgaagaggttggtcaccgctacgtccagccggtaccagtcgcgatcgaaggccacccccagatcatgcaccgcatagccgctgcgccggcggagcggggtcgagtcgtaatcctgggccgccgcatagatgccggcataccagacccgccagtcctggttcaccgcatagccgatcccggccgcgaccttgtccggcggcgcatagagctgggcgccggtatcggcatccttggaccgcagcttcgaataggcgagcgagacatcgacgggtcccgcctgatagctggcctcggcctcgatgccgcggcgtttcgcttcggcgacgttgcggcgctggaagatcaacccggtgccggaaaagggcgctgtgcgggtgaaggtgccgaccacctggctgtcgatcagatcgtcgacccgttcatggaacacggtcgccttgaagcgcagcgcatcgcccggcaaggccagatcgtcgaaggcgagggtgaaaccggcttcggtggtatgcgcggtctcaggctgaagttccgggttggggatgaagttgaacagcgcccgggtggcggtcaggttcggatacatctcggccagggtcggcgcgcggaaggcctcgccatagccgacgaacaggcccagcaccggggttgcctgccagtgcagcgccaccttgggcgacagccggtcatgggacgaggatgcctggccttccgggtcgatttcatagcggtcgtgccgcagggccccgatcagggtccagtcctcgaagatcgtcagctcgtcctggatgaagacaccggtggcggtcagatcgccatccggcagcaccacattcgtcgagcccgccgtgcggttggtgttggtgtcgacataatggtcgacgccataggtcagcttatgcgccagcgccgccccggtctcgaaccggctggtgttctgaagcgacaggccgcgggtctcggtctcggtcgaggtggcgtcgagtggcgggttttcacggctcgtcgtgtcgaaacgcagtttcgtgtaatagagctgcaggctgccgtccagccagctgcgatccgggtcggcgaaggaccagcggccggaatactggtcctggcgacgctccagcagctgcgcataggggaagagggcgctgccgccgggattgttcggcccggtcagatcatcgtcgaaacgctgatacgagatgtcgatccgatggtcggggccaaggtcgagcccgcccttgaacagacccgagagcagatcgccctcgttctccagcttgtcaccggtgccggtgcggatgttgtcggtgctgcgataggtcagcgccgccagcaggtcgccatccgtcgtgcgggtcgtgccggccacatggcttgaaaaggcgtgattgccgctccgccagcccaggctcgcccggccgccggtggtttcccccggcgccagaagatcctcgggctccagggtgcggatcgccatcacgccgcccaacccgccgctgccatagctggcggaaaccgggccgcgcaccacgtcgatggcgccgatcatgtcgggatcgatcagcagcggcgagaacacgccgccctcgttgttccgccgcaccccgtcgaccgacaggatgatccgcgggccgatgaagccgcggatcgacgggttctgcgccgcagggcgcgggccgccgcccatgtcgacattgggcaggcggcgcaggatggtgaggtcagccgcctgggcatcatccagcgccgtgcggtcgatctggctgacggaggccggcagatcgaaggccgaggcttcggtgcgggtggcggtgacggtgatcgcctcaagccggctgatcggggcggattttgcttccgctccgggggcgtcggtctcttcggcatgggcaggaacgggctggacggtgatgcccagcagaagggtggcggcggcggtgccggcaagcggcagccggccgcgcagcacggatgcggcgggtcgggtcatggggtgcggatccgaaagcgggcgggcagccggcggcccgggcgcggatggacgcgcagccaggggcctgccggaccggacgccccgtccagccaccgggcaggtggccgacaggggcagctcttgaaggtcggatcaggccccgatcgggggtgccctggccttaagggtggccagataccagccggccgcgatcagcccgccgggaagagggggggcatcgtggagccgcaccagcctgggggcaggcgccatgatcggcagcggtggcgtggaactgccctgcaccagcaggcagagcgggcaatcatcggccgaaggcagcgcctgatcgggccggccatcggcatccgtgtctgcgggccagtcgtccccgacctgatcggccagaaccagccgcacgccttcggcggtgcagatcggcgtcagcagcccgaaggccatggccggggcatagaccgaccagatcatcatctggaacaggaaggcgagcgcgcccgtgagcagccccgcccggcgcagccgctcccgaagccgaccgcgcggccccgtgctccgatgaggatatgacacccggcgatgctgcatccgatgacgctacaccggctcgcgtcctgcgcacagggcttttgcatcatgcgacccatcgtcgcagatggcgcccctcaggtgggcaggcccaggcggatgcgcatggcggtttcagagacctccagccgggccgccagatcgcggatctccgtcacgccctcgctgttgagtgcccggatcaacggccagggcatcagcagctgcgccgcgaaacggttggcctcggtttcgatcgcccctgagagatggctgcgatagaaggcatcatcctgaacaccccctgtggcgacgtctcgatgcagcaggaaatgcgcgatttcatgggcaatggtgaaacggcggcggactttgacatgccgcgcattgaccacgatcgcccagcccgaggggccgccccgttcggcatcccgcaccagcttgcccgaaagcgactccggcaagggctcggtccagacccgcagcccaagatcccgtgccagcgcaacgatcttgaccggtgccgactgttgatggcgggacacgacgtcgggcaccgccacgtccgcagtgaccggcgcatccaaggcggcaggccactcccgcacggcatcttcaatcatccgacgtggtctcctgaggtccgggcgcgcccggtctctgttcttctgcggcaacgacattggccgaggcaacccccgcgattccgcggtcgatcagagccgccatgcgcgcctggaattcgggaccgtcaagataggccctgacggcgctgcccaggcccttctcggcaaccatctccgcctggcgtgccgccttgcgagtaatataggtggcaccgaacagcgccaccgccccaagcacgatggtcgccgcggtcatgacgatggtggcggtctccaccgaactgaactggggtgcattgcgcagaacggcgtcggcagccgcctcgatcgagtccaagctcgcctccccctcaggatctacgagagcgcagtttccgtgaacaggtcgagaacatcaagttcattcgatgatattcaactgtaagatttaaatttttgtttatcaaataattggagagaggctatgccgccgacggcgtgctccgcaccgcccccggcgactgccccgtcacccgcttgaacgcccggctgaatgccgcctgcgaggcatagcccagccggtcggcgacgatgtcgatcggcagccggtcgcggccgatccagcgggtggcgaggcgcatgcgcaggccggccagatagcgcagcggcgtggtgccggtggcggccaggaagcgttcggcgaagaccgagcgcgaggcgccggcaaggccggccagctccgccaccgtccagtcgcggccggggtcgcgatgcagggccgccagcgcccggcccaggcgcggatcgcgcagcgcctgcacccagcccgaggcttcgccgcagccgttctccacccagccgcgcaggatcgaggccgcaaccacatcggccagccgcgccaggatcgcggcaaagccggcgcgttcggcgcaggcctcgcgctccatcgcctccagcatcggcaggatttcgggcgtgcggtcgatcagggtggcgaccgacatcacctcgggcatcaacgcgaccagcggctgcatgccgcccagatcgaagctcatgcagccgctgaacaccacggcaccggtcatggggcagcactctgcatcgcaggcgcgcaccgcctccacctgcgcacagagcgtccgggcggcgaaatcgtcgagatcctgtccgggctggccgggatcggagagcagagcatggatgccgccgcggggcagcagggccgcatcgccgggccccagccgcagcagctcgcccgaggggctttgcaggaagacctcgccgcgggcgacgaaatggaactgcgcccgcccttcttcgcggccgccatcctcggagaggtctttctccggcggcccgaaccgcaccccgcgcggaggggcaatctggatccgccgatagcggatgccgtcgagccgcatgcccatcagcagctcgctcatcgggtcggacagaggttcggccatggttccggactttcgatcaaagcttccggatcagatggcatggatcgtccggagagtccagcctaccttccgctctcctcctccaacctctcccccttccaccccctccctcctccttccgtccacgaggatcagatgatgaacgaggctgtcgcgacggccggccggccgggcagcgccgcccccgcctggggggccgtgttttccatggcgctcggcgttttcgggctggtgacggcggaattcctgcccgccagcctgctcacccccatggccgccgatctgggcgtcaccgaaggcctggccgggcaggcggtcaccgccaccgccgccatcggcctcctcgccagcctgctgatgccggccgcaacccgcgggctggaccggcgggtggtgctgctcggcttctcgggcctgctcgtcgcctccaacctgctcgcggccgttgcctcaagcctgcccgtgctgattgcggcccggctggtgctgggcgtggcattgggcgggttctgggccatgtccaccgccaccgtgatgcggctggtgccggaagcggcgatcccccgggcgctgtcgatggtcttcggcggcgtctcggccgccaccgtcgccgcggcaccgctcggcagtttcctgggcgatcagctgggctggcgggcggtcttcctgatggcggccgttctcggcctcgcggccttcctggtccagttcgccaccctgccgcgcatggccgcctcggccaccacccggctcggcacgctggtgctggtgctgcgccggccccgggtcggtgccgggatgatcgcggtgctgatggtcttcaccggccatttcgccgtcttcacctatgtccgacccttcctggagacggtgacaggcgtgggcatccagggcgtgtcggccatcctgctcggcttcggccttgccaacttcctcggcaccggccttgcggggccggccatcgcccgcaacctgaaggcggtgctggtggccatgccggcgctgatggtcgtgctgggcctggggctggtgctggccggcggcaccgtcttcggcgatgcggtgatgctggcgctctggggcatggccttcggcgcggtgccggtcgcctggtcaacctggctgacccgggcggccccggacgaggccgaaagcggcggcggactgatcgtggccgccatccagctcgccatcgccaccggtgcggccgcgggcggggtcatcttcgatctgaacggcgccccgggggttttcctcgcggccaccctggtgctggccgccgccgccctgctgatcctgacgcgcgtcaggatcagtccgcggggcacactcagtccgcgggaagggatttgagcacgctgccttcggtctgcaccgcccgggcgccgaaggcactgccccgcgccagcgcctgacccatctccagcccgcgcagccaggcgtcggtcagcccgccggcaaaggcgtcgccggcgccggtggtgtcgatcacatggtcgaccttccgggccgggcagctgatcttccggccgtcggcggcaaaagcttccgacccctcggcgccgtgggtgaccaccacccactccagccggtcgccggcaagtcgccgtgcagcggcgagcggatcggccgccgcggccggcgccagatcgtcgatcgaggccacgaagacccgcgccggccagctgccggccggcagggtcggttcatgttcggccggcgggatctgggcgatcgccggcaggccgcgttcggcggcggccaccagcagccggccagcctcggggttgcggctgttcaggaacagggcatccatgccgtcgagcacgctttccggcggcacccaggccagatgatggccgatcttcaggatggtccgctcgccttcgggatccagcagcagcatggtctcgggcgagtggtcgagattgcggtcgagcctggagacatccagcccgcaggcggtcacatccgccaccagccggtcgcccagcgcatcatgggccacgcgggtgatcagcgccgggtgatggccggcaagggcgagcgcagtgccgacattggcgccggacccgccgatgcgcgggccttcatccacgccccgcggccgtccacccgagacgatgggccggtccaggcggatcacccgatcggcattcaggctgccgacgacggcgatacgggcagggaagggggcaaccatgggcggaacatcctccgatcagtcagcagggtcggccggccgctcgccggtccgaccacgatcagtctgaccgccggggcgcgccacgtcgaggatggcgagcaggcggtcgagggtgggaccgtccagcgtggcgatccgttgcgccaccagattggccaatcgggtggcccgggggtccaggccgccggtctcaaccgtcaccttcggatcggacagcccggccagccgctccagctcctcggcctcgtcccagatgatgttgaaataggtgcagatctggatcagcagcgaccgggtcggcacgccgcgccggccgtgttccagcgccgagagataggcattggagatctcaaggtcgcgggccatctgcttctggctgatcccgcgcgcggcccgaagctggcgcaggcgctctccgaagggtgtcaccgctcgcgtttaagcaggatataggcggcgccgaagccgccatgcatctgccgggcctgggtgaaggccagcaccttcgaccgggtctcgggctcgttcagccagcgcggcagctcgctgcggatcacgccggccgggttcgtcgcccagggctcgcgcggcggctcgggggtctcgggtacggccatgccgcggcggcgcaccaccggctgcggcctgggccctcccttgccggtgatcaccagcacgcagcgcaggccgcgggcatgggaccgggcaatgaaatcgaccagcatgccgcgggcgacctcgcggccatggccgtgaaggtccagcatcgcctccaccggcatggcgcctcggcgcagccgggcctggctgcgccggtccagcccgtcgaaggccttgccggtcagcgcctgaagcggttcgggcgccgtcggccgccgccctgccggcgcggggagagaagccgccatcgccgccgccggcagttccggcaccggagggggtgggggcggtgggggtggcaccaccggcgcatggcccgacaacggtttcacatcgctcatcgccgagccgaacaggtccagctccccccggctgatgccgcgggcggaacgcggcaccggcctggcctgcggggcggggggcggcacggcggccgcgcgccggcgggtggcgggtgccacgccctggtcgtcccccgccgccgcggttgcatgaaccgagggcagatcggggccgcgcagcgacgagcgttcggcgacgtcttccgagcgcatcgcccgttcgaacaaccgcgcctcggcctcgggatcgggccgaagcgcgtcctggtcgccggttcggggaggacgtgcgggcatgggcagggtcagacctcgtcgacgatcaccacatgcagccgccgcggtccgtgggcaccaagctcgatctgctgctcgatgtcgccggtgcggctggggccggtgatcaggttgaaggtacgcggcggggcaccgcgttcggtgcgcagcctggcccagacatcctcgtaggcgcgttccacgcgtgaggcgggcagcaccacgatatgggtctcgggcaggaaattcagcgtggtcggatgctcgggccccgatgccagggccagcgtgccggtttcggcgatgccggcaaaggcgctggtcaccgagacctcgtcggccgcctcggccgggccggcgcgcagggtcagcagcggtgccgcccccgcccagtcgatccggtcgagcagcgggtcgggcgcccggccggccgccatcggcaggttgcaggcggccatgtagtcgaccaccgccgccggcacctcgtccagccgggcgacccgggtcaccgtgcccgccaccttctgcagctggtcgatgaacagcgacacccggccggccgggtccagatcggcccgggccgggatggtgttggggcggtgggcctcgatccgggcggcaacgcgggcccgggcctcggcctcgttcgccggatcgcggcggatgccggcgcgcacggcgcccagaatgcgggctcgggcatcgtcgccatgagacatggtcatcggccctgctccttcgctgacccacgatggcggcgggcggtggcatcccccggcgcctcggtcgggcggccgtcggccttccaggcggccacgaagctgcggccttcgggcgccggcatgtcgcggacacgggtccagcccccggcgagcggcagccgcttcagccgaccctgagaccggcccatccgcccgagcagggcggccgcggtgcgcgtaacgaggcgataggcccggggccgttttgcgaaccaggcccagaccccaagcccccagcgctgcgaggcggggctgagatggcgttcgaattcccgggtccgccaggcgcgcatcatccgcggcagcgggatccgcaccgggcagacctgttcgcagcgcccgcagaaggtcgaggcattgggcaggtggcccgcctcttccacgccgatcagcgccggggtcagcaccgcccccatcggacccggatagacccagccataggcatggccaccgacggtgccatagaccgggcagtggttcatgcaggcgccacagcggatgcagcgcagcatgtcctggaattcggtgcccaccatgcccgagcggccgttgtccagcagcaccacatggaattcctcgggcccgtccagatcgccctcgcgcttcggcccggtgaccagcgtggtataggacgagaattcctgccccgtggccgaccgtgccagcactctcagcatggtcgaggcgtcttccagcgtcgggaccagcttctcgatgccggccagcacgatatggcgcttgggcagcgacagggtcaggtcggcattgccttcattggtcaccaggatgatcgatccggtctcggcgaccaggaaattggcgccggtgatgccgacatcggcgtccagatatttctggcgcagcacttcgcgcgcctcgcggaccatgtcggtcggctcggtcaggcggcgggtcttgccatagcggccgtgatggcgcaggaacagctctgccacctgttccttggtcttgtggatcgccggcgcgatgatgtggctcggcggctccttggccagctggatgatgtactcgcccagatcggtctcgatcggctcgattccggccttttccagcgcatcgttgagcgcgatctcttccgtcaccatcgatttcgacttggtgacggtccgggcattgccggcgcgcgccagttccagaatgatccgccgggcatcggccgcggtctcggcccaatggaccttgccgccccgggcctccaccgcctcggcgaagcgctccagatagatgtcgagatggccgagcacatggttcttgatgtcgcgcgcctggtcgcgcagcgtctcgaactcgggcagggccgccgcggcggccgcccgcttgggcacgaagcccgagcggatcttggcgagcgaggcctgaagattggcatcgcccagggcgtcgtggacattgtccttgaagcggtgactggtcgcctccatcggatcgccctcccgctcagcgccggtccgcgccgacggcggtgtcgccgatggctgcggtgtcggtcatgtcggccagaacctcggccacgtggcggacctggatggtggagccctcgcgcttcagccgcccggccatgttcagcaggcagcccatatcgccagccagcagcagatcggcattggtggcgcggatatccgccaccttgttggagaccatacggcccgagatttccgggtatttcacgcagaaggtgccgccgaagccgcagcattcctcggcccccggcagctcgttcagggtcagcccctcgacggtgcccagcagcttgcgcggctgtgccttcacccccagctcgcgcaggcccgaacagctgtcgtgataggtgacggtggcatccagcctcgccttcaccccctccatgccgcggacatcgaccaggaaggccatcagttcataggtcttcgccgccagccggcgggcccgcggcccccagtccggatcgtcgcgcagcagctcgggatagtggtgcgagatcatgccgccgcaggatcccgacggcacgaccacatagtcgaagggctcgaaggtcgcgatcacctcgcgcgcgatcgcacgagcatcggcccggtcgcccgaattgaaggccggctggccgcaacaggtctggctgtcgggcaccaccacccggcagccggcctcttccagcagcttcgccgtggcgaaccccacgctcggccggaacagatccaccagacaggtcgcgaacaggccgaccgtggccggttcgcgcgcacgggcgggctttgccgccgtctcgcttggggtattcaccgtcgctcgtccttctgaagcttcggacaggcccgcgcgtctgcggggccggccggcatttgcggacgaggatggggcgatgtggccgcggaggcaagcctgccgctcacctccgggcgctcaaccgcccgctgcggccgtctccggggccggtacggtcgacggatcgatggcgagcggcagcagcacggcatagctgccgcgttccttcatccgcccggcgaccagctccgcgaaatcgcccggaccccagaacacatcgccgcgcaccgcccccttgatcgcgccgccggtatcctgcgcgatcatcagccgccggagcggcgtttccgaaagcgcgccgacacctgccggatagctggcatccaaccagaccggcgcccccagcggcagcatcgaccggtcgaccgccagcgaccggcccgggctcagcaccgcgcccatggcgcccagcggcccgtcatcgtccagaagccggaagaacacataggacgggttctgatccaggatcgagaccatccggtcgggatgggcggccagccaggtgcgcaggctctgcagcgacacctcttcgggcttcatctcaccctgatcgatcagcaccttgccgatcgagcgatagggccggccattggccccggcatagcccactcgcagcacccgtccgtcgggcagccgaacccggcccgagccctggatctgcaggaagaaggcatcgaccgggtcgtcgacccagagcagttccagcccgcggccgtcgagcacgccgtcggcgatcgccgcgcggtcgtaatagggggcaaaccgcccgtccgccacccgcccgaccagacggcgaccgtccagcgcatcgtcgaaggcgcccagatccgccaccaccagatcctcgggcaggcggtagagcggcacgtcgtgccgggtgtcgggggtcagcgatccggccagttccggctcgtaatagccggtgaacaagccgttggtgtcgccatcgggcttcgccacctgccaggcgttgaaatggcgctcgaagaaggcacgggccgcgccggcatcgtccagcggcagatccaccgcggccccgcagacatcgcgccaatggccgacggtgccgaagcgcccgccgcggtcgagcggcgccgccaccggccggcgcaggatgatccggcacgagatctggaaagcgccgagtgcagccgactggtcgtcgtcgtcccagccgggcaggtcgccgaaggcgatgcgggtgaagcgcggcccctcggcggtcaccgccggctgcggggccggcggcgtctcgggtgccggcaggttgcgtgtgctgagataccagccaccgatcagcgccgccccggccagcgcgagcacggcaaaggcggccgcaaggcgcagagaccgcctgctcatgcacggctctccggtccgcgactttcccgcctgatcggccttcgcatatggtcagcgggatcggtcctcatctgctggcactctccgaagggttcgcaatgatctggacgggcagggcggacggttcatgcagcagccaggcctctcgccaccggatcggaccggccgtgcacaaccggtccatcagcggcgctcccgccacaagcagggctgcaatctcgagacgggcaagcggtgcgcccaggcagtggaacgctccccggccaaaggcgagatgcggaacccgggagccgagcggacaggatgttccgacgtcacccacgatcgcaggatcccggtcggcgatcgaggtcatgagatagaccaccgcatcctttggcaagaggatagtcccgtccgccccgtcgctcagatggaacggtctgagcagacgacgtcgcacccccagtaccggcgtatccagccggaccagttcgtccaccagtaccatgtggttctccgggtcggatggcagcgcaattccatcccgcagccggcggaccaggatattggcgatacagccggctgtggtcgtcgtaccggtgacgagcagcttgctgcagatgtcggcgagggcggcatcatcaagcccgtccgcggtgccggtctccagaattgttgccagcagcggtgttgcaccacctttccgggcagcggccagacgctggcggaaataggcatccagcatggtctttgccggaccgacagaggcggactgtcccgtccagccggggtcgtaaccgctcaggatccgacccgccatggtttcaagcaccggcacatcggccggcgggatgcccagcagatcacgcatcaccgccatcggaacccgatcggcgaaatcccggaccagatctgccgtgccctcgcggaccagccgcgccgtcagatcatcgaccacgccctggactgccggcatgacgtcagcatcggacagccgggacacccagcttcgcagacgccggaccagaccgcgatgacggtcgccgccagcggtatcgaaggcattgaagctggccgtactgccgggctcggcaagcagcaccgacagaatatccgcgtgccgcgcgaccagccagacatccccgcccgtcgtcctgatcggcggcgtattgcgcaaggccgatagaaccggatgagggtcggctgcgtactcagcccccggtggcagaactccgaaagccgatgcaatgtcgatcatgagccggcccccttctgcaacccgcgcagggccaccagggcggaaagcgccgtcgccgtggtgaagctgcgtccatggtcggatgcacgaaccagattgcctgccgcattgggaatgtcgagcacggccgacgacggccagctgccgtcaacctgttggccggcaagcaatgcctccgcccctgcccctctgtcccgggccagaacccggatcctcagcgcaagcgcttggccgaaactggtatcgaccggatgacgcgctgcgcgcgcagcggcagccgcgatccggcgatcatccccgctcgcagcccgtccgcgtcgtccggccagaaccagtgcctccaccgcctgatcggtggcatagccttcctccagccaccaataacccggaaagacgccgtccgggcgctgatgtcggcgcaaccactctgccggggcatcgccgatggtcgacagacaggccgtggccgcagtgacacagccatgtgccgcggtccatccggcattgatcacgcgcccctccgacgcccgggcatggtcctctgccagataggtcacaaccccgccatcggcaccaacatgccgacgcaggaaagccaggcctgcggcgaagccgggctcgctctgccggccaagggcctcgccgagacgcagcgcccaggccgtgctgtcggcatctgccggctccacgccattccatccccagcccggtcgcccggcggtgcgggccgccagaagccgccatgcccgggcggccgctgccagagctgccgggtcacccgtctcaaccagggcatggccgacccgggccgtgacccattcctctgcgacgccttcgccaaacccgcgatagtcgagccaccagcccgcctgcacgcgggcatcgagcagaaagcggatggctgcctcgatcgcctcatccagacgccggggcgtctcgggaaccgcaggtggtgcagcccgaacgacatccggagccgtcgcctccagcacgcccatatacgccttgaccgcaccatcggcgaacccgccatggctgaccttgagatgactgaaccggcaatcgagccaggccgtccgcccgtggacgatgtcgtcgaggatcagcgaggcgggccaggggcgggttgcggtggtgggtatcacggcacccggccattccagaaccgaggcgcgcgccgccggggtgcaccgaccggcctggaccagatggtcgagcatccgccgccagcgccgatcgaacacctccggggggccgagaaaacattcgagacccagctccggctcagcgccgccatccccgatggtcatcgccagtcggatgcggtcgacatagacgaacagggcgtcgacccggtcctgcagggccctggcgtcgcccacccagccggcccgcccggcctgacctgcgatgtcatccggatccagatcgtcgaagatcagacggaagggcgcgcccggccggtcgagcatcagacccaggaaggcgagccgccccgtgccccgacgggcggcaagacaccggcgaagagccgcctcccgcatcgacggcagcggcagtccgaagcctgcgatgacgctctgcaccgtctccagggcggcactgccgccggccgccccggccagtcggacaaagaccgagagcgccggcggatcggcgccgtcatcgagttccagccagatctcctcgatccggtccagcccggggccgtcacagaaccgggcgagcgcggcaaacccggatccactagcggttatctccgccatccagctgcaaagccgatcaaactcgggtcctggccgaacccgctgctgaagatcgaccaccgttggatcggcaagccggatttcgagcccggcggccggcaccgcaggcagatggcgtgccagccgaaggactgcttcgggcatgtgcaggccacgctcagccgccacgaactccagaatcggtgccagtgccggcagccgaccgacgtcagcttcgatcatccgccgatctcctctgccagccgcagaagcccgtcccagccgggctccacccgatgcacggtcaacggcagatgttcagccagccgggcgaaacgtgccatgatttccgtggtcatgaagctccggcaaattgccggatgccacatgttgatcagcaggtgcaggcgccggaccgggtccggccggtacatatccccggtctgccgggtcaggagatgaatctcatcgagtgccagttccgccttatcggccggatcgacggagggggcctgccaccaccacttgcccgtcgagggtagcggcgccagcccctcggtacccgtggggagaaaccgtcgggccgtctcttcggtaagccgcaaaccggccgttccgggcaggaaacacacctgtggcccggtacggctgattgcgatcagatcatcggccgcaaccagccctccgcgggcgaccagtgcggcggccagggtggatttgccggcacctgtggctcccatgaaacaatgggtgcggccgcgcatgacgaccgcggccgcatgaagacaaagcaggccgcgccggaagagcagaatccccatcgggtcaccgaccagcgctccgggcacggagggcaatctgcccggacggcagatcacgtcgatacgatcgccctgatcctggatcagaaacatcatttcgcctggccagccgtagatcgtcgccgtatccgtgcgaccggccaccggcgcccccgggagagcgggggccggcaatcggcccggactcagcgccggttccgcagtttcgggatgccagccgatgacgacatcacagggcccgtcaccggtgggggcctggctgccgggcagatcgaaaggcgtctcgatcatcagtccgaacaaatggcggcggcggtacggttccagcatcacacgtcacctctgccggaccgggcctcccggtccaggaaccggcagacgagggtaccggtcatgacggtatcgaacattgccggggtccaaccctcccttccggagggccggacggcacgaactgcggcaagatagcggtcgcgatcgatccacgcccagcacgccggatgcgccgtctcggcccaggcctcgagcgcaccggcatagcgggcgaggcgggcggccaggacaggatcgaatgccggccccttgtcccgcctccaccggatctcgtcggggaggatcccggccatcgcccggcggtagaggcttcgctcccagccgccacgccggagttccgcagccggaaccgacatcatcagcgacagaagccgctggtcgagcatgggcaggcgcagatcgacgccgtgaagccgggcggatatgcccacaacatccgatgccggatgatccacccggccggggacgagcgcgacgcgcatcaggtcctgaggtcccatctgcagaaaacgccgccctcgccgccgcaggcgccgccagtccccggccgaaagcgcgtcccggcgcaatggcagggtctcggtcgaaatcggtcgaagtcccgccggcagcaacggcgcgacaacctcccgccggagcagggtagaccagggaacaccctgcacgcgatgcagatcggcaagatcctggacagcctcgcggaggcgtccctgccgcaacagcgccgcagccgtctgccgtccggaatgggacacgaagaggtcgcccgcaaacccgttgagcagaacgtcgacgccctgtgccgccgcggctgcgccaagtgcgagaaccccgtgggaaaggggaacaaaaggcagcctgccgagcaggtccagcacgcggtcgagctcggcgaagggatcatcatcagggaccatctcgatgcgaagcagatcgatattgtccgccgcctcggccaccctgagaacataaggccattcatcgcgttccggcccctggtgatcaagggggaggacggccgagatggccagaagccgcttgccccggcgccgaaggcgctttgccgcaatgagagcaatggcagaagaatccagcccgccgctcagcagcaccgccggtcgttccgcatcgtcgatccggtcatggatggcgacaatcagccgttgacgcagttcgccggcccagggatccgggcttgtcatgtcggcgggccggaccggtgtccagcggcggaggtgccgcagatcgggtggggcggtatccgggtgtggctttccggtatcgatgaccaggcattcgccgggtagaatcgtccgcactgcagcgtggcaggtcgcagacggcgcccgtcggtcctgccgcacaagctggtcggtgatcaccgtccggtcgagtctggccggaatccgcggcagggccgtcaacagccggaaatcggtggagaaggcgatcaatccgccccgggcgaccagatagagcggcagtacacccaccacatcccgcaaaagtgccaaatgccggccatcccagatggcagcgacatagtcacctgtcaggccggccagagcctcggcaccgccggcccgccaggccgatcgtacgaggtctgcgccgtgccgccgttgcgcgccccccggcatattcccggcgaggcgtccgttgaacaggatcagcggcgcggcgggtgacggggtatcaggtactcctgaaccgtcgtccggtcggggcccagccggtcgggtatatacgggccagcttgcaaacacggcacgcggaccgccatcaaccatcagacgatggcagacggtccctgtgccgacgcgctggtccagcgtccgcagccagtcagcgggaaggatgctgtctggtcccgcaagcaggccggcaaagtcccgcatcagtctccgccgtcagcgaggagaccggctgcctgcaggctgtcgatgaaccgcctgacatctgtttcacaggcagcacgctccacatcgaagccggccatcacatgctcgacgatctgcgacaagctgcgcggctcatcgatatagcgccagatagcgccgccgacgccacgtacctcataatactgaccagatgccatatcgagcacagccacctggccatccagatctgaccacacggcatcagggcggcgaaagatcaagtcttcagtcatcgaatgctcgactccaggccggctacgatggaaaatatcaggaatagttattgtcactgcccgggccgctgccgccggaattcgtcaagtcaccaacattacccaccagaacgagttccggtgcctcataccgcgcccgctcgtcctgctcgtccatcttcgccggcttgtattcgatcatattttcactccaatcagagcctggatattttgctcgtgaaaagatactaaaaagactcatggatagcaactgacagatggatgatcccgatgatcacgaggaggtgaatacatggatcaacaataccgggccgcgcttggctttctgcggttggcacgagatcaacccgaaatcagagcgcaagtctcattgatctcccaaaagaacgacgcactaaaacctctggtcgctctggccttcagccttggttatgaaaccgatgccgtagcccttgcccgtgcctggcagcaggattggacattgcgccgcctgcacagtcacgcccgctcaaaatctccggtcagtgacagctaagggtaagtcgcgcctgttcccgcaggagccggacagaggtccagatcgggggatgggtccggcgcagacggtgcagatgcggcaggatccgcaggatcagtgcccgggtctccagcctggccaggtgcgcgcccaggcagaaggtgttgccatggccgaaggacagatgcggatttggggatcgcacgggatcgaagacatccggatcggaaaaacgttccgggtcacgatttgcgtgatcgaacatcagatgcagcactgaccccgcgggaataccggtctctccgatcacgacatccgccgccgcgacccggccggtaccgcgcaccggcccttccagacgcagacactcctcgaccatcgtgccgagaatcgccggctcagccgccagcctggccgccacatccggacgatccaccagaagggccacgacattcaccagaaaatcgcgaatggtcgtgctgcccgaatagaccagcatggcagcccatccgacgaccatccggccgtcgtcgttccggccggcggcaatgtcgcgaacggccgcagcaagcgaaccttcgggtgccgcgaggaccctcggtgccagccaccggcccatcgtctgttgggcgaaacgaccgcgcatccggtcggcctcggtcggtgccatgtcatggccgcgtgtgatggccgccagcaggggatgcagatcctcgaacctctccccggcaatgcccaatacccgaaagatgatggtcagcgccaggggtgggcaagatcggcaacgacctccagcttgccccgggcggtggcccgttccagtacgccgtcgacaaaggcggatgcgacctcttcaagtcctgcgatctcgcggctggcgagatgtttcgtcagcaggcccgtcagatcgctcatccgccgtgcacgacgtccggccgcttcaccgcccgtctctgagagcggcttgcgcaccaccagatcggggtgtgccagtgccgcccgtacgtcggcataccgggtaatgataaaactgcctgcttcgtcatcgaaaaccggcagtgcggtcattcgccgctgcgggtcgcggtcaggatccagttgggatcgctcgaccgggtatcgcgctcgaaggtccagaggtcgatcaggtcgatctcctcggcgccgccggcgaccacgcgcccctcggcgtccagcgtctggttgatctgggtggtggagaagcgcaccgtcacctgcgccatgctgccgaccagccgggcctcggcgatgcgcggctcgcgcaccgacacgatgcgggtgctgtgggtctcgcccgcctgctcacgcgcttcgatcgcctgattgaagccggccagcacctgcggcgacagcagcatggccagcgtctggcgatcgccccgggcgaaggcgtcgaggatcatctcgaaagcctgctgggcgccctccaggaaccccttgggatcgaagttgcgatcggcgcggcggatatattccaccccttccagcgccggctggtcgatcagcgacatcaccttctcggacatcgggaagggcagcacccgggcgggccccggctgctgggcgccggcctcggcggccttggggtcgccgctgcggggggagagcgggttgcgcgtctcttccggcggccgttcgtggccggtgcgtgtgcccagaacgccacgcaggcgcagcgccacgaacacggcgacgagggcgaagaagaggatgtcgagatattccatggacatcaggacctggccgtcggagacgtccgcacgaaggatttcggcggcggaacacgatcggtcggccgcgtccggccggcattcgcacccgcggatcccggcacccgatggcatgggtgcggaaatggggtcgcacgaacgcgacgagggttggacggcgccgcctccacccttacataagggtcggttcaggaaagggcaagcatggtcgccgcagtctctctgcttctcgcaatcctcttcgtgccgctgatcgaggtcttcctgttcatccaggtgggcagcgagatcggcgccctgccgacggtggcgctctgcgtgctgaccgcggtggcgggtgccgccatgctgcgccatcagggtctgaaggccctgaccgaggcccgggcccggctcaaccgcaacgaggcgccggtcgatcaggttttcgacggcctgttcctggggctggcggccgtgctgctgatggtgcccggcttcttcaccgatgcgatcggcgccctgctgctggtgccggcctttcgccggctgatgcagcgccagatcctggcccgcacccggttcgtgatgaccggccgtccggggcctggccagccgggcagccagtggcgcagccgtgacggcagcgtgatcatcgagggcgagtactccgcgcccgcagatcgtcccggcccggcggatggtcgccgcaggccagaagacgacgagccgccgctgatcggacgctgacggagaggacggcgatcgaccaccagtcaccgtccccggcgctgcacttgcaccgcgcgggcgcacatgttacgcccgacatggccggcgatccggtcggccccagatcaacacctgcgtcacccggagaccagcaccccatggccgacacccagacgcccgagggcaacggcgcagccggcgccgaggcttcgccgcgcttccgcctcgccatccagtacatcaaggacctgtcgttcgagaacccgaacgcgccgcgctccctgatcgcctcggcccagacccggccgaacatccaggtttcggtgaatgtcggcgcccagccgctcggcgacgacaattacgaggtcgagctgaagctgtccgcctcggcgaagcacgaggaaaacaccaccttcctctgcgagctgtcctatggcggcgtgttcatgctcgagaacttcccgcaggagcagatccagcccttcctgctgatcgaaggtccgcgccagctcttccccttcgcgcgccgcatcatcgccgatgccacccgcgacggcggcttcccgccgctgatgctggacccgatcgatttcgtgcagctgttccaggccgagcagcagcgccgcgcccagccgcagtgaaacgcgtgagcgccggcaccgccggccgctccgccgctacctgcatgaaacgccgccgccctgatcaggggcggcggcgtttcgtttaaggccgatcggccagaaacgccgccagttcttccggcgcgccggtcgggaaggcctctcgcagaaaatcgagaaaggccgagacgcgggcgttcagcagccggcgggtcggatagagcgtccacagcacgatctccggcccatcgacatcgccaagccatcgcagacggcccgatgccagatcacggctgaccagcgagatcgggaggcatgcgatgcccgcacccgccagcaccgcatcgcgcaccatgatcatcgacgacaggctgagcaccggcgccgcccgaatctgtgatctgccggccggcgtcgtcaccggccaggctgccggcggctcgatcgggccgcgcacgactgcggggcagggcgtgccgtcgtcgggcagcggcagcgcggtgctcgccaccaccaccagccggtcgcgcagaaacggccgccccaccaggttgtcatctgtcgccggattgacccggatgaccagatcatagccttcctcgaccatgtcgacggcccggtcttcggtggtgacctccagccgcacctcggggtggcgccgggaaaaccgcgcggccagccggcccatggcggtctgcgcaaacagcagcggcgcgctgatccgcaggcgcccgcgggggctgtggcctcccgatgcgatcgcctgggcggtctcgttcagctcggtcagcagccgagcggtccgctcgtacagcgcacgcccgtcttcggtcagccgcaggctgcggcccccgcgctcgaacagtcgcagatcgagcgccgcctccagctcggccacccgccgcgacaacgtggccttgggccggccggcggcacgagaggcgcgcccgaagccgccatggcgggccaccaggttgaagtcggcgagggcaagcagatccatgtgttccaccattgagacgatatgtccagattgcgcggctatcggcatgatcccggatcatcgatgaatagggcgtccgatggcaaaccgaaccagggagttcccgatgaccattctcgtgacaggcgcgaccggccgtatcggccgccatctcgtcgaccagctcgtccggcgcgatgcggatctgcgcgtgctgacccgtgatcccgcaaaggccgctttccccgccggtgtcgacgtcgcacagggcgatctgctcgacatcgacgccatgcgcagcgccttctcgggcgtgcgtacgctctttcttctcaacgcggtcaccggagacgagttcacccaggccctcatcaccctgaacctggcacgcgaggccggggtcgagcgggtcgtctacctgtcggtcttcgacgccgaccgcgccgtcaacgtgccgcatttcgcggtcaaatacggcgccgagcggatgctcgcccagatgggcttcggcgccacgatcttgcgcccgacctatttcatcgacaacgaggtgatgatccgggacgtcatcctggaccacggcgtatatccgatgccgatcggcagcaggggggtcgccatggtcgacacccgcgacatcgccgagctggccgcgatcgaactgatgcgccgcgaccgggcgccggacgggctgccgatcgagacgatcaacgtcaccggccccgacacgctgaccgggccgcaactggcagagatctgggccggtctcctcggccgccccatcgtctatggcggcgacgatcccagcggtttcgagcagaccatggcgggcttcctgccgaaatggacggcgtacgaaatgcgcctgatggccgaacgctatgtcagcgacggcatgatccccgaacccggcgacgtcgcgcgcctgaccgccatgctcggccgtccgctccacagctatcgcgatttcgcggcgggcctggttcccaagcccccggccgcgttggcctgagcgcgacgctcttccttcccggcgccttgacgaaccgctccgacgccccctctttcatggaggctgcgcttcagaaaggcaccggaatgtcctgccctctccgccgcatcgtcctggccctggcccttctgctgcctgtccaggcagaggcggcgcccgtcacgctctgcaccctcgtcactgatgccgccgacggccgtgtgctgctacgcgaggggaaggcctgcgcagtatcggtcaccccagcttcgacctttaagatcgcgctcgccctgatgggcttcgaaaccggcatcctcaccgacgcccaccacccggtcctgtcctggcacaagggctatccggcctggcgggcatcctggcggcaggacacggatcccagacgctggatgacggactcggtggtctggtactcgcaggtcatcaccacccggctgggggcggagcgttttgccggactgacccgcgatttcggttacggcaatgccgatgtctcgggcgacgccggggcggataacggcctcacccggtcctggatcggctcgtcgcttcgcatctcgcccgaagggcagatcgatttcctgacccgcttgaccgcgggccggctgccggtctcggcgcggacggtggcgctgacccgagagatcctggagcagtcaccacaaccgaagggctggcgcgtctggggcaagaccggtgccgcaaagcgcccggttgcggacggcccgagcgcggacggatcgggagcggacggatcgcgcggggcatatggctggtttgtcggctgggcggaacagagcacgggcaacaccgcacgacgggtgatcttcacccggttgatcctggacacgcgcagctttccgtcgggggatcccccgggcccgcatgcccgcgacactctgttcgccgatcttttcagcaccgatgggctgctgcgctgacgcctcaatcctccgccagccagatcgccgccttgacctccttcaggatgaaggcctgatgggcctccagctcggccggggtgggggtgtggacccggggcggccgggcgaccgtgcggcggcggccgtcggtctcgcccggcccgccccgacggtcggcggccaggtcgaaaccgcgctggcggtcgcccagaaggtgcagatagacctcggccagcagctgggcgtcgagcagcgcgccgtgcagcaggcggttgctgttgtcgaccccgaaccggcggcaaagcgcgtccaggctggccggcgcgcccggaaagcggatgcgggccatctgcacggtgtcgatcgaccgcgacatcgggatgggctggcgccccagcctggtcagctcggcattgatgaagcgcatgtcgaaggcggcgttatgcgccaccagcggcgcatcgcccacgaagtccagaaagcggtcggcgacctcggcgaagaccggctcggtcttcaggcgctcggccgtcagcccgtgcaccgccaccgccgcctcgggcacgtcgcgctcggggttgatatagacatggaattcggcaccggtgcgcgcctgatccaggatctcgacgcagccgatttcgaccagccggtcgccggtggcggggtcgaagccggtggtttcggtgtcgaaggcgatctcacgcacgcttctcgtctcctcgttcggcagacgcggataaagacgatctcagccgccagggcgccggcgcggccccgtgggccgccggatccgtggccggtgccagtggtgcttccacatccggtggcgatgacggccgaacccgtccagcgccagtttcagcgaccggaaggcatggccatggcccagcccggtctggatcacagcgtcggcgccgcgacgcttttcggcatccggcacctgtttcgacagaatgtcgcgaaacttggcccgcgtcatccccggacgggccagcacccggcgggcctgcacccagttgggtgcgctcaccaccagcacggcatcgacatgggcatcgccgccgccttcgaacagcagcgggatgtccagcaccaccatcggtgcgcgccggcgggcatgggttgcgatgaagcggcgctgttcgtcgcgcaccagcggatggatgatccgctccagcgcgcgcagctccgccttgcggccgaagacccgggcgcccagcgccacccggtcgatgcgcccgtccttcagcgcctcggggaagcgctcgatcaccggccggaaggcgcggccgccgggggcgagcagggcatggacggtcgcatcggcgtcgaagaccggcacgcgcagccgccggaacatcttagaggtcgtcgacttgcccatgccgatggaaccggtcaggccgatgatcagcatggggcctccgctccgatcagatcggcggcgacatgccggcgcagcgctgcatcgaccacgggccgcaccccgaaccagcgctcgaagcccggcaccgcctggtgcagcagcatgcccagcccgtcgaccgcgaccagcccgcgggcacgcgcagccttcaggaccggcgtttccagcggatcgtagacgatatccgacaccaccagccggtcatccgcccgcgcgagatcgatctcgagcggcggctggccgtgcagccccaggctggtggtgttgaccagcgtgccgcacccggcaagcagatccgatctcgccgcccaatccaccgcctccagcaccgtcgccgggcaatgtggcgccagatcgcggatcagggccgcggccctttcggccgtgcggttggcgatcaggatccggccggcgccggcctcggcgagcgcatagaccacggcgcgcgcggccccccccgcccccagcaccagggccggtgccgccgcatcgcgtgccggcgccccggccgccagtgcggcaccgaacccccaggcgtcggtattggtgccgatgatccggtggtcctcgccgaagaccagggtattgaccgcgccgatcgcacgggccaccggttcgacctcgtcgcagagcggcagcaccagttccttgtgcggcagggtcagattgacgccgcgaaagcccatgcggggcagggccggcagggtctcggccagatccccgggccggatcgccagcggcagataggcgccgtcgatccggtggcgtgccagccagaagccgtgcaggcgcggcgaccgcgaatgggtgacggggtatccgatcacgccggccagccgtgcggcgccgctgatccagacgggatgcaggggttcggtcatcgtgcgcccgtccatcagctcgggatcacgccgcgcaggcgcaggaagtccagcagctcgatcagcggcaggcccagtatggtgaaatagtcgccctcgaccttcgagaacagctgcgcgcccaacccctccagctgataggcgccgaccgagcccagcaccgcctctccggcacggtccagataccggtcgataaaggcgggcgacagcgggcgcatggtcagccgggcgcggccgattgcatgccagacccgggcgccgtcgatggtgactaccgcggccgagatcagctcgtgacgccgacccgacagggcctccagcgtcgcgcgggcctcgtcgcgatcggcaggcttgtcgaaccagcggccgtcggcgaccagcatctggtcgcagcccagcaccggcacccggccggcgcggcccgagatccggcgggccttcatctcggccagcatcaccgccacatcctcggccggcgcaccctcggcggccatcgcctccttcaccgccgtctcgtcgatgcgggcggggagggccaggaaatcgagcccggcgcccttcagcaactgcgcgcgggcggcactctgggaggccagaatcagccgtggttccgctgccgtatcggcgtcgtcacggatcgaaacaggggtcatcggatcaactctcccccagatggcgcagatacatctgatagatcgcggccgcggtttcctcgatcgaccggcgggtcacgtcgatcaccggccagcccttgcgctcgaacagccggcgggcggcgatcacctcggtgcgcaccgcatcgatgtcgatatattccccgtcatcgggctggttcaggctcagcagccggttgcggcggatctgcaccagccgttcggggctggtggtcagccccacgatgaacggccgggtggcgctttccacctcgtccggcaggggctggccgggtaccagcggcacattggcggccttcaccccacgattggccagatagatcgcggtcggcgtcttggagctgcgcgacacgccgacaaggatcacatcggcatcgtcgatatcccagagcgactggccgtcatcatggatcagcgcgaaatgcatcgcatcgatccgggcgaaatattcctgatcgagcatatgccgccgcccgggccggcgggagaccgacacccccagatagccgctgacgatgtcggtgatctggtccagcaccggcacgcaggggaccttcagccgtcggcaggcctcttccagccgctcgcgcaattcgctgagcgccagcgtatacatgaccaggcccggatgggcctcgatcgactggatcaccttttccagctgcgccggagagcggaccagcgaccagacatgctcgcgcgcatccaccccgtcgaactgggccagcacggcacgggcgaccgtgttcacggtctcgccgcttgaatccgacaccagatgcagatcgaacaaaacctgttcgcgatgcagatctgcaccatgcccgccgccgcgcaatgccggcgcggcacccgctgccccgtcggcagagggggtaagcgcgggggctgcgggggtggggagcggcggcgccgcggtcggctcgttttcggccatccggatctccagcaagcgtcgtcgggggcgatgttcgtgccctgttcatgtcccgttcacggctgtggataacccggaatcacgggggccgaacggggtctggcgtcgggcgctcatattgcgtcaccgctcttcatctgtcatccgccgagccgtctccatgtgggcagcccctcaggcatggggacggcagagcgaggacggccgccggggacggcagagttttccacgttatccacgacattatcccccgagactccgcgcgcgactccggagttatccacccgggcctccggagggtgccgccggatcgtccacatgggggcttttctgtggatggtttgtgaatgggtggggatccccgatatccacagctaccctctatcctctacaacctttccatcccgaatcccttcctttctgcagatggggccttgtccacagggcgagagaactgcagtctggggccggaacatgcggttcgcatggttcgaacgaaagccggagcgcaacggggttgcgcagccgaacggctggcttttgccatcatcaggtgttgccgtttcggcaacgccatgccgatccggcaacggcagagacgttcggtcgcagccgaaaacgaaaatcgcccacggactccgctggaatcaagcctcccgaacgggcatgatccgcgcgaccggcggcagggctggccgaccgtcctttgccgacgcggccgtctgcctgccagagatccgaggaccgcatcgatgaccgagaccaccaagccgctgctcgccgccctcaaaggcgggcatccggatcggaccccgatctggctgatgcgtcaggccggccgctacctgccggaatatcgcgagcttcgggcgcgctcgaaggggttcctcgatctctgctacagcccggatcttgcgaccgaagtgacccttcagccgctgcgccgcttcgatctggatgcggcgatcctgttttcggacatcctggtcgtgccccacgggctgggtcagacggtctggttcgccgaaggcgaggggccgcggctcgatccgatccgtgatgccgcgggcctggccgcgctcgatcccgaacgggtcacctctttcctggcgccggtctacgaaaccgccgcacgagtgaaggcggcgctgcccgagggccgggcgctgatcggttttgccggcgccccctggaccatcgcgacctatatggtcgaaggcggctccagcaaggatttcctcaacaccaagcgctgggcctatggtgacccggacggcttccaggtgctgatcgatctgatcgtcgatgcgaccgtccgtcatctggaggcccagatcgccgccggtgccgaggcggtgcagattttcgacagctgggccggggcgctggacgaagacggattcgatcgctggacggtcacgcccatccgcagcatcgccagccggatccgtgccgcgcatccggatctgccgatcatcggctttccgaaccgggccggcacgctatatgagcatttcgtccggaatgccggtgtcgatgcggtcagcgtcgatccgacctggagcgtggaggcgatcgccacccgtctccggccgcatgtcgcggttcagggcaatctcgatcccggccgtctggtcgcgggcgggccggatctcacccgcagggtgcggaagatatgtgaccggctggctccgatgggcggtttcgtcttcaatctcggccatggcgtcctgccgccgaccgatcccggccatgtcgcccaggtgatcgcagcagtgcgcgaggctgatgccgcgagagtctgatacaggttatgattaaggaacgtgacaatatggaaacgggacgaatcgctgtcctgttgttcaatctcggcgggcctgacgggccggatgccgttcagccgttcctgttcaacctgttcttcgacccggcgatcatctcgctgcccctgccgctacgctgggcgatcgcgaaactgatcagcacccgccgtgcgccctttgcgcgggaaaattatgccctgatgggcggcggctcgccgcttctgccggagaccctgagccaggcccgggccctggaagccgagcttgagggtcgcgggctgaccgttcgggcctggccggtgatgcgctactggcatccctttgcgcccgaggtggtggccgaggtgaaggcctgggcgcccgatcggatcatcgccctgccgctctatccgcagttttccacctcgaccagcgcctcgtcgctcaaggactggcatcgcgccgcccggaaggccgggctcagggtaccgacctcaaccgtctgctgctggccggtcgagcccggcctggtcgaggcgcatgcgagcctgatcgtggagcgctggcatcaggccgaggccgaggcaccgggccggcccatgcgcatcctgctttcggcccatggtctgccgaagaagatcatcgagcggggcgacccctatcagtggcaggtggaacagagctgtgccgcggtgatggaccgggtggcggcgatgctcggccggccgctcgacaccatcgactggcaggtctgctatcaaagccgggtggggccgctggaatggatcggcccctcgaccgatgccgaggttgaacgggcagggcgggacggttgcggcctgatcctggtgccgatcgccttcgtctcggaacatgtcgagaccctggtcgagctcgacgtcgaataccgccacctcgccgaaaaatccggcgtcgcgccctatctgcgggcgcccacacccaccacccatccggccttcatccgcgggctgggcgatctggtgatgcaggcggcggggcgcgagggggtggcgcccgatcgggcagggccgtcctgtcccgcaaaattcggctgctgcgcctgtcgcgccaatacctgacgcgaccgcaaccagccatccgagacgaggcacccatcccatgatcgacgcattcgccggcgcctatccctggttcaaggccctgcatgtgatctcggtgatcgcctggatggccggcatgttctatctgccgcggctgttcgtctatcacgccgatgccgccccggggtccgaactgtccgagcgcttcaaggtgatggagcgccggctgctgaaggcgatcatcaatccggcgatgatcgccacctggctgttcggcattctgatcctgaccaccggggcggtctctctgtcggaaggctggctgcatgccaagatcgccctggtgctgatcatgtcgggcatgcatggcgccttcagcgcctggcgccgcgcctttgcggaggatcgcaaccgccattcggcgcgcttctatcgctggatgaacgaggtgccgacggtgctgatgatcggcatcgtgatcctggtgatcgtgaagcccttctgatccgaccagaggggcctggtgggtccccatggcggggcagagagcgtgacaattgcgcgattcggccggaaatcgaccaaggtcgtatcgatttccggcgtatcgggtttgacagcggccatgtgacgcgctaactgattaggcatcggcacggttgacgtgccggtgaagccggtatcgtgacgttcgtcccatgcctgcggcatgccgggacggaacggacagacggacgtcgccgggcgacatgcttcacccgtcaccacccgagccgccgcattggccgggcggtgggcattcagggatcgcagttgcgggtaccggtccggatcgccaggctctttgcgccgacgcggtctttcagtcctctcctcgtcgatcgaaccccttcaggaccacatccgtttccggaaccgaaccgggccgttaccggttcgtgatcgacgtcgatgatcatcgacgtctccgctcacatggtttgtgtccggccggcgccctgccggcccgttctggatgaccggactgtccgggtggttcggcccgaccattcgacacacacgcacgcagcctgtctgccgggcttgcgtaaaacaggttgagccaggcgtcgccccggcttcgtcgttgaacgggatcccgccattccggcgtcccccgtccgtcgacccccgatcggaaatccatcgcatgaaccttcaggaactgaagacgaaaaccccggcggagctgctccagtacgccgagaccctgggcgtcgagaacgccggcacgctgcggaaacaggatctgctgttcgcgatcctgaagcagtctgccgaacagaacgtcgccatccatggcggcggcgtgctcgaagtgctccaggacggtttcggcttcctgcgggcgcccgagagcaactatctggcggggccggacgacatctatgtcagcccccagcagatccgccgtttcggcctgaagaccggtgataccgtcgatggccagatccgggcccccaaagagggcgagcgctatttcgcgctgctcaagatcaacagcatcaatttcgacgcgccggacaatgcccggcacaagatcaatttcgatgatctgacgccgctttatcccaacaagcggctgaacctggaactctcggacccgtcgaagaagaccaccaccgccagccgggtgatcgacctggtggcgcccttcggcaagggccagcgcgcgctgatcgtggcgccgccgcgcaccggcaagacggtgctgcttcagaacatcgcccatgcgatcgccaccaaccaccccgagtgctatctgatcgttctgctgatcgacgagcgcccggaagaagtcaccgacatgatccgttcggtgaagggggaggtgatcagctccaccttcgacgagccggcctcgcgtcatgtccaggtcgccgagatggtgatcgaaaaggccaagcggctggtggagcacaagcgcgacgtcgtgatcctgctcgactcggtcacccgcctggcgcgcgcctacaacaccgtggtgccgtcctccggcaaggtgctgaccggcggtgtcgatgccaatgccctgcagcgcccgaagcgtttcttcggtgctgcccgcaacatcgaagagggcggctcgctgaccatcatcgccaccgcgctgatcgacaccggctcgcgcatggacgaagtcatcttcgaagagttcaagggcaccggcaattccgagctgatcctggaccgcaagctggccgacaagcgcaccttcccggcgatcgatatcggcaagtccggtacccgcaaggaagagctgctggtcgatcgcggcacgctctccaagatgtgggtgctgcgccgcgtgctgatgcccatgggcacgatcgacgccatggacttcctgctcgacaagctcaagcacaccaagagcaatgcggacttcttcgattccatgaacagctgaccgctgctgttccacgtggaacgcatatgagaaaggccgccgtcccatccctggggcggcggccttttccatacggcgttccacgtggaaccgtgcggtcgcctggattcgtcgagcgctcaaggcagcagcacggttgcaccggtggtggcgcgggcttccagatcgcgatgggcctgggcagcctccgccagcgggtaggtgcgggcggcaccgaccttcaccttgcccgagccgaccacatcgaacagatctttcgccgtggcgcgcagctcttccttggtcgaggtgtagtggaagagggaggggcgggtgacataaaggccgccacgctggttcagcaccaccagatccaccgggccgaccgggcccgaggactggccgaagctcaccatatagccgcgcggctgcaggcagtcgagcgaggccatgaaggtgtccttgccgaccgagtcatagaccaccggcacgcccttgccgccggtcagctccttcacccgcgccaccaggtcttcctcgcgatagaggatcgggtggtcgcagccatgggcgcgggccagttcggccttttcgggcgaaccgacggtgccgatgacggtggcgcccagcgccttggcccactggcaggcgatcaggccgacgccgccggcggcggcgtggatcaggatcgtctggccggcctggaccgggaaggtgcggcgcagcagatactgcgcggtcatgcccttcagcatcatcgaggcggtggtctggtcgtcgatggcatcgggcaccggcaccatccggtcggccggcatcagccgctcttccgaatagctgcccatcgggccgctggcataggcgacccggtcgccgggcttcaggtcgtcgacgccgtcgcccaccgcgaccaccacgccggcgccttccatgcccaggatcgcgggcaggggggcggggtagagaccggtgcggaaatagacgtcgatgaagttcaggccgattgccgtgtgacggatgcggatctggccgggcccgggctcaccgacctcgacctcgacaaacgccatcacctcggggccgccggtccgttcgatccggatcgccttcaccatcgggtgtctcctccatatgggcacgtctctggggacgcaggggtgtttcggttcccgatgatcggcgaggccgggcgatcgtgcaatgcccctgccggatccgccgccggaacggcctgtttccgccacgacaaaagaaagggggacagcccgtcaggaccgtccccctctgtctgcgtcatgccgtcgtctgtcaggcgatcgtgctcttcaggaaggtgagggtgcggtcatcggccttcagcgccgcgtcctgcacgaaattggcaccgcccgggcgggcgaaggcgtggttgcagccctcatagacatgcagctccaccttcgggttgtcggccagcgccgacttgatcttctcctgcgactccggcggcacgaaatcgtccttggcggccacatgcatcagcagcttgccgccgatcgacgtcgcctcgcccagattgtcgtccagcgctacgccgtaatagctgaccgccgcatcgatattggtgcgggccgcggtcaggaaggccaggcggccgcccaggcaccagccgatggcgcccaccttgccggtgctgctctggccgcggatatagtccaccgtcgcggcgatgtcgtcgacgcccttgtccgcgtcaaagccctggaacagctggaaggccttctgccagtcggcctcgctctgatcggtgatcatcacgcccggctcctgccgccagaacaggtcggggacgatgacggtgaagcccttggcggcgaagcagtccgcctgatagcgcatcaggtgattgacgccgaaaatctcctgaatcagaaccagcgccgggccgctgccgccctgcgccgtcgccagatatgcgtcaaacgtaccgccgtccctggcggtgatctgcaccatgctgcccactgttcggcccctttgcttgtctggtcgggatgcggaatgaacggcccggcgccaggtttccgtggggcgcagcccgctttccggtgtgcggaacacgaggcgtcacagaagccgcggctgccgttccggcgtccgggcccgctcaaggtgaagcagaaaccgtttggtgtcaacgccaccccgcgcagagaaacctccgattgaatgtccaccccccaccacccggtggcaggggatgacgatcgggatcggattggcgccacaggccccgcccacggcgcgggccaccgaccccacccggcgggccatgtcgccataggtttccgtctcaccatatggaatctccagcatcgcggtccagaccgcgcgcctgaattccgtgccggcgggggcgagcggcagatcgaatcggtccagttcacccgcgaaataccgccggagctgggcctcggtctcgtccagaatccgggccgtctgcgagccggcctcggcggccagcatggcctctgcaacatcggccgggtcgatccagtccagcgccagcagcgcctcgccgtcggcggccaggcggatcggccccagcggggtgtcggccatcagccgcgttgcggcggcgcgggggccggtcgtgcgcaggatggcgtcgcggatgcgggcacccggctgcgtggatgtcatgatcggacaggctccggagcaagggcggcggccagtgccgcggggtcgtgcagcggcagcccgcagcgcgggccccggcaatgataggccgtgggccgcccgtctgccatgcccttgccatgggagggatggccggcgggcaggggggtaccgggctcgatccggcgcagatcgagcaggggcctgccgctggccgcagccgccctgagcagcgcgcgggtcgcctcgtcgccggcggggcccaccaccaccacctggtccgcggtctcgagcagcagggccgcgaccatcaacgatgccaccccgaaggggttgccgtcgacctcggcgccgaaggccgcgatggtcgcgcgggccgcctcggcataggcggggttgccggtggcgagcgccagccgcgccagggcctgcgccatcagcccgttgcccgagggctgggcggcatcggtgccggggcggctgcgcaccggcagcacctcggcatcgtctgcggtcatgtgccagccgccgccctcggccatgtgatgccgcatcaccacctccgcccagccttccgcccgggccaggcgtgccgtgccgccctctgcctggtccagcgccagtgccgccaggatcatagcggcgtgatcgtccagcagccccggccagaccagccggccgtcccgcgccgcatggcccagacggccgttgcggtcatggctcgccagcacagcgtcgaaggcgcgggcggcccgggccacctggtccggccggtcgaagatcataccggcttcggcgaggcccgcgatcatcagcccgttccagtcggccagcaccttgtcgtcgcggcccggatggctgcgcgaccagcgccggtcgtgcagccgtgccgccatcgcctcaagccgcgcctcgtcctctccgctcagcgggtcgggatgggccagccggttggggatggcgcggccctcgaaattgccgcccggccggatgtcgtagacccggccgaagagggcggcatcgtccgcgcccagaaccgccgcgatctcttcggccgtccagaggtaatagaggccttcttcgccctcgctgtcggcatccaggctgctggcgaaggcgccgtcacctgtctccatctcgcgcgccagccaggccatgatcccctgggcggcctgcgcgaagaccgcggcatggggtgcgctgccggcccgggtccaggcgcgggcgtaaagcggcagcagctgggcgttgtcgatcagcatcttctcgaaatgggggaccagccagtcggcatcgaccgaatagcgggcgaagccgccgcccagatggtcatgaatgccgcccgcagccatgcggcgcagcgtccggtccagggccgcacgggcggcgtccgtcccagtctctcgcccgatagccgggccgcccgggctcgccagggcgtcgaacagggccagcagcggcgggttcgggaatttgggcgcgccgcgcacgccgccgcgctccatgtcgaacaccccggcgatccgggcggccgcgccggccacggtatcggccgatggcacgggccccggacggcgggccgcgagccggcccacacgggcaccgatcgccgacgcgttgtggcggacgtcttccgcctgatcgtgatatattgtcgcgatctgctcgagcatgtcgcggaaggcgggaagaccgtggcgaggttcgggcgggaaataggtgccgccccagaagggcgcaccatcgggcgtgaggaacatggtgagtggccagccccccggctggccgagagcctgaagagcggccatgtatacgtcgtcgacatcgggtcgttcttcgcgatcgaccttcacgttgacgaacagccggttcataacggcggcggtctcggggttctcgaagctctcatgggccatcacatggcaccaatggcaggcggcgtagccgatcgacagcaggatcggccggttctccgccctggcgcgcgcgaaggcctccgggccccagggcagccagtctaccggattgtccttatgctgaaggaggtacgggctgacttccctgtggagtgagtttccggacatcttttaaacccgagagtgtgttggcgcttgcaatcggtgcggggatcgcggactgtccagggtacgtggcgtcagtggcgaccatcggcaagcgcagacgagccaaagcaaagatcagggaatctgcccgatgaagatctccatcgacctcgattgcacccccgaagaggcccgccgcgccgttggcctcccggatctgacgccgctgcacaacatgttcctgaccgagatgcagaagcagatggctcaggccatgaagaccatggatggcgacaacatcatccggagctggatgccgggcgggcagggttgggaccagatgcagaaattctggtcggggctcgccaccgccggcaccaccgggggcgtgaagaaggacggctgaggtgagtgtggtccgcaacgatccgccgctctattacgagcggcacatcttcgtgtgcaccaacgagcggcccgagggccatccccgcggctgctgcgaggccggcggggcaacgaagctgcgcaactacatgaaggcccgcgccaaggagatggggctcaagggcgtgcgggtgaacaattccggctgtctggaccgctgcgaactgggcccgacgctggtgatctatcccgaaggcgtctggtacggctatcgcagcaccgacgatatcgacgagatcctgaccacccatgtcgccgaaggcggccgggtcgatcggctgatgctgaagccgggcgatgacgagatcgccaaggccgacatcgccgagcggcgcgccgccgaaaaggccgcccgtgcggcggcgagcggcggctgacggtcccggccgttcggcctgctgaccatacggcccgctccgactgttcgggccgctgttcatgcagggccatcgggctatgatgggccggcatcccgaaggacgggatgccggcctttcttgtcctgcgcctgcctgatcggaccctgaattcccatgacgacatcggcgacctcgcgcccccggaccatcttcgcccgggcgaccccgcccggccgtggtgccgtggcgatcatccgcctgtccggccccgacaccgatgctgcgctggtggcactgacgcccgggcgcgcgctgcccgaaccccgcctggccagcctccgccggatcgccgatccggtttcgggccgggtgatcgacgaggcgctggtgctgcgcttcaccgcccccgccagctataccggcgaggacgcggccgagctgcagctgcatggcggcccggcggtggtggcggcggtgatcgaggtgctgggccggctgccgggtctgcgtccggcggaggcgggggagttcacccgccgggcggtgctctccggccggatggatctgaccgcggccgaagccgtcgccgatctgatcgccgccgataccgccggccaggcggcgcaggccctggcccagctgggcggtcggctggggcggcaggtggaggagtggcgggcgcgtctgatccgcgccgccgccatgatcgaagccgagatcgacttccccgacgaagaggtgcccgacggcatcgccctgacggtggcacccgagcttgaggcgatcgcgaccgagtttcgtgcctgtctggccgatggccgatcgggggagcggctgcgcgaaggcgtggtcgtggccgtggtcggtcgccccaatgccggcaagtcgagcctggtgaatgcgctggccggccgcgagatcgcgatcgtgaccgatcgccccggcaccacccgcgatgcgatcgaggtggcgctcgacctcgacggggtggcgctgaccctgatcgataccgccggactgcgtgataccgacgacccggtcgagcaggagggtgtgcgtcgcgcccgggcccgggcggccgaggcggatctgcgcctggtggtgatcgatcccgagaccaccgatccggccgaagcgatggccgaagcaggggtgctgccgggcgatccgatcgtcttcacccgccgggaccgtctggcgggcgatgccgccgaccggcttcgagcagagatgggcggggaccatccgatggtgctggtctcctgcgtcaccggcgccggcatgggcgatctggccgccgctctggccgggcttgccgccgggctcaccggcggcggggaaggggcgatgatcacccgggcccgccaccgggcggcgctcgatcaggcggcggtggcgctcgatgccgctgcggccgggctcacccatccgctgccgatgctggagctggtggccgaagacctccgccgggcctgcgatgcgctgggccggatcaccggccggatcgatgtcgaacaccttctggatgcgatcttccgtgagttctgcatcgggaaatgatatctgaagggcgagcccgcgcggtatccgccccttcagaccatgtctgaactgccccggcttttcgtgtgtggcacagggggttggcggcggatgttccacgtgaaacgcgcggtaccgccggcgggtcccaggcccgcccgccattaccagcccgcccgccatcatccgaccacctcacccgacgaccagacgagaccacgatgcccagcgatctgccccgttccatcccggccacgccagaggccgtcgtcgatccgtcggcggtcgatgtcatcgtcatcggcggcggccatgccggtgtggaggcggctgccgccgcggcgcgggtgggggcgcggaccgtcctcgtcacccatgcctttgcgaccatcggcgccatgtcgtgcaatccggcaatcggtggcatcggcaagggtacgctggtgcgagaggtcgatgccctcgacgggctgatggcccgggcgatcgatcggtcgggcatccagttccgggtgctgaatgccagccgcggccctgcggtccacgggccgcgcgcccaggccgatcgtcggctctatgccgcggcgatgcaggacctcgtcgccggcaccgccgggctccgcgtcgtcgaaggcgcggtcgatgatctgatcgtggcggaggagggtacgggcccgcgggtcgccggtgtggtgctggccgatggccgccggatccgggcggctgcagtggtgctgaccaccggcaccttcctgcgcggcatgatccatatcggcgatcagcgcatccccgccggccgggtgggggaggcgccggccgcggcgctcggggcgcgtctcgaagccctgggcctgccgatgggtcggctgaagaccggtacgccgccccggctcgacggccggaccatcgattgggctgcgctggcggagcagcatggcgacacgccgcccaagccgttctcggtgctgaccgaccggatcaccgtgccgcagatcgcctgccatatcaccgcaaccacgccggcggcccatcaggtgattcgcgatcatctgcacgagagtgctgtctattccggccgcatcgccggccgcggcccccgctactgcccgtcgatcgaagacaaggtcgtgcgcttcgccgaccgcgacagccatcagattttccttgagcccgaggggctggacgatcacaccgtctatcccaacggcatctccaccagcctgtcggccgaggcccaggcccggatgctccgccatatcccggggctggagcgggtgtcgatcatccgccccggctatgccatcgaatatgatttcgtcgacccgcggtcgctgctgccgacgctggagagtcgggtgatgcccgggctttacatggccggtcagatcaacggcaccaccggctatgaagaggcggcggcgcagggggtgctggccggcgccaatgccgcgctggcggcgggtgaggcggggggcgatcgtcgccaggggacccggctgttgcccgatcgcggccgctcgctcaccggtgtgatgatcgacgacctcaccacccgtggcgccgacgagccctatcgcatgttcacctcgcgcgccgaataccggctgctgctcagggcagacaatgccgatctgcggctgaccgccgaggcgatggccctgggcttggtgggggccgaacgccgtgtcgcccacgaggccaagctggccgccctcgacgaggcccgcgggctggctcgcagcctgaccctcacccccgaacaggcccgcagtcacggcatccccgccaaccgcgacggccggccgcgcacgctgcaccagctgctggtgcatgccgaggcgacccgtcccgtgatgaccgcgatctggcccgagctggctcggatccgggccgatgtctacgagcagatcgagatcgaggcccgttatgacggctatctcggccggcaggaggcggatgtctcggcctggcgccgggaaggcgggctcgccattcccgatgggttcgattatggccgggtcggcggcctgtcggccgagatgcaggaaaagctgaaccgcagccgcccggcgaccatcgccgccgcccaggcgatccccggggtcaccccggcggcgctcagcctggtgatcggcgccatccggcgcggcgcggcactggcggcggaatagggcagatggcacgcaagcccgatcccccccgcttcagccccaggccgccggctcagccgcgcctggccgagccggccggccccgccggcgccgaccacgacatcatccggccgcggatcgatgcgctgctcgccggggttccacgtgaaaccctcgaccggctggagatttacgccgaaaggctcatccgctggcaaggggcgatcaatctggtgggccccgcgaccctgcccgaactgtggcggcggcacatgctcgattcggcccagcttctgccgctgatcggcccggcagcgggtcggcgtctggtcgatctgggctccggcgcgggctttcccgggctggtgttggcggcgctgaccgatctcgacgttcatctggtcgaaagcgacacccgcaaggcgatcttcctgcgggagaccgcccgggcgatgggcatcatcgtcaccgtccatgccgaacggatcgaacgcctgcaagccctgggcgccgacctggtctccgcccgcgcgctcgccccattggacaagcttcttgagatggccattccgcttgcccgcccggatgccgtattctggttcctgaaaggcgcccaggccgaggccgagattgcagccgcccgcacccgctggacaatgcaggtggtatgccatagaagtatgaccgacgagggtggcgtcatccttgaagcgaaggggctgtctcgtgtccaagaccgtgaccaatcccgctgatgcggcgcctcagggcaccggtcgcgtgctggccatcgcaaaccagaagggcggcgtcggtaagaccacgaccgcgatcaacctggcgactgcgctggctgcggcgcgcaagcgggttctggtgatcgatctcgatccgcagggcaatgcatcgaccgggctgggcatcaatgccggccagcgggatccgtcgagctatgatgtgctgatgggcgaggcgagccttgccgaggcgatcgtcgaaaccgatgtgcccgggctggcggtggtgccggcggtggtcgatctgaccggcgccgaaatcgagctgatcgagcgcccggcccgcgagcgccggctgcgcatggcgctgggtgccgagggactaccgcagtacgactacatcttcatcgactgcccgccctcgctcggcattctgaccctgaattccctggtcgccgccgatgcggtgctggtgccgctgcagtgtgagttcttcgccctggaaggtgtcagccagttggtgcggacggtcgaccgggtgcgtcgctcgctcaacccgcggctcgacatccagggcgtggtgctgaccatgttcgacaaccgcaacaacctgtccaaccaggtcgcagcggatgtgcgcaacttcttcggcgacaaggtctacaagaccgtgatcccgcgcaatgtccgcgtgtcggaagcgcccagccatggcaagccggtgctgctctatgatcaccgctgcgccggggcgaaagcctatatccatctggcaggtgaagtgctgaagcgcgaacggggggtggccgcgtgagtgcggaagagaccggcggccgcaagcgcggcctggcgcgtggcctgtctgcgctgctcggggatacggcgatcgaggatgcggcccctgcggccgcaacggccgacgtccggatgatgccggtcgagcgactgcgtcccggccgctatcagccccgccggcatttcgacgaagaggccctgtcgcagctggccgccagcctgcgcgaacgtggcgtggtccagccgatcctggtccgtccggtcgatgacggcggtttcgagatcgtcgccggcgaacggcgctggcgggcggcgcagcttgcccggctgcacgaggttccggtcatcgtccgccatatggcggatcatgatgcgctggagatcgccctggtcgagaacatccagcgccaggatctgacgccgctggaagaggccgacggctatcgccggctgatgggcgagttctcctatacccaggaagaactcggccgggtgatcggcaagagccgcgcccatgtcgccaacatgctccgcctgctgaacctgcccgatgcggtcaaggagatgctcgacgacggccggctgtccatggggcatgcccgggcgatcgccactgccgacgacccctcggccctggcgaagcgcatcgtcgatcgcgggctgacggtgcgtgaggccgagaccctcgcccggggcgaggccgagaagcgggctaatcgggagggcgcacagcgcaagcccgtgggcggccggccgcgccgtgccgatgccgccggcagctcggccaaggacagcgacacactgcgcctggaagaggatctgagcgagagcctgggcctgaaggtctcgatcaaccccatctcgccgacggcgggatcgatgaccattgcctatggctcgctcgaagatctcgacgacctgctggcccggttgggcgggcgcggctgacaccccgatcgcggaccgatttccggtcaaaaattatcgattgtggaggcgggttttcaggcctcagcggcggcgtttacgctgcccggcttcggcggcaatacccagcaatgcctggccgaccagggtctcctggggcagtccctgcttggcccgcgcctcggcatcggccagccggcccagggcccgggcgagcgctgcggtcggccacaccgccagggcggccctgaaactgccggtctgcttgaagaacaccggaggcttcagcgatttcatcgccgcatccggatccataccggcatcgatgtcggcgcgggcctgaagcagccggccgaaatggcgggaaacggcgcgcagcagggcgatggcggaggtgccttcggcaaaggcgcggtcgagcgcctggtccagcgccgcggcatcgccgccggccgccgccagcgccacatcgtccagcgccacggtccgggcatcgccgatcaccgcttcgacatcctcgagcgtgacccggccgcggccatgggcgtagagggccagtttgtccagctccatccgggtcatcgcccggtcggcccccagagagccggccagcgccatcagcgcatcggcatcggcctgaagccctgcttccgacaggtgattgcggatcacctcggccagatcacggccttcatcggcatagcaggcgatggcggccgcattggtggcggtttcgaacagtttgcgaagcttggatcccggtcccaactcgccgccgtcgaccacgatcagcgcatcgccggccggatcgcccagaaaaccggccagcgccagcgcctgggcatcgccgatatccctgaggcggaccacccgccggccgccgccgaaggcgatggcggccgcttcgtccgccagccgggccggatcatccgacagggtcttgccgtcgagggtggcgatccggaacggatcggtggggtccggcacgaccgcacgcaccagccggtcggcccgttccttcaccagcccgcgatcgggaccatagaccagaaccgcccgccaggcggcatcgggccggctgcttttggtgtccgcatcacggggggcgaccttcaccatccgctcgccgccgccttaaacctcgccatgctggtcgaaatagatcgacagccgggtatggacctcgcgcgcggcttccttcagcgcgcgttcgatcgcatcctgccgcgataccagcgtcgcatagggggcagagatctggtcatagccgttgatctgggtgaccgtgccgtcggccagcagcctgtcggcgttgttctcgcccgcatggggcgccatcaggcgatagctcaccacgatccgcacattgtagcggctggcggtggcgtcttcgttgatggcaagcccggtctcggtgatcttgatggcgctatccagccggtagcgcccgggatgaccgcggccctccccggcaagcaggcgttccaggctgttccggtagatctggccagcccggtcgggcaccggtccgaccgccaccgcggccagctgttcggtgaccgcggggcggttggcggcggtgtcgccatagagcggccggaagccgcaggccgacagcgtcagcgccgccgcggccatggccgccgccagcaccagccgccggctgcggcggctggcgggcccggtcgggctgatgcgatcagccgatgaggttgagaatgcggttcgggacatagatcaccttccgcggggtgcggccgtcgagagcggtcttgaccttgtggtcggcgagggcacgttccacagccgcatcctgatccagatccggcgcgacatccagcttgctgcgcaccttgccgttgacctgcaccggcagggtgatggtgtccaccgtcaccagcgtcgggtcgaaatcgggccagggctgttcggccagcaggccgtcatggccggccatccgccacagctcctcgcccagatgtggggtcatcggtccgatcaaccggatgatggcatccaccgcctcgcgggcgacggcggcatcggcgggcgaagccggggtgaagtcgaacagcgcgttcgaaagctcgcgcagccgcgccacacccttgttgaagtggaagcgctccagatcttccgacaggtcgcggatcgtccggtgcagcttgcggcggatctccagcgccgcgccctcggccgccgccaggtcagcgccgatatcggtgccgggggcgggcagggcggccgcccactcatcgaccagccggtacagccgtgccagataacgatgggcaccttcggcgccggcatcggtccattccagatcgcgttccggtgggctgtcggagagcatgaacagccgcgcggtatcggcgccataggcctcgatgatcgccatcgggtcgacgacgttgcgcttggacttgctcatcttctcgatgcggccgcgggtaacgggtcggccggtttccacatggaccagctggccgtcggcgtctttggtcacctcttcggggaagacccagcggccctgatcgtccttgtaggtctcgtgcaccaccatgccctgggtcagcagcccggcgaagggctctttcacgtccagcagcccgacctcgcgcatggcgcgggtgaagaagcgggaatagagcaggtgcagcacggcatgttcgatgccgccgatatactggtccaccggcatccacttgtcggccgcttcgcgcgggaagggccggtcggtggtcaggccggtatagcgggcgaaataccagctgctctcgaagaaggtatcgaaggtgtcggtctcgcgccgggcgggcctgccgcagctcgggcaatcgacatgcgcccagctggggtggcggtccagcgggttgccctggccgtcgaacaccacatcctcgggcagggtgaccggcagctggtcttccggcaccggcaccacgccgcaatccgggcagtggatcaccgggatcgggcagccccaatagcgctggcgcgacacgccccagtcgcgcaggcggaaggtggtctcacccttgccgatgccgatcttctcaagctcttcgatcgcgcggcgcttggcatccgcgaccgacagcccgtccaggaagcccgaattgacgatcacgccgtcgccggtcagcgcttcgctgccgatctccagcggggacgcgtcgtccaggcctgccggccggactaccggcttcaccggcaggtcgtatttgcgggcgaaatccaggtcgcgctggtcatgcgccgggcagccgaagatcgcgcccgagccgtattccatcagcacgaaattcgccacatagaccggcagcttcagccccggcacgaagggatgttcggcatcgaccggcagccggtagcccttcttctcggccttctccagcacctcttcgctggtgccggtgcggttgcactcttcgatgaaggcggcaagctcggggtcggatgccgccagcgcctcggccagcgggtggttgggggcgatgccgcagaaggcggcgccgaacagcgtatcggggcgggtggtgaagacctccagcccgtccagcccctcgggcgcgccctcaaggcggaagctcaaccgggcaccttcggaacggccgatccagcgctcctgcatggtcttcacccggtcgggccagcggtccagcgtcgacaggctgtccagcagatcgtcgccgaaggcggtgatcttcaggaaccactgcgacagcttgcgccgttccaccagggcgcccgagcgccagccgcggccctcgatcacctgttcattggccagcaccgtctggtcgacggggtcccagttgacccagctttccttgcgataagcgaggccggcttccaggaacttcaggaacatgcgctgctcgtggacgtaataatccggcgcgcaggtgaagatctcccggttccagtcataggacaggcccatcgacttcagctggccacgcatggccgcgatgttgtcgtaggtccatttgcccggatggatgccgcgctcgatggcggcgttctcggccggcatgccgaaggcgtcccagcccatcggatgcagcacgttataccccttggcgcggcggtagcgtgccgtcacgtcccccagcgtataaacgcggacatggccgatatggatgcggccggaggggtaggggaacatctcgagcacatagtatttcggcttcgacgacgcttcatcggtcgtgaaggtgccgttctcgtcccacacctgctgccacttgggctcgatcgccttggggttgtagcgggccatttttccggtacgaagtgcggatgaccgcaaccggcaccgctccctgttgtcagggggcatgccgctgccggtcacccggtttgagacgatggcggcagggctggccccgtcgccggacttgtgacgccgtcagctggccgtgcttgaaacgcgcagctggcgggcgcgggtgaggatggcgtcctcgatacgggtcgcgaccgcgggctcgacgggcacgtcgacccaggtgccggcctcgtcgcggcgctgcttgaaggcggccacgcggatgccgtcggcccggagctggcggtcgaggatatagacggtgagcttcatccgctcacccggcgtctcgggggcgctgtaccagtcggtgatcagcacgccgccgaagggatctgcggaggccagcggcatgaagctgatggtgtcgagcgaggcccgccacaggaagctgttcacgccgatcggcgaggcgccgccggtgccgtcgcggctcttctcgttatcgaagatgttgagaccgccgtcgccgaagatggtctggcgctgggtctcgtaggtgccgccggttccgccggggatcgagcgcggatagctggcttcggtctccacgccgctgcagcccgcgagcagcgcgagcgcgcctgcgagcgtcgcgtaccgcaacagatccttgcccgtgactgccatggccgttccaaacctctctggctattgtccgacgtggtcccgccggcgttgtctctggtcccgacagggcgtcgccgaaatctgtccgagagaggcatttgcgctccgtcggatggcttcggtcggctgaactatatggcaagccgcttcctgcctcaaccgaagccgataacaggtcgtccgcgggcccgtgggggcccccgcggacgggggagggggcccatgacccccctgtgtcatccctgttgcaatcctgctacattgtgacggaaatcactgaccggccctgttgcgctgcgttgacggcgcgtgcgctgcagaagaacatgaacttgccgcatgggcgaattccccgcacgcccggcgtccgggagacggccaagaccgtcaaccgcgaagagcttccggccagcatcaggccaatgaccaccaggtcggaacccgaagcgggccggccgatcagactgcatcccggacgtcccggcacccggccggactgaagattctgaacgttctcaccaggggacccgacccgatgaagaagatcctgctcggcagcactgccatcgtcgccgctgccgccgcttttgccgctcccgcttcggcggccgagaagatcaagcttggcctcggcggctattatcagagcgtcttcgtgctgatcgacgaagatgtggcggacactcgcaccgacagcatgaagcaggaaggtgagatccacttcctcggtgagaccacgctcgacaacggcgtgaccgtcggcgtgaacgtgcagctcgagggctataccaccgacgaccagatcgacgagcacttcgtctatttcgagggcggcttcggtcgcgtgcagctgggcgccgccgactcggccgcctatctgatgcactattcggccccgaccgccatcgccggccatggcgtcgacagcccgaacttcttccatgcctcgcagcccggcaccaacgtgctggcgtcgaactacaccttcctgaacaccaccggcgacgccaacaagctgacctacttcaccccgcgcttctcgggcttccagctgggtctgtcgtacacgcccagcctcgcggccggcacgggcggctcgtcgaactcctatggcaacctgccggacaacactccgggccagcaggagaagatcgtcgagatcggtgccaactacgtgaacagcttcggcggcatcgacgtcgccttcgcggtgggctacctgacgggccagcaggaagtcgatgcggcaggcttcgatgatcaggaagccttcacggtgggtgcgcagctgggctatgccggcttcaccttcggcggtggctaccagaagaacaatatgggcctgcagctcgaagacgacatggagcagtggaatgtggggctgacctacggcttcggcccctacaccgtcggcgcgggctatggctatggcagccagaccagcggtgccggcgtgaaggacgagctgtccactctggagatcggtggcacctacgagatgggtccgggcgtcagcctgatggccggctacttccgctacgatttcgactcggacctggcggcgaaccggaacacctcggacgccttcatggtcggtacctcgctcgagttctgatcgggcagtcgtgggcgccgcggtttccgcggcgtccacccctcacataaccgtctgacggctgatccggccctgcccggagttgttgcttcacagccacagtgtggcgggaagcgcgacggcaggggtgcacctcgcttgaccaccgcatgcgcgggatggaacatggcgacgcacagcgcttcggatacggcttcgacggcaccctatttacgggtcgtatcacctggcgctcgatgccgcgccgggctttttgtgttggtctgatggcagttcgccagatggccggcctcaagcctggctccaccggttctaggggaactgaccgatgaagaagattctgcttggcacgtcggccatcgttgccgccggcctgctcgccgcgccggcgtcggccgctgagaagatcaagctgggcctgggtggctactaccagagcgccttcgtcctgatcgacgaggacgtggagaacacccgcaccgacaatatgaagcaggaaggcgagatccacttcctgggtgagaccacgctcgacaacggcatcaaggttggtgtcaacgtccagctcgaggcctacaccacctcggatcaggtcgacgagcactatgtctacttcgagggtggcttcggtcgcgtcgtcctcggcgccgagaactcggctccgtacctgatgcactactcggccccgtcggccgtggtgggtcatggcgtcgacagcccgaacttcttccatgccagccgtccgggcaccgctgctctggggtcgaacgcgaccttcctgaacgcgaccagcgacgccaacaagctgacctacttcaccccgcgcttctcgggcttccagctcggcctgtcgtacaccccgagcctcgcgggtggccgcggcggttcgtcgggcgcctatggcaacctgagcgacaacgtcgtcggccgccaggagcagctggtcgaggttggcctgaactacgtcaacaccttcggtgccgtgaacttcgcggcgtctgccggctacaccggtggctcgctcgaagctgacggtgccggcttcgacgatctcgaggcctggagcctgggtgcgaatgtcggttatgccggcttcaccttcggtggtgcctacatgaccagcaaccagggcctcgagctgaacgacgacctggagcagtggaacgtcggcctgacctacggcttcggcccctacaaggttggtgttgcctacgcctatggcagccagagcaatggcagtgtcatcgcggcgaccgccaacgacaaggacgagctgcagatgctcgaggtcggtggtacctacgccctgggcccgggtgtcaacctgatggctggctactactacatcgacttcgactcggatatcgcggccaaccgcaacgaggcgaatgcgttcatgatcggtaccgccctgtcgttctgatcgaccaggcaagccgattggccgggtcaccggccggacgtgaaagaggggatgggcttcggcccgtccccttttttcttgtccgcatgttcctgcggagatggcctgagatggttgcgctgcacacccgggaaggaccgcaggatcccgcggaatccggcacggaatgccgcgctgcaacggtataccgttcgcgcctgcgccatgtggcattggtgacacagtgcgcgtcaaccgacacagcggcgatcccggtttcttgacgaccctcgccggcccgcgtttatttggtgcgtctcatgtgacgatgatcacgaaaaccccgggagcgggtgacgaagatcacgtccgtcaagcatcagccttcgggagcacgggccccgtcggtgtatcgttcgggcaacagacccgggcgacctcgatcgagagtgagggagagcatgaagaagattctcatcggcaccacggcgctcgtcgccgtcggcctcgtcgccggccaggcttcggcggcggagaagatcaagctgggtctgggcggctactatcagtcgttcttcaagatcaccgaccaggacgaggtcaacggcgtcgagtaccgctccgacgagatggttcaggaaggcgaaatccacttcctgggtgagaccgtcctcgacaacggcctgaaggtcggtgtgcaggtgcagctcgagggctacaccaccggcgaccagatcgacgagcactatgtctacttcgacggctcgtggggccgcgtgctgctgggcgccgagaactcggccccgtatctgatgcactatgccgcgccgtcggcgatcgccggtcacggcgtgtcgtcgccgaacttcttcaacttctcgaccggcaccaaccttgccggccgcgtcgggcaggctccgagcaccctgatcaacaacacctcggacgccaacaagctgacctacttcaccccgcgcatggccggcttccagctcggtctgtcgtacaccccgagcctggccggcggcaccggcggttcgtcgggctcgtacggcaacctgactgacaacgtcccgggccgtcaggagcagatcgtcgaagtcggtctgaactacgtcaacaagctgggcccggtcgatctggccgtgtccggtggctacctcaagggcagcctcgaggctgatgcggtcggcgctgacgacctgcaggtctggagcctgggcctgaatgtcggcttctcgggcttcaccttcggtggttcgtatatcaacgacaaccgcggcctcgacggcaacaacgacatcaagggctgggacgtcggcctggtctatgccttcggcccgtacaaggtcggcgccgcctatgccaacagccagcgtgaatttgacggtggccgtggcgacgacgagctgaagatgtacgagatcggtggtcagtacgccatgggcccgggcatcagcctgaatgccggcgtgcagttcctcgatgccgacagcgacctggcctcgggtcgtcaggatggcacctcgttcctgatcggtaccgctctcagcttctgatcggtgtcgctcgggcggccttcgggccggatgagacgggaagggcgggtcttcggacccgcccttttccgtgtgcatcctgtgcttcgggcgcggctttcttttgtccggcgcggttttcggctatggattggggctcgatgcccggccggcacggtctgccggcagccttcaagggagtcccgccgtcatgggtgcgattatctggctcgcttcctatccgaaatcgggcaatacctggacgcgggcgttcctgcacaacctgctgcgtgacgccaaggccccggtccatcccgatcgttttgccgatttctgcctgggcgagagcaagcccgaatggtatctgcgctatctggacaagcccctgtcgcaggcgaccgagcaggagatcatgaagatccgtccgctggtccatcgtgacatgacgcaggccttccccgacaacgtcttcgccaagacccacaacatcctggcggagcgcggcggctatccgctgatcagcctgaaccacaccgccggcgccatctatatcgtgcgcaatccgctggatgtggtctcgtccgtggccgaccatttcggtctcgatatcgacggggcgatcggcatgatggcgaccgagggtgccgtcaccgccaatgacgaccgcaacgtcttcgaggtgctgagcacctggtccctgcatgtgaagagctggacccaggtggcgagcccgggcctgcatgtcatgcgctatgaagacatgaccgaccggccgctgcagaccttccgcaagctgaccgatttcctggggctgaaacccccgcgggagcggctggaacgggcgatccgcttctcctccttcaagattctgaagcagatggaggagcgtcacggcttccgcgagcgctcggtcaattccaaggccttcttccgctccggcagtgccggcaaatggcgggaacggctgacgcccgatcagatccgccggatcatcgccgatcatcacgaacagatggcgcggttcggctacattcccgcagattatgccgatgcggttcccggtgcggccctgccgcagccggcagtcgctaccggcgaggggcccagatgagcgagcagcgcgccaggcgtttcgcattgtccaccgcgctcggcttcggcaagcgcggctatttcatcccttaccgctatgccgaacaggtggaagcggtgaagcccaaggggccgcatccggcggccgaggcgctgtttcaggcgatggagccggtcttcggcgcggtactggatgccgcggccgattatcgcgacgatctggcccggctggccggggcccggccgccggcgccgcgctggtcgcaggactggttcccgcgtctggatgcgctggccgcctataccatggtgcgtgcggcccggccgcggcggatcatcgagatcgggtccggccattccacccgcttcatcgcccaggcgctgaaggatgacggccacggtgccgagatgaccgcgatcgaccccgaaccccgggccgcgatcgacgagctgggcatccggctgatccgcaagccgatgcagagcgtgccgctgaaggaattcgcggcgcttgaggccggcgacatgctggtcgtggacagcagccatatcctgatgccgggcagcgatgtcgacgtggtgctgaaccgcatcctgccgatgctgcccaagggcgtgctggtccatttccatgacatcttcctgcccgacggctatccgcagagctgggcctggcgtggctataacgagcagccggcggtcgccgccctgctgttcaccggcggctataagccgctcttcgccagccgctatgtcgcaacccggatgaccgggcgggtgcagaacggcattgccggcgggctgccgctgctggaaggcgcctatgaatccagcctctggctggaaaagctggtcgatgcggcggtggcgccgccggattgagatgcggctggggtgaaggcgtcgatggcggcaaagcccgcaaggttgcggcagggatgcagctgccgcaaccggctgcggtccatgccgcccagcgccaccaccggccggtcggtcaggcgggccagcgcccgaaagcggagcggccccaggaccctggccccaggatggctgcgggtcggcagcacgggggagatcagcagcagttttgcgccccgccgcctggctcggacaagatcccggcggtcatggacggcggcgctggccggcaacaggcgcggcaggcggcggatttcgggccggcgcagccggtggccgggcaggtgctgcccgtcggcgtccagtgcaagggccaggctgcgatcgcccgcgaccagcagcccgatgccccgcgcccgggtcagccgtcgccacagcaggccgagagccggccggtcgggggcgtcgtagtcacggaagatcaccagatcgccgcgcttaaggccagcgagcagggcggggcggggcggcccttgccggttccggtcggtgatcagcaccgcgatcccgcgcgggtcccgccgctgagagttgagaagcccgccgcctcggctatgatggcgccccatatcgcatctgcccgatccgaagggtggaggcggggtgctgccccgccggtgatccgttccgagggagcccgagccccatgaccgacgtcaaggcaaacctcgcccaggtccgggcggagatcgaccgcgccgcccatgatgccggccgcgaccccgcggcggtgaccctggtggcggtctccaaaacccatgacgcgccggccatcctgccggcgatcgaggccggccagcgggtttttggggaaaaccgggtgcaggaagccgccggcaaatggccggccctgcgcgagcgtttccccgatctggaactgcacctgatcggtccgctgcagaccaacaagctgcgcgaggcgctggcgctgttcgatgtcatccagagcgtcgaccgcccgaagcttgcccggatgctggccgaagaaggggccagggccggccggctgccccggctgctggtgcaggtgaacacgggtgaagagccgcagaaggcgggcgtgctgcccgccgatctggatgggtttctgcgggaatgccgtgaggatctggggctcaccgtcgacgggctgatgtgcatcccgccggtcgacgaccagccggcaccgcatttcgccctgctggccgacatggcggcggcccatggtcttaagctgctcagcatggggatgagcggcgactaccccatggccatccgcctgggcgccacccatgtccgcgtcggcaccgccatcttcgggcatcgcgactattctgcccctctggcggggtgatcctctagaatctcgcgctgatggtcagggtgtcgccggggccggcatccgccagcacccgcaccagatcttccatcgccagggccacgcagccttcggtgccggagaaatccggacgagcgacatgcagaaagatggcgctgccacgccccggcaccaccggggcgtcgttccagcccagcaccgcgatcaggtcgtagacatggtcgtcgcgccacagccgttcatggcgggcggggaagggcaggtcgacgggcttgttgtaccaggggttttccgggtcgtcgcaccagccgtcttcggggcggatcgcctggacgggcaggcgggtgcgcggcgcctcgacccggtcggcacgatagagcacccgccggatcggcagggtgccgatcggggttgccccgtcgccttcgcgtttggcgacggtgatgccgttgcggccgatggccaccggcaggcgctcgtcccgccaccagaagcggaaccgggcgagtaggggatcgtatcgaaccaacatggtctcagtctgccacggccctgtcggacccgtgaagaccagccggctgccgacgcggatttgtcacggcgctgatcgcccggcgaggggttggctacagattccgcgagaccgttgcggccttggactggccggcgcgcatctgggcctggtagcgatccagcgcctggttcatccgggcggcgaaatcgtcgagcgggatagggccggtctcaggcgccgccgcgttcatgtcctgcagctgggcggcccgggcggcatcggtcgccatgggctcgtcctgcggctcccgcgggcggggcggcgcggtgcgtgcggcataggctgcggcacccggggccgataccggcggggccggcttgcgggcggtcgggccgtcaacgcccatgaaggcggcggccgggatgatccggcccatctcggtattgccgccggcgcttccggccggcagatcggcgagcggcgtgctgccggcactgcccgccggtacgctctggcgcagcatggcctcgatctcgcgctcgctcggccggccattgcggccgcgggcgatggagaggtcgttcgccgccaggcgttcctcggccggggtggtgctgcgggtccgcggcgcccggtcggcggtggcggcgatcgaggcctgcgcccccgtggtctgcgcatccggggtcgcgccgccggccggccggttgccgttcgcggccgccggggcggcggccccgaaagcccccagcagggcggcgaactgggcctcgctcatcccctgatcgccgtcttcggccgggacatccttcgcccccaccggccggcccgccggggcggcgagcgaggcggtctgcgaggcggcgatccgcgccccgtcatcggcggcgctttccacccggcccgatgcggcatcggccgcggccagcgccgtgccgccggtgtcctcgtcctcgccgatcagagcggccagcgcccgatcgccggcggtatggcccgaggcgtccatggtggcgttttccatcatcgcgccgatggcaccgatcgggccgccgaaggcgatgccgccgatcatccgtgcaccgggcgagattgtatcgccggtcagggcccgatagaccgtccccaccaccggcagctgctgcagcgggttcacgatgtcgagcaggtcgccgaagctgaagccgtcctcgccccagaaccccaccggttccgcctgggcggtcttgtcggcagtggtgctgcggtcggcccgcgcgctgtcggtctgcgtggtgtcggtcgaagacgtgcgcgcaggttccccgccggcccaggcgggcgtgtcgtagcggtaaccgcgggaagcgtcgacgaacatggcagaaaccccgggggcgcccccgtctgccgggcagacggtctgggcgggcagtcatggcgcgcggaccggcgccgtcggggtcttaatattcaagcatcgtgccaaccgtgatccggtgcaaatcacggcgctgtcgacgaaaaaacgccgcgacgcccggctgggggcgatcgcggcgcggtccggttgtgtcggcggtgccggccggcccggcagcatttgccgggcggcagcccttgccgcgcggctacagcatgtgcccggcccggcgagccttggtcgacagatagccggcattgtggccgttggcggggaaggcatggggcacccgctccaccacctcgatgccatgggcgcccagcgcctgcaccttggccgggttgttggtcagcagccggatgcgctgatggccaagcgcccgcagcatttcggccgccgggcggaaatcgcgctcgtcggcctcaaagcccagcgccagattggcatccaccgtatccaggccgcgatcctgcaggtcataggcccgcagcttgttgatcagcccgatgccgcggccctcctgggccatgtacagcaccacgccgccgccggcggcggccatggtccggattgcccccttcagctgttcgccgcaatcgcagcgcagagagccgagcaggtcgccggtgaagcattcggaatgcagccgggccaggatcggcgcatccgccgcaggctcgcccaccacgatcgccagatgttccggcccgccgtcggatgggcggaaggcgatgatccggcaattctcggcatcggccagcggcacccgggcctcggccacacgcttcagccggccggccgcgatctggccttccttcagcagcttcgcctcgatgatgacgggatcgagcgccgaggccccgccgggtagccggcctgagggcagttcaacggacaccagcgccggcagcaggccggcccgtttggcaagcgcgatggccgcggccgaggcccgtccggccgggcgcagccggccaagagcacgttcgcgtgcggccgtgccgtcgtcgctgcgggtcgggtcggccgccagccgccaggccgggtcgctgatgtcgcggatgggtgccgccaccggctccacgccgcgcggatcatccgcctcgatcggcgcgaccagcccggccagcgccgcgcggcggcgggaaatcagcaggtcggcgggggcgccggtcaggatggcgagggcggcgaggcgatcgggcgaggcgcgttcgggagagagcgccagcacatcggcctgatcgtcgcgcagcagcacggcgccgccggcgcgcaattcggcctgggcacgctgcagtcgccgctccgtcgcctcactcatctgatcgtcctcgtcattggacctgtccgcgggggggacaccgtcggagccggatgtcgcgttcactgccggcgtgcctccatttcaaggatcagggagatctcgtcaccgacgaggtcgccgtccaggccataggtcatgccgaagtcgctgcggcgaatggtaccacgcgcagaaaccccgataacataggggcgcgtaccgaatacgccagtcccgaacggatattcggcactcttgttccacgtcacgtccagagtcatgggttttcgcacacccagcaactccagtgtgccggtgatgcgcccggtccgctcgcccgcaggctcggcgccgtccaggcggaagaccatgtcggggaattcctcggcattcaggaaatcgggcccgcgcaagtgctcgtcccgcttgtcgtgatcggtgaagacgctggcggtcttcacccggatctcgccgccgtcgagccgtttcgccgcctcgtcgaagctgatttcgccctcgacttcgcgaaaccggcccagcacgttggcatagcctgcatgcatgaccaggaagcccaccaccgcatgttcgggatccagggtgtaggtctcgggtgctgccagcgccggctgcgccgtcacgaccgaggtcgccatcagggcggggggtgccatcagggcggggagggcgagcagccctgcggcggcccaggctctgcgcatcgtcatcagggggtctcctcgcgaggggtgcggctgcggtgcagcctgatcacggccagaaggtcgacggcgaaggaccagcccagcacggcgaccgcgatcgcggccgagaccgtgccggcggtggcggagatcgggttcagcgcgccgaccagcgccgcaacaccgaaggcgcaggcggcccggcggcggttgctggggggcaggggggctttcaggggtggccaggcccaggccgccgccacccacagatagcgcagcgcccccgccgccagcacccaggggcccgcccgtcccgcatccagcgtcgcccaggacagcaccgccacgaacagcgcatccagttccatgtcgaaccgggcgccgaaggggctggctacgccgcgcctgcgggcgatccagccgtcgacgccgtccagcgccaggcagatcgccgcggtcaggaacagcatccaggcgaccggcccggcggctgcgccatgatccaccgccatcagcggctcgccgatcgtggcggcgaccagcgccaccaggcctgcgcgcagcagggtcacccggttggccgggcccactcgggcctgcggcagatgctgggccagcgcggggcccgcgatggccagtgcgaaggcgagccaggccaccgccttcagcggataggccgggcccagcgcatcgcccgcccgcgcggcggcgacgacgcctgcggccgcgaccagcccggtcgcaccgatcgcatgcagccctgcatcaagtctgagccgcgccagggcggcggcctctcgtttcctcgccatgcatcaccatatggagacggaagcgccccggttgtatggggcgttcaccgggaaagacggcggaaggtgccgaccggggccagggaggtgagccgggaaccgatccggcggccgggcatttgcgtaagttgcagtatctttacgcaaccgccacgccttcggatcgcttgtcgcctgtcgatcgtcccgaccggcacccaccgaagggcagggcaggggagaaggaccaccaggatggacatgccacccgccgatgccgtccccgccgcccgaaatccggtgacggagaacggaaccgtcaccgccggggctggttccgccgcgacccgtctgtctgcgctgcgtccccaccatcctgtcggccggccggcccggccccatcccgtgcgtctggatgcggccgtggtctgggacgggctgctggcccttgccgccgcgcccgatctgccggcgggcctggcgcttgggcccgacggccggctggtgccggcggcgacgccgcttgccgccgatgcggtgctgctggacgatcatgcggacgagcccgccatgcgctgggcgacgcggatcgagctggacccggccgccgcccggctgctcgatctctatcttccggtgctccgccctgccccggccgacaggccgcgggtctcggcccatctggcccagagcctggacggccgcatcgccaccaccagcggctgttcgcaatggctgtcgggcgaggaagaccttgtgcacgcccatcgcatgcgtgcgctttccgacgcggtgctggtcggcgccggcaccgtcgaggctgatgacccgcgcctgaccgtgcgcctggtgcccggtcccaacccggtccgggtggtgatcgatgccggcgggcggctcgaagctgaccacaaactgttcggggatggggccgcccgtaccctggttctccatgccgccgatgtccctcccccgccggcgaccgatcaggtcgagccggtggcggtgccgcgccggccctgcggcacgctggatccgcatcaggcgctgcggcagctgcgggcccgcggcatccgccggatcttcgtcgaaggcggcggggtcacggtctcgaagctcattcaggccggtgcggtcgaccggctgcagatggcgatcgcgccggtgctgctcggctcgggccggccggtgctgtgcctgcccgaaatcgatcatctcgaccaggccatccgcccgccggtccgccatttcatcatgggcgccgacattctggtcgaatgctgcctggatcttctcccgcgcagtgccggaggtcagcccggatgatgacccgcgccctctggacggtcgctcccggccgtttcgagatccgcaccggcacgcttgccaccgacaccaccggcatgatcgaagtccgcgccctgcaaagcgccgtcagccgcggcaccgaacgcctggtcgccggcggtctggtgccggaaagcgaatacgagcggatgcgtgcgccgcttcaggaaggcgacttccccttcccggtgaaatacggctacgccatggtcgggctggacccgaagggcgatcgcgtcttcgtgctccacccccatcaggaccggtttctggccccggctgccatgctccgcccggtgccagacgcggtccccaccgcccgggcggtgctggccgccaatatggaaaccgcggtcaacgtgctctgggatgccggcgccgggccgggcgaccggatcacggtggtcggcgccggcctggtcggcctgctgatcgcccgtctggcccaccggctgcccggggcggtggtcgagatcatcgaccgcgatcccggccgggcggcggcggccgcggcgctcgacctgcccttccgcgcgcccgatgccgccgcgccggatcgcgatctggtgatcaatgtcagcgcctcggccgccgggctcgatctggcgctcgatctcgccggcatggaggcgcgggtggtggaggccagctggcatggcgaccgcgagaccccgatcaatctgggccgcgccttccacgcccggcgcctgaagctgatctcgtcccaggtcggccaggtctcggccggccggcgcgcacgctggagccatgccaaccggctggacctggcgctccgcctgctcgacgatgccgcattggatgcgctggtggtcgacgaggtcgccttcgccgccgcccccgcccggctcgccacccatctctccgggccggatcccgatctgcgcggcacggtgctgcgtatcgtctattgatccacgctctctcccctctccgcccccttatctgaggatctgcacccgatgttcaccctcggcgtccgcgaccatgtgatgatcgcccacagtttccgtggcgagatcttcggcccggcccagcgtctgcatggcgcgacctatgtggtcgatgtcgaattcaagcggcgggcgctcgacgatgacgggctggtggtcgatatcggcctggcccatcaggcgctgaaggcggcgctggagccgctggcctatcgcaatctcgacgatctgccggaattcgccgggcggaacaccaccaccgaattcctggcccgccacatccatggccggatggcggcggcgatcgatgccggcgatcttggggcttctgcctccgggatcgatgcgatccggatcgtgctgcatgaaagccatgtcgcctgggccgccttcgagggcccggtcggcgatgctgctcgcgccggctgaaggctgccgccgggatgctggaccctgtcgatcttctgcttgcggtgccggggccggtcgacctcgccaccgggggctatgtctatgaccgccggatcatggcggcggccgccgggcttggggtggtcgtcgaaaccctggccctgcccggcgggccgccgccagtcgggcccccggcgctcgccatgctccgcgaccggctggccgccggtccggtgcgggcgctgctgatcgacggcctggccctgccggggctggcgccgctgctcggcgagatcacgcccgcgggcagcggcggcccgcggcggatcgcgctggtccatcacccctgtgcgctcgaaaccggtcttgcaccccaggtcgcggccgatctggccgggctggaacgcgcggcacttgcccgggtcgatgcggtggtcgccaccagtcccgccacggcggccctgctgcgcgacgagcgctggaccgatctgccggtgacggtgatcgaacccggcctctcgatcgaaccccttccccatcaggccgcccccgacggcgcgctgcgcctgctgacggtcgcgagcctcacgccccgcaaggcgcatgaggatctggtggcggcgctcggaaagatcggccgcgatcacgagtggcggctggatctcgtcggtcccgacacactggacctgccccatgccgctcgggtgcgtgcggcgatccgggccgccgggctgggcgaccggatccatctgcatggcgtgctctcgggcaccgatcttgcccggcgctatgccgcggccgatgttttcgtgctgccctcgcgctttgaaggctatggcatggccttcgccgaggccctggccgccggcctgccggttgtggccgcccgggccggcgcggtgccggagctggtgcccgacagcgccgggattctggtgccgccgggcgatgtcgatgcgctggccgaagccctgcggcggctgatggcggatgccgggcttcgcgggcggcttgcccgggccgcggcagaggccggcgcccgcctgccccgctggcccgatcaggcccggcggctggccaccctgatatcggaggtctgatggggttcgatcccgactggctggcgctgcgcgccggtttcgacaccgccgcccgggcgacggcgcttgaggcacggctcgcccgccatgtcgccggccggcacgacatcagggtggtcgatctgggggccggcaccggtgccgggctggtgcatctggcgccaaggctgggggcccggctccgccagtcctggtgtctggtagagcgtgacccggtgctgatcgccgccggccgcgcccggctgtcggtccagcccgaagccgcgggtgtcgcggtcaactggctgaaggcggatcttgccaccgccgatctggccccggttctggaaggtgcaaatctcgtccatttcaccgccctcatcgatctggccgggcgcgcctggctggaagatctggccggtgccctggcccgggccggcgtgccggttctgggtgccctcacctgggacgggcggatgggctgggatccggccgccgcaaccgatgccgatgcggtggcgggttttgcgcgccatcagcgccgcgacaaggggctgggcggcccggcgctcgggcccgacgcggcgccatattttgccgaggcgctgcggcgtcatggtttcgaggtgacactcgcccgctccgactgggtgatcggccccgaccatccggcgatgcatcaggcgatggtcgacggcgtcgccggggccctggtcgatctggtcgatggcggcgaggcgccggccgggctggttgccgatttccgtgccggccgcgctgccgccggccccgggcggctggtggtcgggcatctggatctgctgggcattccgccctcgcttgcctgatccaatacttgcctgacccggcagggcccccgtaaaaccttgggggacgccatccacggaaagcgccgcccacatgaccgcccagaagcgcatcctgctgatcgacgacgatcccctgctgcgccagacgcttgccgagcagctggcgctctacgaggaattcgccatcgaagaggcggcgagcggtgcccaggcgctggagaaggtgaaggcggggctgaaatccaccccccatgacctggtcattctggatatcggcctgcccgatctggacgggcgcgaggtctgccggctgatgcgccgcgccgggctgaaggcgccggtcgtgatgctgaccggtgccgataccgaggccgacaccatcctgggcctggatgccggggcgaacgactatgtcaccaagccgttccgcttcgcggtgctgctggcccgggtgcgtgcccatctgcgtcagcacgaacaatccgacgatgcggtcttcgcgatcgggccctatcagttccgcccggcggtgaagatgctggtcaccgaagacggcaagcgcaagatcaggctcaccgacaaggaagcccagatcctgaaatatctctaccgcgcgggcgacaagccggtgccgcgcgaccggctgctcgacgaggtctggggctataatgccggggtcgccacccatacgctggaaacccatatctaccgcctgcgccagaagatagagcccgacccggccaatgcccggctgctgatcaccgaggccggcggctaccggctcaatctctgatatccttcaggtcctgaccgccgcggccgcgacctcgcgcaccagccgacgcagccatcgatggccgtcatcctcgcggtggcggatatgccaggccatgtggccggggaaacggcccagatccgcgggcggctccagcaccttcagccgcgggtcgccggccagcctgcggcagatcgcggtcggcagggtcgcgcaaagatcggtggcggcgaccagttccgggatggcgaggaaatgggtcaccgagaccgcgacctcgcgctccagccccagccgttccagcacctgaaacagccccactttcagccggccgggcggcagcaggttcacatggcgcagccgttcaaaggcggcgcggtccagcctgtcccctgccgcatcggggtggtcggcgcgcagcacgcaggaaagtccgtcggtcaggatttcctgcaccaccagcgtgtccggcggatcgacgatccggcccagcgccagggcggtatcgcccgtcagcagcccggtttcggccagatccgcgccgaagggcagcacgcggagccgcacccccggcgcctctgcctgaacccgcgccaccagcgccggcagcagcacgaattcggcatagctgttggccgagatcacgaagctgcgccgcgcggttgcggggtcgaagccctgtgccgccagcacggcatcgtcgatcccggccagcgccctggtgatcgccggggccagcgccagggccttttcggtcggccgcatgccatagcgctcacgcacgaacagcgggtcgccgatcagcgcccgcagccgggtcagcgccccgctcaccgccggctgggtcatgcccaggcgatgggcggcgcgggtcacgctgccttcgtcgatcagcgcggcgaagatccgcatcaggttcaggtcatacatcatcagatatcattttagctgatatctggcatcggtgccgcgaatttgaatccgcccggccgcctcgccacctgaaggatcgaccaggacacatcatcacccccatcgatgaagggccgatttctcatgagccgcatcctgtttatcctcaccagccacgactgcctgctcgacggcaagcccaccggcctctggctggaagaacatgccgtgcctttcatggccttcaccgaagccgggcacgaggtcacggtcacctcggtcgccggcggcgacgtgccggtcgatccgaacagcaccccctcccccgatcaggcggcagcctgggcgccggcgattgcggcgctgaaggacacgccggcctatgaccgcatcgataccaccggcttcgatgccgtctatctgcccggcggccatggcaccatgttcgacatgccgttcaatcgccgcctgcacgatctgctcttcgcctttgccgatgccggccggctggtcgccgcggtctgccatgcaccggcggtgttcggcgacatgcgccgtcccgacggcacgcccttcgtcaagggccgccggctcgccgccttcaccgacagcgaggaagcggcggtgggcggcacccacaacgtgcccttcctgctcgaaacccggctgaagcagctgggcgcgctgcatgaaggtaccgccgactggggggtgaaagccgtgcaggacggccggctgatcaccggccagaacccgcaaagctcgggcgaggtggcgcggctggtgctggccgcgctttaagacgccgacggtcccttagatacggcttccgtcagatacggcttccgtcagacatcgtcatagaccggtgcccgcttctccgtcagcgcggcatagccttcccgcgcttcggcagaggtgaagctggcgccgatctccgccaccgccgccgcccggtccagccggccggcggcgatgtcgtccagcaggcgcttgaaattgcgcaccgtctgcggggccagcccggcgatgcgagcggcatgggcatcgaccgcggcggccagcgccccctcttccccgccggtcagctggtccagaaagccgatgcgcagcagctcgtcggcatccatcggctcggccagggccagcaggcgtttggcggcggtgatgcccagcctggcgacgaaacgctcaagccccgtcacgtgatacatcaccccgatccgggccggcggcgccaccgcccggctggcgggggtgccgatgcggatgtcgcaggccagcgccagatccaccccgccgccatggaccccgccgttcagcgcgcagatcgtcggcaccgccacccgggccacccgttcgcacagcttttccagcgggttgtcggtccagtccaccccggccagatcgtcaaaggcgacgccggaacagaaggtcccgccctcccccgtcaccaccatcacccgcacgccgcgcgtggcctcggcctgatcgatcagcccgatcaccgccgggatctcgcgcatcagcagcgcattgcgcttggccggccgggtcagcgtcagggtggcacgcggccccgcaatctccaggcgggcggtctcgatcatccggcaggtcctttcgggctggaacggtatggggcttatcgacgcatggttgatcgaagcccgccccggatcaagctttcaggataatgcttccatcctcgcccgtgtcaggcccttagtcccgcttcttgggcggccggccgcggcggcggcgaggcggcgtccgcagcggcgcgtcgccttcggcgcggggggtgatgccctcataggcatcggcgatgttctgtaccgccgcagccagtgcctggcgccgcatcgggtcttcgatccgggcataggcgaccagcagatcctgaagctgacgatcttcggtggtgaccggtgtattggccgagagcattgcgggcgcttcggccagttgatcaccacttaaccaggcatccagatcggtaccggtgggcagaccatcgaagaagtaggcgacgggaacccccagaaaggtcgcggcaatatacaatcggcctgcgctgatgcggttcaggccgcgctcgtatttctggacctgctggaaggtcagacccagagcctcgcccagctggtgctggctgatctcacgcatctggcgcaaggccagcagacgcgcacccacatgggcgtcgatcacctgggcgctggccgagcgggtctccggatcgatcggagtggattcggctggcggccagtcaggcacgccgccctctgcgatcaactggctccccggtccgcccgggcccttctgtgccgtcaggcccttccggggctcggtacccttctggggttcggtgcccttctgcacaggcttggtctggcgcttgggggcgtcatgctgattgtcgtcggtcatggccaaggggtccgtcggtcactgtgggggatgggagggccgggcgtgcggaccaccacgatcatggggcggccctgcggcgcgcaggcccgctgccgggccgggcgggcggcgataggccagcgcctcgctcaactgtgcgcggccgatccgctcgcggccggcgagatcggcaatggtcagcgcaacccgaagaacccgggtcacgccccttgccgacaggcgaagccgctccgatgcgcgcaacatcagttcccgggccggcccgtcgagggccgctgcccgatcaagggccgtgccctccagctcggcattggtcatcgggcggcgcagatgggcaggagcctcgtccagcccggcgaacccgcggttacgtgcgtcggcacgggcgcgtgccgccagtacccgtgctcgtatcggcgcgctcgcctctcccgggccatgagccaggattgcagccggcggcgtcggtgccagttcgatcgtcatgtcgaagcggtcgagcaacgggcccgagaggcggttttgatagtcggccgcgcagcgcggcgcgcggttgcaggccagcatcgggtcggcgacatggccgcagcggcagggattcatcgccgccagcagctgaacgcgcgccggataggacacatgcatcgctgcccgcgataccacagcttccccactttccaccggctgacgcagggcctctagtgtcggtcgggcgaattccggcaattcgtccaggaacagcacgccgccatgggccaggctgatttcgcccggacgggcgcggttgccgccgcccaccagggctgcggccgacgccgaatgatgcgggtcgcggaagggccggttgatccgcggccggacctgcccgcggccggccacgctttcaatcaggcacagatccagcgattccgccggcgccagagggggcagcaggccgggcagtcgccgggcgagcatggatttacccgcgccgggcggtccgatcatcagcagattatggcggccggctgcggcgatctccaacgcccgccgggccaccggctggccccggatatccgccatgtcgggtaggggcggctcaccgtccagccggggttccggcgtcgtcggcagcgtactgcgcccggtcaggtggcccagcaggcccagcaggtcgggggctgcgatcaccgcatggcggtcacctgcccaggccgcctcgtccgccgatgcggccgggcagatgatccgccggccggtctcggccgcaagcacggccgccggcagcacgccggccaccgcggcaagcgtgccgtccagtgccagctctcccagggccaggtggccgtccaacacccctgacggcagggcgccgatgccgagcatcagggcgagcgcgatcggcagatcgtaatgcgacccttccttggcgagccccgccggggccagattgaccaggatacgtttcgccggcagggtcagccccagccggccgagggccgcccgcacccgttcgcgcgcttccgtcaccgccttgtcgcccagacccaccacggcaaaggccggcagcccggccgagatcgccacctgaacctcgaccgggacggcgcggatgccggtgagcgcgatggtatcgacgcgcgcagtcaacggcaccgctcccggttccgggctgcaaggccaccggtgcatctgtcgatccgggtcggtggatcagtccacaacgtccgcacgcacgaaccccttcgcgacacgccatcggcgggtggcgtgttggctttcctcagagtctgttctacctgatcgttagtcgaccatcatgatttcgtcaataatcatggggataaaacgaagctatcagagtcatttacagctaatacgtgttcatacacaagcataaataccttgacgtgtaattggagacaggggactactatagcgagtagattattactaatttacttctttaagaggaatttcgctcggttcaggcggttaagtatgaggaatgaacccggtcaggtggcttcacggttttggctgagaattggtggatgtgcagctttcttaatcttcaacccgaatgagggtttattcatacatcatgcgcgaacctgccgtctggaaaaaatatacaatgcatcaagcctgtcgaataatctgcgatatgatgatatgcgcttcgcgccattttgtcttatcacccggcagttcagacaggatttataccgcatgggttgtgcaggaccggccgcatcagggccgtccttgtcttgtccatcgaaacttttaaatggaacgacacaattcagtgtcggaatactcaggaaccgccttgtgccgtcgaatgccggtaccggttcacgcgagcagcgtctccgtcggctgcggcatcctggcccggtgcagcgcggtttccagcgcccgggccaggtcgcgccgctcctcgggcgtcaggaaatggccgatgatcagccgccggccatggctggtgagggccagttcgcgcgggccgaagccgtcttcctcgcccgcatcgggctccaccagttccacccgcagccagtagggctgaaaatcatgggcgcgggtgcggccgcgatggtcggtctgttccacccgcagccgttcatgggtcaggcgcagccgttcaaacgcgcggccgctgatatagctggcgcggaagcccagccagaccagcaggatttccagcccgcagaagccgaagaccggccaggcgcccagcgtcatgaaatagatgcccatgggcgcgagcacgcccgcgaggccgaacatcacccatctgaacccgctgggcggcagggagcgatggggcgtcagcagcgcgtcgaaaatgagcggaccttcaggggatggccggctctcgtctctggtctctggctggctcatggcttcagtatatggagcggccgggcggcccgccaagccgttattcttcaggcacctgggacaggttgacccatggatgcggccgccgcttcccaaggcccgcccgagcggctatcgtcaccgcccatgaagcgcgccgatgtcgaagaattcttccgccggctctccgccgccgatccggcgcccgagaccgagcttgcctatggtaacgtctaccagctgctggtggcggtggtgctgtctgcccaggcgaccgatatcggcgtcaacaaggcgacccggctgctgttccagcaggtcttcaccccggccgacatgctggaactgggtgaagaggggctgcgcggccatatcaaaaccatcggcctgttcaatgccaaggcgaagaacgtcatcgcgctcagccgcattctggtggagcagcatggcggcgaggtgccgcgcgaccgtgccgccctggaggccctgcccggggtcggccgcaagaccgccaatgtcgtgctgaacgtggccttcggtgagccgacgattgcggtcgacacccatatcttccgggtcggcaaccgcaccggcctcgcccccggcaagaccccgctcgacgtggagcgcgggctggagcgtaaggtcccgaaacactaccgcctccacgcccatcactggctgatcctgcacggccgctatgtctgcaaggcccgcaaacccgactgccccgcctgcatcgtggccgatctctgccgctacaaggacaagacgccgggagtggcggtgactggcggtgtggtcgggacgtcagacggcatataaggggtttagatcgagtttacccatttatatccacattcagatataaatgggtaaactcgatcaaacaggtaaattcgataaaatccgtttccttcggagggtgcagatggatccggtacgcaatcccttcgcacctggtgccggtacgccgtcgcccgaggttgccgggcgcgcgatgattctcgacgagcttaccgtcacgctccagcgcatcgcccttggaaaatttgcccaacctgttcctggcggttggtgaagccgcccggtcagctggggtaccgttcgcgatcctgatcgacgagatgcagtatctggggcggccctcccccagattctggggttggcgggcgaatcgaagtcctatgccgagcgtctgttcaaatatccgaagatcggtgccttggaggaaaaggatgcccgtgcggccctgctggggccaattcgtgaggaaggtgcacggatcgaagaggccgcgctgactgctattctggagatcaccgagcgatatccgtatttccttcagcaatgggggcatgacgcctggaacgtcgcagaacatgacatgatcacggcagtggacgtggaggcggcgacggagattgcgattcgcaagctggacgacaatttcttccgcgtccgcttcgatcgctgcacgccatctgaaaaacgctatatgagggcgttggccgagttcggccccggcacccatcgatccggagatgtcgcggaccggcttggcctgaagaccaccagcgtcgggccggtccgcaataagctcatccgcaagggcatgatctattccccacagcacggtgacacggcttttaccgttccgcttttcgacgcctatatgcgatgcggcgtgtcatcccgactctcgactgatcccggacgtctgcacggcaaaaggccggcggagcgatccgccggccttttcaatacgatcagatgccgcgcgaagcggccggctcacttgccggcgcgggcgacaccttcctcgatcagccgcttggcggtgtcgatgtcgtcccagccggtgaccttcacccacttgcccttttcgaggtccttgtagcgggtgaagaaatgctcgatctggcggatcagcagctccggcaggtcggtatagctctggacatggtcgtagagcgccgagaccttctggtgcggaacggccaggatcttttcatccatgccgctctcgtcttccatcttcagcacgcccaccggccgcgcgcggatcaccgagcccggcacgaccggatagggcgtcacgaccatcacgtccaccgggtcgccgtcatcgcccagggtgttggggatgaagccgtaattggccgggtagaacatcggcgtggcgacgaaacggtcgaccaggatggcgccgctgtccttgtccagctcgtacttcaccggatcggcgttggcagggatctcgatgacgacattgatgtccgcaggcaccgcgcggccggcggcgatcttggtcacgtccattggtcgggcctctttccccggtggtacagaaatggcgatgtacacccgggggtcgagacgggacggccgggtgcgacctcgccgatcgatgcgctagatagcacgatctgcggttctgcgcgagacgagccgcagcaggatcagccccggaatcgccgcaaccgtggttgcgaggaagaaggccgaccagccgagttcctcggccatgatgccgctcgacgacgaaagccaggtccgcgccaccgccatgaaggacgacagcagcgcatattgcgtggcggtgtaagagacgttgcacaggctcgacatataggccacgaacaccgccgtccccatgccgccggccagattctcgaagccgatcaccgccgccagcaccgcgacatcggggccggcctcggcctggaccatgaaggccaggttcgacagcgcctgcaggatgccgcagatccagagcgaccggacggtgcccagcgcccccagcagcgtgccgccggcccagaagccgaccatcgaggcccagaagccgaacagtttggaaatctcggcgatctgggtcttgtcgaagccgatatcgaccaggaaggggttggtcatcaccccggccaggctgtcgccgaatttgtagaaggcgacgaaggccaggatcagccaggcatggggccgggtcaggaattcctggaagggggccaccaccgcggcatgcagccaggcgccggcgcggccgatcggcccctttgcacccagccgttccagcagccgtccggcccgggcttcggcctcggccgcatggctgcgatccacccggggttcggggcccgccagcaccgccagaacgcccaggcccatcgccgccgccatcacggcataggcggtgaaccagtcgaaataggcggcgagataaagcgcgccggcgcccgaggcgagcatgcccagccgatagccgaacaccaccatcgccgcaccggcgccctggcggtcttcgggcaggcgttccacccggtaggcatcgatgacgatgtcctggctggccgacgaaaaagccagcagcaccgcccagagcgcggtggtccaggggtcggcggcggggtcggacagccccagccccagcatggtcaggataaccgccgcctgggtcagcagcagccaggaccggcggtggccgaacagccgggccaggcccggcagccgcagctggtcgatcagcggcgcccagatgaatttgagcgcatagggcgtccccacggcggcgaacaggccgatcgccgccttggagatgccgtcttccgtcagccggacgctgagcgtgccgaaactgagtgcgagcggcagaccgctcgcaaaacccagcacaaggatctggatgaggcgcggctccagatagatccgcgccccggcaaggaagcggctgcccctgcctgtctcatccctgccctcgccaccatcgggtgtcgtcatgcgggcatccgtccgacgggtgggatcaggccgaagcgacggcgcgggccgccttcttgcggtcgttggggtccaggaagcgcttgcgcagccggatcgacttgggcgtcacctcgatcagctcgtcctcgtcgatataagcgatcgcctcttccaggctcatgatcttcggcggcgtcaggcggatggcgtcgtccttgccggccgagcggatattggtcagctgcttggccttcagcgggttgacgtccaggtcgttgccgcgcgaatgctcgccgatcaccatgccgccatagacccgggtctggggctcgacgaacaggatgccgcgctcctccaggttccacagcgcataggcgaccgcctcgccggtgccgttggacaccagcacgccgttgcgccggccttccacctcacccttgtgcgggccgtaatgcgagaacagccggttcagcacgccggtgccgcgggtgtccgacaggaactcgctgcgatagccgatcaggccgcgcgacggtgccatgaacacgatccgggtcttgccgccgcccgaggggcgcatgtcggtcatttcggcccggcgcaggctcatcttttccaccacgacgcccgaatactcttcgtcgacgtcgatgtggacttcttcgatcggctcttccagctggccggtctcggcgttttcgcggaacagcacgcgcgggcgcgagatcgacatctcgaagccttcgcggcgcatggtctcgaccagaacgcccagctgaagttcgccgcggccggcgacttcgaaggcgtccttgctcggcagctcggtcacgcggatcgcgacattgctttccgcttcgcggaacagccggtcgcggatcatgcgcgaagtgaccttgtcgccttcctggccggccagcgggctgtcgttgaccgagatgctgaccgccatggtcggcggatcgatcggccgggccgccagcggctcggtgatgccgacggcaccgatggtgtcggcgaccgtggtcttcgacaggccggcgatggagacgatgtcgccggcttccgcctggtccaccgcttcgcgcttcagcccgtcgctgcgcaggatcttggtgatccgcgcatcctcgaccagcgtgccgtcgcggcgcagcgcccggacggcctggttcatcttcacgacgcccgaggcgacccggccggtcagcacgcggccgatataggggtcgctctcgatcatggtcgcgagcatggtgaacggcgcgtcgcggtccacatccggggccggcacgtgggcgacgatcaggtcgagcagcgggtgcaggttctcgcccgaggtcaccggctccatcgaggcccagcccgaccggcccgaggcataggccacggggaagtccagctggtgctcgtcggcacccagtgccgcgaacaggtcgaagacctcgtcgagcacggtgtcggggcgggcgtcggggcggtccatcttgttgaccaccacgatcggacgcaggcccttggcgagcgccttggagagcacgaacttggtctggggccgcacgctttcggccgaatcgaccagaagcagggcgccgtcgaccatgtcgaggatccgctcgacctcaccgccgaaatcggcgtggccgggggtgtcgacgatgttgaggcggtaatccttccaggcgactgccgtgcatttggccaggatggtgatgccgcgctcgcgctcgagatcgttcgagtccatcgcccgttcggcgagctgctggtgggcgcgcacggcgccgctctgctggagcagggcgtcgatcagcgtggtcttgccgtggtcgacgtgggcgatgatcgcgagattgcgcaggacggtcatacgggtctgacaagccttgagagacgacggcggcacctcttgtgccgccgtccgcccgcttgggccccggttcaggccgatcgcgcgacgagatccgcgatcgaaccggcagggcgcgggccgatttggccgatgatcccggcagccgccaggccgccgagtcgggcggaccgcgcgagatcgaacccgtgggtcagcccgtaaaggaaaccagccgcatagagatcaccggcgccggtggtatccaccaccgcttccaccgggctcgcctccacatggaccggcgccccctcgcggggcacgatcaccgatccgtgttcgctgcgggtcagcgccgcaatctccacccggcccgtcaccgaacgcatggccgcgtcgaagtcgtcggtctccgcaagtgcggtgatctcggcttcgttcgcgaacaggatgtcgatgtggtcgtcgataagccggtggaactcggcacggaagcggtcgacgcagaacttgtcggacaggctgaatgccacccgtgttccattgcgccgtgccgcccgcatcgccttgaggcaggcttccttcgcgggtgcaagatcccacaaatagccttccacgtacagtatttcggcacgcgcgacttcgttttcgtcgacatcgtccggcgacaggtggacgctggcccccagataggtgttcatcgtccgctggccgtcgggcgtgatcagcacgaagcagcgcgcggtgggcggggtcggtgctgcggccggcgtgtcataggccacgcccagcgcccggatgtcgtggcggaaaacctggcccagcgtgtcgtcggccacccggccgacaaaggcggtgcgcgcgcccagcgccgccagacccgcgatcgtgttggccgccgacccgcccgagctttcgatcgccgggcccatggctgcatagatcgcctcggcccggtcggtgtcgatcagggccatggtgcccttgaccatgccctgggcgtcgaggaagccgtcttccgtgcgggccaggatgtccaggatggcgttgccgaggccgagcacgtgataggtcttctccgtcatgatcggttcgtcttcctttgcgcggggatgtttctttgcacgaggatgggggcgcgggtgcccgggcgaccctcaaccacaggctgcatggccggtcggcggcagtatagccgccccggcccggaagggcgatcccgggcgcgcggcatctcgccggcttttgcgtcgcaatgccgattgcgcccttgagtcccgcccgtccccgtcgtatgaattccctacggtttcgcaggcgcaccgtaaccggatcacggaccggggggcgcctcggccgggggggccgaacgggccctcttcctccccgcgctccccctccccgcgctccccggagacgacccgcgccatggcgctgatcaccaccaccgtcggacgcacgctcggcaatctcgacgatgcccgcatgtggcgtccgctcggcatcggcatcgtcggttcggcgatcctgatgggcgtgctgtggtggctggctgtgggctgggtggatgcgaccgggctcaccggcatcggctggctggacaccaccatttcttacgccggcgatttcgccgtcatcgtcatctcggcctggctgctcttcgtgccgatcacctcggcggtgatgggcctggtgatcgacgaggtcgccggggtcgtggagcggcgcagctatcccggattgccgccggccaaaggggccgggttctgggcctcgctctggtccggtgtcaggttcggcgtcttcgcgcttctgctgaacctgctggtgctgccgctctatttcgtgccggtggtcaacctggtcctgttcgtcgggctgaacggcatcctgctcagccgggagtatttcgaactggcggcgctgcgccgtctcggcacggccgaggcgaaggccatgcggctccgccaccgcaccacgctcttcgtgcatggcgccgcggtctccttcctgttcgcgatccccttcgtgaacctgaccgcgccgatcatcgccgccgccctgttcacccatctcttcaccctgatccgggagcgcgaagcccgtgagctgcgccgtccgtagccagatcgcccgccccttggccatccgtcctgtggccgcccttcttctcggccttgcgggcttcggcctcgccggctgtcagaccaccagccccgatatcgggacggcccagatccgcccggcgcccaagcctgcgcatgtggcgcagccctcggggctggcagagctgctgaagctggatcaggacgatctgaccacccgtttcggccggccggcggtggcgcggcgcgaaggccagtcggtgttctggcgctattccgacaatcgctgcgcgctgatcctgtatttcccggcgatcgatgcggcaaagccgggcggggcgcgtcccacccatggggtggtgcgctggttcggtccgcaggcggcgggggcgggcgatgccgattgcgtggcgggattcgatcacgccaccatccaggcccggctggccgcgccgggcgtctgagcctgtctagccggttgcgggcagcaggttgatcggtttgcccggggcgtctgcaggcgccgtctcgcctggatagggtgccaggcccgacggcggcaccggtcccaccggtgtggccggcacggtcggtggcggcggcacctctcgcggcggcagaagggccggtgtcacggggatggggaccaccgcctccgttgcgggcatatcaggcgtcgtcccgggtgcggccgcctcgggggtgacggtcgagggtgcctgcacggcggcctgcatcgcctccagcctgcggcgcatctcctcgatccgctggcgttccgccgcggcttcattgggggtgatcacccccaggcgcatccagtcgtcgatgcgccggccatgggccgccagctcttcggccgtcagctcgttcggatagggcagcgtttccgccggggcgggcggcagcagggcatctatgatccgggcctgttcggcccgcgcctcttcggcggtcatctcgcgcgcggcgaccatctgcttcagcgcctcgaaacgcgccagggtctcgccgggggtgggggccggggccagcgggtccacggtaaccgagggcgtatgcgacagcggcagcagcccgcccagattggtcgcccggcgttccgccgccagcctggccgtcaccagatcggcggcacgcagccgctccatggtctggaagcgccgcaccatgccggcgtccaatgcctggtccaccggggcggggcccggccgtggccggctgccgggcggccacaccaccggctgccaggccaccatctgcactgcggccggcgagtcgaccgtgatcggcgcctcgacgatgatcgggtcggtgctcggcaggatccgttcctcatccgccggcggttcggtcgtgatgctctccgcgcagccggtcaggatcgccggcatggccagcagggccagcaacagggcgatggggcggcgcagaaacaggggcatcgggcgaacgggtgtcatgctcaagagaatagggtgtcccggccgcgcccgccagccctgcccctgcggcaacatgcggcctcagccgatccgccgcccggcctcgatatgggcccgctccccgcgcagccggcggtccagccgctgggcgaaccgcccggtgccgacggtcaggctctgaaccgtctcgggttcggcgaccagttcggcgtgtctgtccgagaaatagccgattcggctattttggcccatattcatagccgatccgtcagctggggccatcgcctcccacaccgggcgaccgccatggggaccgggtgcgatcgtatgttcaagccccatcatcgccagcatggtcggtacgatatcggcggtgccggtcgcggtctcgatcctggccccgctccggaagtggtcgcccaacagcgcccccaggctcaggatctccttcgggtgcagcccgccatggatgcccaccccgtcgcccaggccgttgtcatgcaggcaggtcccggtcaggccccactggtccggttcgtcgaagttccgcaatacgaaaacaagatcggctgcccgggcatggtcgatgcccgcgagccgccggtcgaaggtccccggggcctggccttccaccccgtcccggccgggggccgagaacaccatgccgatctcgtccatctccatcagcgctgccgccaccctcgccgccagcgccggggaacgatcacgcaccagcatgtttccgcaatagcccggaatcagggccacatcggccccgtcggccaggtgccggtcgaccctgaaccccgccgaccgcagcgccgccgccagatcgaagcgccgtgtctgggtaacatgtgcatgatctgacacaaaaatcagctgcacgcccgcggcccgaccctcggcctcccaccagtccgcaacccggccgatctggtcgtccaccgctcgcatcgcgcccaacgaggtttcggatccgatgccgaaaacatggtaggcattgtcgggctcgccataccacaggatggtgacgtccggcaggtcgcgggtgatgaccgtcaggaaggcgtcggtcatccagcgggtgccggccaggtccggatactgcttcggtgcctcgggccggcctacctcgtccaggatcgcccgcacctcggcttcggggaaggaactctcgggctggtggaccgacaggcacagcgcgtccagcccggtcatcggctgcttcagccgcacgctgccggcggaattggccgacagtaccttcagccgccggccgttggccgccagaatctcgcccagggtcggggtcgtgaacagccggccgtcataggccgcggtcgccttgtcgatcttggcgacgtcatagccctcgaagcgctcgcgggcgtcgacccgggggtccaggaagaagttcgccaccatgccatggccggatggccgggcgccggtcaccagggtgggcaggttgacataggtctcggtcgggaaggcggcggaatggcgggccagcaccgtgccccgctccagcagcgccgtcagcaccggcatgcgatcgtgggtgacgagttccgggcgcaggccgtctaggccgatcagcagaaagcgcatggggggcgggctccggtggcggcggctgccgagaggatcgggaggaggtgacatagcaggatcatgttgcacctctgtgatcggcctgcccagccctctctggattaaaccagatatcggtgccctcatcggctctggcgagggggggcgcgctgctgttaggttgggcggattttccccgacggacaagcggatgaccctgcgcgacccgatctatctcaaggccaagacccatctgagcgacgggctggacgagggccgctggcggcccggcgacaagctgccctcggaacgggatctggcgcgccagctcctgctggaccgcaatctcgtccgccatgccctgatggcgctggaaggcgaagggcgggtgatgcggctggatcgccggggctggttcgccaccccgccccgcctggccttcgacccggtcaaccatgtcaacttcgcccgcgccgcccgcgaccaggggcgggatccgggctggcagtcgctgcagcgcgacatggtgcccgctcccgggcccgaggcccgggcgatgcggcttccgcccggcacgccgctgctgcgcaccttcgcctggggggccctcgacggggtgcgggtctatgtcgaggaaaccttctataacccccgcctcgggccggtcgccgatacgcagtggcgtggacgctccaccaccgaggtctgggaggaggatttcggcatccggccccgccagcgcaatcttctggtccgtcccgtgcggctggcgggagaggtgctcgaggttctggcactggccccgggggctccgggggtgtacatccgccggatcaaggtcgacgaggtgggcaatgtcatcgagatcgaccatgaatactggcggttcgatgccgtcgaattcagaatgtaagtccgaccatgccgcatgggggccgcctgcccggctcccccgtgcagctgcccgaggagagaccggatgaagacccgcgccgccgtcgcgttcgcgccgaacacgccgctcgagatcgtcgagctcgacctggaaggtccgaaagagggcgaggttctggtcgagatcatggccaccggcatctgccataccgatgcctatacgctgtcgggcaaggacagcgagggcgtgttccccagcatcctggggcacgagggcgcgggcatcgtccgcgaggtcggtgccggcgtcacctcggtcaagcctggtgatcatgtgatcccgctctacacgcccgaatgccgccagtgcaagacctgcctgtcgcagaagtccaatctgtgcaccgcgatccgcgccacccagggcaaggggctgatgcccgacggcaccagccgtttctcgctcaagggccagccgatctaccactatatgggctgctcgactttctcgaacttcaccgtgatgcccgagatcgcggtcgcgaagatccgcgaggacgcgcccttcgacaaggtctgctatatcggctgcggcgtcaccaccggcatcggtgcggtgatctataccgccaaggtggaagcgggtgctgatgtggccgtattcggcctgggcggcatcggcctgaacgtgatccagggcgcgaagatggtcggcgccgaccggatcatcggcgtcgatatcaaccccgggaagcgggcaatggccgaggctttcggcatgacccacttcatcaaccccaaggaggttggtgccgacaaggtcgtgcaggcgatcaccgatctgaccggcggcggcgtcgactactccttcgactgcaccggcaacaccaccgtgatgcgtcaggccctggaatgctgccatcgcggctggggccagtcgatcatcatcggtgtggccgaggcggggcaggaaatctccacccgtccctttcagctggtcaccggccgggtctggcgcggctcggccttcggtggtgcccgcggccggaccgatgtgccgaagatcgtcgactggtacatgcagggcaagatccgcatcgacgagctgatcaccgatgtcatgccgctggatcagatcaatcacggcttcgatctgatgcatgaaggcaagtcgatccgctcggtcgtggtctactgatccgatgatcgtgaaagacatggagacgatctccatcagccgctgcttcggcggtacccaggggatctatgcccatgcgtcggccgagacccgcacccgcatgcggttctcggtcttcgtgccgccgcaggcagagcaggggccggtgccggtggtctggttcctgtcggggctgacctgcacggaagagaacttcaccgtcaaagccggcgcccagcgcatggctgcggcgctggggctgatgctggtcgcccccgataccagcccgcgaggggtggacgacggcggcgagacggtgcccgacgatccggagggggcctgggatttcggtctgggggccggcttttatgtcgatgccaccgaagctccgtgggcgcgcaactaccggatgttctcttacatctcggacgagctgccgcagctgatcgccggggccttcccggccgatatgaatgcccagggcatcatggggcattcgatgggcgggcatggtgcgctgaccatcgcgctgcgccatcccggtcggttccgctcggtctcggcctttgcgccgatcgtgtcgccgctgaactgcccctggggcgaaaaggcgctgggcggctatctggggcccgatcgcagccgctggcgggcccatgacgccgtcgccctgatcgaggacggtgcccgctgcccgcatatcctggtcgaccagggcatggccgatgggttcgtcgccagccagctgaagcccgacctgctggaagccgcctgcaatgcagcgggccagccgctgacgctcaaccggcgcgacggctatgaccacagctactacttcattgccagcttcatggaagaccatctccgctggcatgcagcggcgctcagggactgatatccccgatcgggcggggcgggatcacctttcgcccggcccatctccatccccgttgtcgcccccatctccatcctcatcccgatggctcgtggcgggatgcgccggggcgtcgggatcggtcagcgcccggatcaggtcggcgatcgcccgacgggcgagcggatgtgacaccgcctcgatccggggcagatccggtgcgctgcgctcgggcgtgcggcggcgcggcggtaccgtcatcgggtcggtggtatcgtccagcagggccgacggcgccacttccagcacttccgccagcaggacgagggtgctggccgcgatgcggttgcggcccttttcgtatttctgaagttgctgaaaactgatgccgagcgccgctgcacagcgctgctgggtcagtccgcgcgccctgcggatggtgcggatccgtcggccgaccgccgctgcgaaaacctcctccgcgacctttccgcgccgcaggcgcgacgacggcgccagatcgtcgccatcgtcttcccacaggccatcggcgtcccacaaaacggtcgtgccggaatacagcagctccatccacgtcctcccgtcggcagagtgcgatcgtgcttccacctcagattgaagcacatttcgtgaggatcgcgctacatatcaatcgccatgcgagatatagagcaaggcgtgtgccatgtggtgagaagtcgatcggcggtgtatggcggccggtgggatgtgcggccgccatggttgtgcggggtcagagcagggtatcgatggcctcggtggggcggccgaccacggcgcggccgccacgcagcaccaccgggcgctcgatcagccgtggcgttgcggccatggcggcgacgagggcgtcgtcgtccttcgccggatcgtccaggccaagccccttgtattccggttcggccttgcggatcagggccctggcaccgcccaccgccgcagcgacgcgggcgatttcttcggccgggggcggggtgtccagatagcgcaccacgcgcggtgtcaggccgcgggcctcgatccgctccagggccgcacgcgacttggagcagcgcgggttgtgccagatcacgatctcgtcgggggtcatgatggatatccgttccggttcagctgcgcttcgcttcgatggcatcccagatcgccgcggcgagattggtgccgtcgaagcgctcgatctcctgcaggcccgtgggcgaggtgacgttgatctcggtcagatagtcgccgatcacgtcgataccgacgaagatcagcccctgtttgcgcagttccgggccgatcgcctcgcagatctcgcgctcgcgggcggtcagtgccgtgggttcggggcggccgccgacatgcatgttcgaccgggcctctccctcggccggcacgcggttgatggcgcccagcggttcgccatcgaccaggatgatgcgcttgtcgcccttgcgcacgtcggacagatagcgctgggcgatgatcggctcgcggcccagccggctgaacacctcgatcgcgctgttgaagttctcatcgtccgggcggatgcggaacaccgccgcgccgccattgccgtagagcggcttcaggatgatgtcgcggtgctcggcccggaaatcgcgcagggcctggacatcggcggtgatcagagtgggcggcgccagctctggataatgggtcaccagcagtttttccggcgcgttgcgcaccgactgcgggtcgttcaccaccagcgttttcggatgaacgtgctccaggatatgggtggtggtgatataggccatgtcgaagggcggatcctggcggagcagcacgacgtccatggtggtcaggtcgcgcagctccagcgcccccaggcggaaatggtcgccggccatgcggcgcacggtgacctcgtggccgcgggcggtgacccggccgtcgcgcagcgccagatcgcggggcagatagtagaacaggctgtgcccgcggcgctcggcctccagcatcagggcgaaggtgctgtcggcattgatgtcgatcgactggatcgggtccatctggaccgcaacggcaaggctcatgggacgggaaactcctcagcgcggatgaagcctgtggcggccgatatggggtggatccgggcggggcggaagatggacagcgtggatccgggcggggcggaaggcggtccgtgataggaccaccactcaattcagctcggcgcgcaaccgttcgaccagggtgagggcccgcctgcggggttcctcggcggtggtgttggcggcgaagacctccagagcctgaacggcgcccagctgctcgcccagccgggcgcgcatcagccccagctcgtaccacagcgcccagtcggtgggcgcgatcagcagcatgcgggccagcacgtcgcgggcgcggtccagctcgccccggccggcggcacggatcttcaggttgttctgcaggcgcagcagcaccgcgcggcggtccaccgcccggtaatgctcgggttccagctcggcggtgtcgccggccacctgcttcagcagcgcgcgcagatccgaggtttccaccacccggccgcgatcgaagggatcgaccagcacccggtccatgccgccttccacgcggatcaggaaatgggcgggaaaattgacccccacgaccggccagcccagtgtttcgcccagatgcatggccagcacgcccagggccaccggcaggccgcggcggcgctccagcacccgggccaggctggcattgtcgtcgtggtcataggtctcgtcgtcgccgtcgaagccataacggccgtgaaggatgtcggcgatcagcaccgcccggtcccgggcgccgtcatcggcatcggcggcatcgacgccggtcttcagcccgcgggccatggcctcgctttcggcggccagcgacatctcttccagcagggcccgcgcctttgcaggatcggccgtcggatggtcgagtgccgagagcagcaatgcggtctcggcgatcgggatcgcatcgtcatccagccggccgacggcctccagcctgcgggcgatggccgcccgctccgacggtgtgccagtgctcatgctccggcccccgggtgcttgacctccacatacgataccacccgcttcactcccgaaatgccgcgggcgatctcgaccgcccgggcatgttccgcatcgctggccgccagcccgatcaggtagaccacggcgcccgagacctcgatgttgtagttgaaggaattgaccgcctcgtcggcgagcagggcggcccggacctttgtggtgagccatgtgtcacgtgcgtagtcgccgaggttgccttcccccaccacgcggatctcgtccatcacctgcgtgacgcccggcacgccccgcgcgatgctcaccgcttccgacttccaggtccgggtggccacccggccggtcagcagcacccggccctgattgacctggatgtgcaccgggcggtaaagctcgtcgacctggcgctcgaagtaacgccgggcgatcccggcgcggatatcggcatccgacaccacgccgccgatgccgcgttcatccgcggcggccgagacggcggtggcgccgccggtggccacggcggcggcgcaggcctgaagcaggccggccagggcgatcgccacaagcggcacggccaggcggcgaagaggggtggtccgggaaaaaagctcggtcatgggctcggtcgtcgggggtgacgtcaggacgttgaacggcgcgcgcatcctagcaccggctgcgggtactgcgccatctggtgcagccgggtcaggatccgtcagggcgccaggcatcgggcagatgatggggcaggcccagccggtcgacccagatcaggtcgaagcgcaggccttcgacaccgccggcccccagcgcctcgccgcgcgccagcacccagtcggcggcgcgggccagacggcggcgctgggccggcagcaccgcttcgccggcggttgcccggtccgggcggcgcttgacctcgacgacggcgagcatccgcccgcgtcgggccaggatatcgatctcgcccgcgggtgtcttcagccgccgggccaggatccgccagccggtgagacgcaggcgaagtgccgccagcgcctccgcccgccggccggcacgttccgacgaccggccccgggcgatccgggggctgcgcgtgccgccgccgctcacccctcgccctctgcatcgtcgtcgccggtcagcgccactgcgcgggcatagaaggccttgcgcggcgcgccggtcagttccgccagcagcctggccgcccggttggcgcccagcgccttgaccagcggcggcagcagcttctccaccgcggccgcatccagcgccccgccggcgggcagggcgtcgccttccccggccgcctcgcgtgccggtgtccgatggccttcgatcagcagcacgatctcgccgcgcggcggtgccgcctcgaagcgggcggcaagctcagggagggggccgcgcacgacctcttcataaagcttggtgagttcccgcgcgaccgcggcctggcgaggccccaacagctcggccagttcggcgagggtgcgggcgatgcggttggggctttcatagaacaccagcgtcgccggctcgtgggccaggcctgcaaagctgctgcggcgttcaccgggcttcgccggcggaaaccccaggaacagcacccggtcggtcggcaggcccgcgatcgagagcgccgcggtgagggccgaagccccgggcacggcacggacctggtggccggcgcctgctgcctcgcgcaccagcttgtagccgggatccgacaccagcggcgtcccggcatccgagacgagcgcgatccgctcccccgcctccagccggcgcagcacctcggggcgcatgcgggcggcattgtgctcgtgatagggggcgagcttcgccctgacgccccaatggcccagcagccggccggtggtgcgggtatcctcgcacagcacaaggtcggcctggcccagcacatccagggcgcgtggggtcatgtcgcccagattgccgatgggcgtcgccaccgcatacaggcccggatcgatccgccggccggcacgcggcggcgggcccgcctcaccctcggggtcgtccgtgtgttgtctcgggccggggctgccattactctgatcgccaccctggtcgccgcagtccgggccatggccgctttcgtggcccgccgggccggcctctgccgcaacgacatccgatgagatccgatcccgtgaaaactgaccggtcccgtgtccgtccggctgaacccggcccgctccaccgcctgcttcgtcgctcgcgcgcgtcgtcattgcgtctcttgcctctcgcggcgatgctcgtgcttgccgcctgtcagagccagagggtagagccgccggcgcctccggcacaagtgcagccgcagcagccccagcagccggtgcaggttctgccccagcagccgccgaagccggcagtgccggaaagcccgctcgacctgccgccgggcgcgctccgcgtcggtctgctggtgccgatgaccggcccccaggccggtttcggccaggcgatgatcgatgccgccacgctggcacttgcggatgtgaaggccgatgacgtggtgctgctgccccgcgacagcggagccgagcctcagcagagcgccgccgcggcccgcgacctggtcgaaaaccaggccgcgaccgtgctgctcgggccgatctacggccgcaacgtgccggcggtggccgaggttgccgccccccgtcaggtgcctgtggtcgccttctcgaacgacacctcggcactgcgcccgggcgtgcatctgatcgggctggcgcccgaggtgcaggtcgaaagggtggtggactatgccgtccagcagggcaagagccgctttgccgccctgttgccctatggcgcctatggggatcggctggccgaaagctaccgcaaggcggtggcccgcaccggggccgagctggtcgatatcgtgcgctattccgaccccggatccgatgcccaggatgccgtccggcgcctgtcgggcgggcagcagacgccccccttcgacagcctgttgctggccgagaccggcgagcggctgcgcggtatcgccagcctgctgccctattacggcatcgatgccggcgaggcgcagatcctgggcaccgctctctggatggatcagccggtcggccgcgaccagaacctgcagggcgcctggtatgccgcccccgaccgcggcgcctgggacggtttcgtgcgccgcttcagcgcgctgttcggtgcgcagccgccggcactggctgggctgtcctatgatgcgaccgcccttgccgctgtgctgggccgcaagggtcagcttgcccgcgaactcgacaatccggacgggtttgccggggtgaacggcctgttccgcttcgatcagaagggcgcggcggaacatgcgctcgccatctatcaggtgacggcgaccggcggcgaactgctcgatccggcggcccagcgcttcaccgccggtgcgcgtcccggggagggcgtgatccgctccaacccgcttgccgcccccacccagccggcggcatcgagcgtgccgcccaccaccggcgcagcttccacttcgggtgtgagcggcgcgaccaccactggtaccgcaagcggtgcggccccacagggccttaccggttcggtgccgccggcgcgctgaccgcgcgccgtcagcccccgggaagcagtcaggcctcgggaaaccgctcgtccagatcgtcggcgagcagatgggcggtcagcgcccccagcaccagccggccggcgggcgtcgccaccagccggtcggtgcgcccggcgacgaagccgccctccaccgcctgggcaaggcgggcggcatccaccgcatcgcgcagcgccacgccggtccggcgctcgaagacggcggggtcgatgccggcatcgagccggagccccatcatcagcgcctcttctgccgcccgtgcctgcccgacgaccacggcttcgtcgcggccgtgaccatgggtatcgatcaggtcgagccaggtttcgggcgcccgcgcccgccgggtggcttcgcgccggccgtccggacccgtcggcacccggccatgggcgccgggcccaatgccggcatagtcggcataggtccagtaggcgagattgtggcggcattcgaatcccgggcgggcgtggttcgacacctcataggccggcagccccgccgcggcgagccgagcggtcgtcgcctcgtagagatccgccgcctcgtcatcctcgggcaggaccagttccccgcgggcatggcgggtgtggaaggcggtgcccggctcgatggtcagctgatagagcgacagatggtcggcagccaggccgaccgcacggtcaagttccgccatccaggcggccatggtctggcccggccgggcatagatcaggtcgaaggacatgcgcgggaagatctcgcgggcctggccgatggcatccagtgcctcggccaggccatgcgcccgccccagcgccttcagcgcagcctcgtccagtgcctggacgccgatcgacagccgttccacgccggccgcgcggaaatccttgagcctggcggactcgaccgtggtcgggttggcctccaggctgatttcaggcgcgctctcggctgggaaaagggtgcgggcccgctcgatgatccgggcggtggtggcggggtccatcagcgagggcgtgccgccgccgaagaaaatcgaccccagcggccgtggccccagccgccgggcttcgtcttccagctcggtcagcagggcgcgttcccagcggggcccgtcgatcttctcccgcacatggctgttgaagtcgcaataggggcatttggagacgcagaacggccagtggacgtagagcgcgagcggttcggtggcggcggtggtcatcccgggggtcagtcgggctcgaaacaggcgcggaccagctggcggaaggcgatggcgcggtggctgatcgcatgcttctccgccggctcgaactcgccgaaggtgcggctgtcgccttcgggcacgaagatcgggtcgtagccgaagccgttgctgccacggggcgggaattccagatgtccctggatgacgccctcgaaggtttccaccgcgccgtccggccaggccagcgccagggcgcagacgaaggcaccccggcggtcgggatcgtcgcccatgcgggtgcggaccagttcgatcgccacggcgaaatccttggacgggccggcccagcgcgcggaatagatgccgggtgccccgtccagcgcctcgacggtcatgccgctgtcgtcggcgagggcgggcaggcccgaggcctcggcggcagcccgcgccttgagcacggcgttgtcgatgaaggtcaggccggtctcttcgggctcgggcaggccgaggtcgccggccgagacgacgtccacgccgaagggctccagcagttcgcggatctccaccaccttgcccttgttgtggctggcgatgacgaggcggtcctcggtaaaacgacgatgggggctggtcatccgaagatctccggtcagcggtccttgcgctgggcggccgccagcgcatcgcccagggtgccgagcggccgtccctgctgattgcggtcgcggtcgggcgcgcggccaccgccactattgttgccgccccccttgttgccaccgcccttgccgccaccggcattgcggttgccgccgcccggcttgccactgccctgtttctgcgccttctgctgctgggccagctgctcgggggacagcggcggcggggtggcgaggtcgggccggccttccatggcggcgatgatcgcctctttctgcagctcgaacagccgtgccgtgccgatttcggccagttcgaccagacggcggaactgggtgggcgagaacgggtcggcctcggccgtcgcctggacctcgacgatgcctccgccttcggccagcacgaaattggcatcggcctcggcgcggctgtcctcgtcataatcgagatcgagcacggcctcgccgtcgaccaggccgcaggagatggccgccactgcccgggtgatcggatgctcggcaaggtcccgcgtcgccaccagcttctgcagcgccagccacaaggcgacatagccgccggtgatcgaggcggtacgggtgccgccatcggcctggatgacgtcggcatcgacccggatctggcgctcgcccagcttctgcatgtcgacgaccgcgcgcaggctgcggccgatcaggcgctgaatctcgaccgtgcggccctgctgcttgcccttggcggcctcgcgatcggtgcggctgtgggtcgcgcgcggcagcatgccgtattccgcggtcacccagcccttgccggtgttgcgcaggaagggcggcaccttctcttccaccgtcgccgtcaccagcaccttggtgtcgccgaaatgaaccaggcacgagccctcggcatatttgttcaccatcggttcgaaccggatgacgcggagcgcatcgacggcacggccggacaggcgcatcggagactgacgcatggggagacaaggcctcggcagcgggcgatgcgggtgcatcaccccggataacagatcgggaggggcggacggtgcggaacatggttgcggtgtcgcaccggccggctggctggtaaagctacgcgctcgggcccgggcttgcaatgtcggcagaccgtcgccgcactatgcccctgcccgcgccatgtcctagagttgacggtcgaaggcccccctcttacataccggctcggacggccatcccggccggtcggaccgtcatcgacgtcggaccgtcagcggagggtcaaggtggagcggatcagatccatgtcgcgcgcgaatgatcgggagaatgtcgaccgtcaggcgctcgaagccctggaaggcttcggcgggccgccgcgcgccttccagcagctgaacgagcgctcacgcgaggtgttccgccatgtggtcgacgccttcgtcgagaccggcgagccggtcgcctcgcggaccatcgcccgtcggctgggcagcagcctgtcgcccgccaccatccgcaatgtgatggccgatcttgaggaaagcgggctgctttatgcgccgcatacctcggccgggcggctgccgaccgatatcgggctgcggctgttcgtcgacggcctgctcgagatcggcgacctgtccgatgacgagcgccgggcgatcgacagccagtgcaacggtgccggccgcagcatggcccaggtcctgaccgaggcgagcggcgtggtcgccgagatgtcgcgctgcgtggggctggtgatcgcccccaagagcgaagccgggctgaagcatgtggaattcgtgccgctttcggaaaaccgggccctggtgatcctggtcgacgaaaacggcatggtcgagaaccgggtgatgccgctgccccccggcctgccgccggccaagctgatcgaggccggcaattatctgagcgcgcggctgcgcggccgcaccatggacgaggcccgccagctgatcggcgacgaaatcgcccgcaactcggccgagatcgacaccctgaccgcccgggtggtggagcaggggctggcgacctggtcgggcggccatgacgacgggctgctgatcgtcagcggccagtcacggctgctcgacaatgtttcggcgctgtcggatatcgagcgcatccgccggctgatggaggcgctggagaccaagaaggacattctgcgcctgctgaccgaaagccagcgggcggaaggggtccagatcttcatcgggtcggagagcgcgcttttcggcctgagcggctgttccgtgatcgcggcacccctgaccgatcagaaccggcgctatgtgggtgcgatcggcgtgatcgggcccacccgggtgaactatgcccggatcgtgccggtggtggattacacggcaaaactgatcgggcggttgatcggctgacggtctggggcagaatggccccgaccaccgatcggcccccatggcgacggatgccccggccggggcgggactgtccggcccgggcatctgcggagcgtggccggggcaggccccgaagcgggcggcccgggccgcgggttcgaacgagaagacgatggagcaggcttgagatgaccgaccagaaccagacgcccgagggtaccgaggccgaggccatgcccgacactgccgcggccgagagccccgacggccggatcagccctgaagcccggattcaggcgcttgaggcggaactggcccagatccgcgaccagcatctgcgcgcgctggccgacatggaaaacctgcgccgccgggcccagcgcgaggtggaagatgccggcaagtatgcggtgacgaaattcgcccgcgacgtgctcgccgtctcggacaatctggagcgcgccgcccaggccgtcccccctgaaaagcgcggtggcgatccgctggtcgaccagctggcccagggtgtggacatgaccctgtcgtcgttccgccagacgctggagacccacggcatccgccgtgtcgacccgctgggcgagcgcttcgacagcaagcttcatcaggcgatgatggaggtcgaggaccgcacgaagccggccggcaccgtggtccaggttctccagaccggctatgtgatcgccgaccgcctgctgcgcccggccatggtcgccgtctcgcgcggtggcccgaaggagggggcgcctgcgcccgagacccccggcagccgggtcgatacctctgcctgacgccggaaccgtccggcggtgacagccaaggcccgttccgcctgccggtgagcgaccggcggcgggcgggcccttgtcgtgtcaggaccctgaagtggtgcgaaagagctgagacagggcgtggccgggccgccatgcgcgacatgtcgcagcatttctgagacgcccccatggttgcgcccccgcccgggcttccctatatgacgctcgaccgcagatgtcggggcgaaattgggcatcgttccgtcatctgcctggacccttccacccattcacgcatggaaacgggggggccgtcggcgccgctctgatcagggccgtcggcgcccgctacctgagagagaccgaacccatgagcaaagtcatcggcatcgacctgggcaccaccaactcttgcgtcgcgatcatggacggcaagaacgccaaggtcatcgagaacagcgaaggtgcacgcacgacgccctcgatggtggccttcaccgaggatgacgaaattctggtcggccagccggcaaagcgccaggcggtcaccaaccccgagaacaccgtcttcgcggtcaagcgcctgatcggccggaccttcaacgacccgacgacccagaaggacgccaagatggtgccctaccggatcgtcaaggcggacaatggcgacgcctgggtcgaggtgcgcggcaagaagcagtcgccgagccagatcagcgcgcagatcctgaagaagatgaaggagactgccgaggcctatctgggtgagaccgtcacccaggcggtcatcacggtcccggcctacttcaacgacagccagcgccaggcgaccaaggatgccggcaagatcgccgggctcgaggtgctgcgcatcatcaacgagccgacggcggcggcgctcgcctatggcctcgagaagaacgacggcaagaccatcgcggtctacgacctgggcggcggcaccttcgacgtgtcgatcctggagatcggtgacggcgtgttcgaggtgaagtcgaccaatggcgacaccttcctcggcggcgaagacttcgacatgcggatcgtcgattacctcgccgacgagttcaagaaggagaacggcatcgacctgcgcagcgaccgtctggccctgcagcggctgaaggaagccgccgagaaggccaagatcgagctgtccagcggcatgcagaccgaggtcaacctgcccttcatcaccgccgaccagaccggcccgaagcatcttgcgatcaaggtgacccgcgccaagctggaagccctggtggcggacctcgtcgagcgcaccatcgagccctgccgcaaggcgctgaaggatgcgggcctcaccgccggcgagatcgacgaggtcgtgctggtcggtggccagacccgcatgcccaaggtcatcgagaaggtgaaggagttcttcggtcgcgaaccccatcgcggcgttaacccggacgaggtggtcgccatcggcgccgccatccaggccgccgtgctgaagggtgaggtcaaggacgttctgctgctcgacgtgaccccgctgtcgctgggcatcgagacgctgggcggcgtgatgaccaagctgatcgagcgcaacaccaccatcccgaccaagaagagccaggtgttctccaccgccgacgacaaccagacggcggtgaccatccgggtcttccagggcgagcgcgagatggcggcggacaacaagctgctcggccagttcgatctggtcggcattccgccggcgccgcgcggcgtgccgcaggtcgaggtgaccttcgacatcgacgccaacggcctggtcaatgtgtcggccaaggacaaggcgacgggcaaggagcaggcgatccgcattcaggcctcgggcggtctgtccgatgccgagatcgagcggatggtcaaggaagccgaggcgaatgccgccgaggacaagaagcgcaaggagctggtcgaggcccgcaaccacgccgacggtctggtgcattccaccgagaagagcctgaaggagcacggcgacaagatcggcgccgaagaccggacggcgatcgaggatgcggtgaccgcgctcaaggccgcgctcaacggcgacgatgccgacgacatcaaggccaagaccgaggcgctgtcgatggcggcgatgaagcttggcgaggcgatgtacaaggccggcgagcagggcgatggcccgaccgcttcgggcccgggtgccggtgccggtgcagccggggcggccgatgacggtgtcgtcgatgccgacttcgaggaagtgaaggacgacaagggcggccgggcctgaggcccgccacccgtttccgggggcggtcggtgccgacgaggcgccggtcgcccacggtcgttttcagagggagctgcgcgggggtccggttctcgtgcgcgcgcccatgatcgaaggcaccggcagaggcgtccgccacggcaggcgcgcggatgccccggctcaaggtacagtccacgaccatggcgaaggccgattactacgagatgctcggcgttgcgcgagacgccgacgaagcgacgctcaagaaggcattccgcaagctggcgatgcagtatcacccggaccgcaatccgggtgacgccgaagcggaacagcgcttcaaggaaatcaacgaagcctacgaggtcctgaaggacccgaagaagcgtcaggcctatgaccagttcggccatgccgccttcgaggcgggcatgggcggcggtcgcggcggtccccgcggcttcgatttcggctcgtccttcgccgatgtcttcgaggacatcttcggcgagttcatgggcggcggccgtggcggtggccgtggcggcggatcccgcggcgccgatatgcgcttcgaccttgagatcacgctcgaggatgccttcaacggcaagcagaccgagatcaccgttcccgcttcggcgacctgcgaggtctgcgacggttcgggtgcggccgagggcacccagcccgtgacctgcccgacctgtaacggccacggcaaagtccgcgcgacccagggcttcttcaccatcgaacgcacctgccccgcctgccacggcgtcggccgggtgatcaaggatccgtgcaagaattgcggcggcgcgggccgcgtgcgtcgcgataagacgttggcggtcaacatcccggccggtgtcgaggacggcatgcgtatccgcctgtcgggcgagggcgaggccggggttcgtggcgggccgccgggcgatctctacatcttccttgcggtggcaccgcatccggtgttccagcgcgacggggtcgacgtgtcgtgccgggtgccgatccccatgacccgcgcagccctcggcggcacggtcgaggtgccgacgctggaaggggcacgggtgcggctcaacatccccgccggcacccagtccggccaccagttccgcctgcgctcgaagggtatgccctcggttcagggacgcggcgggcgcggcgacatgtatgtgatcatcaatgtcgagacgccggtcaatctctcggcccgccagcgggagctgcttgaagagttcgagcgcgagggatcggaaggcggcacctcgtccagcccgcagtccgagggtttcttcgccaaggtgaaggagctgtggtcggatctgaccgattgagccgatctcagcctcgggcgggccgggatcggctttcgcgggggcctgaaacgcggtaggaaaaggggcgcagccgtgttgaagcggctgtgcccctttttcgtgtcggatgtctcgaaaggaccggaagatgagcgcgagcgggatcgcgatcggcgtggtcggctgtgcgggccggatgggacgcaccttgctggctgccatcgccacaaccccgggctgccgcatcgcgggcggcaccgagcggcccggcagcgaggaagtcggccaggatctgggccgctttgccggggtcgatcctctgggcctcgccgtcggtgacgatccggccgtgctgttcgcggctgccgatgtggtgatcgacttcacccggcccgccgccaccacggcccatgcccgcctggccgccggcagcaacaccgccctcgtcatcggcaccaccgggctttcgtcagaagacgaagccgtgctcgccgatgccgcccggtcggtgccgatggtctatgcgcccaacatgtcgctgggcgtcactctgctcatgcatctggtggagcaggcggcggcgcggctcgatgcggattacgacatcgagatcgtcgaaatgcatcaccgccacaaggtcgacgcgccctcgggcacggcgctcggcctggcgcgggccgccgcccgtggccgcgaggtttcgctcgacgatgtggcggatcgcggacgtgacggcctgaccgggccgcgcaggcgtggcgcgatcgggatgtcggcactgcggggcggcgatgtggtcggcgaccatcaggtcatcttcgcgaccgatggcgagcgcctggaactgggccatcgcgcctcgtcgcgcgagacctttgcccgtggggcggtcaagtcggcgctctgggtcgccgggcgggcgccggggctctacgacatgcgcgatgtgctgaatctgcgttgaggcgggggcgctgaggcaggggcggggcgctcagcgtctgcggcgattggcgacggtgatcgccgacaggatcagccccaacgccagaaaggcgttcaggctgggctgttcgcccagcagcagaatgccccacataacgccgaaggcggggatgaggtagttgttgagcgccaccagcaccgccccgccgcgcgccatcagccggtagaacagcagataggcaaggccggtgcaggcgatgccgagcagggtgaccgcggccatcgcctccagcgccggcgcctgggtccagggctgttccaggacggcggcgaccggcagggccagcacggcgcccgaggtcaaggtcgccgtcgccgaaaccagcggcggcacatggcgcacccgctcggcatagagcgaggcgacggcatagcagagggcggcgcccaggatcgcaagttcgccgatcccgccgccggcctcggtcagggccgagggaccgaccagcacgaccaccccggaaaagccgagcgcaatgcccgccacccgcccggcggtgatcgggttttccgccggtttggcgacccgcgccagcaccagggtgaacagcggcatcgccgccatcaggatcgccgccaccgccgagggcacatgctgctgcccccaggcgatcagcgtgaagggggcgagattgccgatcgcgccgaacaccacgaagggcagccagtcggccgcccgggccggcaggcgcagcccccgaagcttcagcaccgcataaagcgccgcggccccaagcgccagccggctgaccacgatggtgaacggccccatggtcggcagggcggtcttgatcagcatgaaggatccgccccacagcgcggcgagcaggatcaggcagccataatccgccggtccgaagccgcgcgcggccagggcaccggcaacgcccgccgggcgcacgtcatccgacatcgccatcctcgaagcactgcgggggaggggatcgcgaaagccggatgatcgcgcgcgggtgggggagaggtcaagggaagggcggcaggttcacttctggaacacatagctccccggtgccgcgcccagcgccggatagcccttgtccggggcggccatcggcggcggggtgacgggggtcgaggaatgggcgtggagccagtcggtccaggccggccaccacgagccgtcgcggatttcggcggccgccacccaggcgtcgggtgccttgtagaagccgtcggtgggggtggtcatgatccggaatttgcggcccttgtggccgggctcggagacgatgccagcattgtgaccgccgccggtgagcacgaaggtgacctcggtgtcggccagcaggtggatcttgtaggccgagacccagggggccacatggtcgcgctccgtgcccactgcgaagatcggggcccggatgtccgacaggctgatcggctggccctcgacctcgaagcggccggtggcgaactggttctcgaggaacagccggcgcagatattcggaatgcatccgatagggcatgcgggtggcatcggcattccaggccatcaacgcgttcatcggcgtgcgctggcccatcatgtagtcatgcaccatccgcgaccagatcaggtcgttggagcgcagcagctggaaggcgccggccatctgcgtggtgtcgaggaagccctgggcccacatcatgtcttccaggaaggtgacctgggcctcgtcgatgaacagggtcagctcacccgcttcggtgaaatcggcctgggctgcgaagagagtgacggagcccagccgctcgtcgccgtcgcgggccatggtggcggcagcgatggtgagcagcgtgccgcccaggcagtaaccggtggcgtggatcgggtgaggaccggcaatggcctccaccgcatcgatcgccgccatcacgcccttcacccgataatcgtcgaagccgatgtccctgtctgccgggccaggattgcgccacgagaccatgaagacggtgaagccctggccgaccagatactcggcgagcgatttgccgggctccaggtccaggatgtagtacttcatgatccaggccggtacgatcagcaccggttccggatgcacggtgtcggtggtgggcgtatagcggatcagctcgatcaggtggttgcggaacaccacttcgcccggcgtcatgcccatattgcggccgacggcgaaattctcggtgccggcagggccggtgccggtgaccgtccgccacatgtcgtcccagaaatgcagggcgccgcggacgaaattggccccgccttcctcgatggtgcgattgatcacctcgggattggtcagcggattgttggacggcgagaacacgtccagcatctgccgggcggtgaactccatcaccttttcatgcgccggggtcacgccgcgcacgccggtggtggcgttgtaccaccactgctggttcagcagaaaaccctggtagagcacgtcgaaaggccattgcttccaggcatcgccccggaaacggttgtcctggggcaggggctcgatacaggcgggcagctttgcatggggcatgccctcggcctctgccgcatctgccgccccggcaacataggcagaggagaagggaaggcccggcaggggggtgtcgccatcggcgaaccccgcccgatgggccatatagctgccgaggcgggcggctttgcgcatcgccttttcgaccagttcggcccgcttgcccggagcgcttgccagatggaccgcccaatccgcccaggcatcggtcagcgaggccggcgacagaccgccggtgacccttgccatggccgcgtgcacggcccggtccaccgcctcgcgcacggcggctccggccatctctcccggctcttcgatgcagggttctgccgcggccggtggggtcgggtcgggcgttttgtggtgcagcgggtgatgggcgggcaccggatgctccgcgggcgctgtggccggcgctgcgggtgcgtcgacggtggggtggcggcgggcatcggcattcatcgatccggctctcctcgaagatcccccggggcctgcggtcggggtgcgtggtccgctattgcagcgcatcatcgcctgccttgccgcggacacccatgatccatgtcaatgtgttcggctttcgcgcatgcgaaaacaagcctgttccgtcacggaccagagaatgacatgatcgccgcacagcatgtcgggtgccagtgacacacgcatgacgatggtctgccggcggagaccggcgaccactcaaggccatgcgcaagttcggaggtccggaaggccatgcgtatcggacgctggatggcaatcgtgatcgttgccgccgtcgccgcaggagcgggagctatctactggcgctccgtcacccgcgatgccctgcccgaggggttcgcccgcaccaatggccggatcgaggccgagcagatcgacatcgccaccaagatcgccggccggctggccgatatcacggtcgaggaaggcgacatggtcgaggccggccagatggtcgcccggctggacgacgttcagatccgggcccagctggcggcggcagaggccgagcatcgccgggccatccaggcaaaggccgaggccgaggcccagcttgcctaccggcggagtgaactggtctatgcccgtgcggagctttcgcgtggcgagacgcttgccgcgcgcggtcatttcacacgcgaaggcgtcgaccagcgccggatgcaggtcgcgaccgcccaggcggccgaagcggccgcgatggcggccgtcgatcaggcggcggcggccattgatgcggcggcggcccaggttgcccagacccgcgccattctggacgataccgtgctgaccgcaccgcgggcgggccgcatccagtaccgcctggcggtgccgggcgaggtgctggcggcgggcggacgcatcgccaccctgctcgacctcaccgatgttcagatgacgatctttctgccggcccgcgatgccggtcgtctcgccacgggcgccgaggcgcggcttatactggatccgattccggaatatgtcgtgccggccgccgtttccttcgtcgccggcgaggcgcagttcacgcccaaatcggtggaaacccgcgaggagcgcgacacgctgatgttccgggtgaagctgcgcatcccggcggatctgctcgccgcccatgccgatcgggtgaagaccggtgtccgcggcaccgccgtggtccgggtcgatcccgccgccccatggccggcggagctggcggtgaaactgccgtgaccgcccccgtcgcaccgggcccgatggcggtgctgggcggcgtcacccatcgcttcgggaaggtgacggcgctcgaccgggtcgatctggagatgaccgccggtggcacgctggggctgatcggccccgacggcgtcggcaagtcgaccctgctgtcactgatcgccggcgtccggcgcatccaggccgggcgggtggaggtgctgggcggcgacatggtcgatccggcgcaccgtcggctggtggcgccacgcatcgcctatatgccccaggggctgggccgcaatctctatcccacgctcagcgtgttcgagaatgtcgatttcttcgggcggctgttcggccagggcaaggcggaacgtcgggcgcggatcgccgaactgctggaggccacggggctggccccctttccggaccggccggcgggaaagctgtcgggcggcatgaaacagaagctgggcctgtgctgcgccctgatccacgatccggatctgctgatcctggacgagccgaccaccggcgtcgacccgttgtcgcgccgccagttctggaccctgatcgatcgcatccgtgcccgccgtccggccatgggggtgctggttgccaccgcctatatggaagaagcggcacgcttcgaccgcctggttgcgatggatggtggtcaggtcattgccgccggcacgccggccgagctgcgggcccggaccggcgaggcggatctggagcgggccttcatccgcctgctgcccgaggcgcggcgtcgcgaccatcaggcgccggtgatcccgccgcgggcccccgacggcgacgggccgccctcgatcgaggcccgcggcctgacctgccgcttcggcgacttcaccgcggtggatgcagtggatttcgccatcggtcgcggcgagattttcggctttctgggctcgaacggttgcggcaagaccacgaccatgaagatgctgaccggcctgctgccgccgaccgaaggggcggcgcttctgttcgggcggccgctcgatgccggggatatcgagacccgccgccgcgtcggctacatgtcgcaggccttctcgctctatggcgagctgaccgtgcgccagaatctggagctgcatgcccggctctacgggctggacgacacccggaccagcgagcggatggccgcgatgatggccgaactggatctggccggggtggcggaccagatctcggatgcgctgccgctcggcatccgtcagcggctgcagctggcggccgccgtgctgcacgagcccgacatcctgatcctggacgagccgacctcgggcgtggaccctgtcgcccgcgaccgcttctgggcctatctgggggtgctggcgcgcgagcgcggtgtgacgatcttcatttccacccatttcatgaacgaggcggcgcgctgcgaccgcatctcgctgatgcatgccggccgggtgctggcggtgggcacgcctgcggatctggcggcagaggatcccggcggcagccttgaggaggccttcgtcgcgcggcttcaggcggcgaccgacggggggccggccgaaggaatgccgaccggggcggtggcgcccgaggcccccgtcatggagcccgcatcggcgacgccggcccggccgcccaggcgccgggatctgcgtcggctctgggcctatgcccggcgcgagacgatggagcttgcccgcgatccgatccggctggccttcgcgctgctgggtccggtgatcctgatgctgaccttcggcttcggcatctcattcgatgtcgaggatctgccctatgccgtctatgaccaggaccggtctaccgaaagccggtcgctgatcgaggccttcgccggctcgcgctatttcgaggaacacgcgcccatccacagcccggtcgagatggaccggcggcttcaggccggcgagctgaagcttgcgatcgaaattccggccgatttcggccgcgacctgacccgggggcgggtgcccgaagtcggggtggtgctggacggtgccatgccgttccgggccgagaccacccgcgcctatgtccagggtgtggcgcagcgccatctggaggagatgcgcgaggcctcgtctctgccggtttcgacgacgccctcggtcacggtcgagacccgcttccgttacaaccaggccttccgcagcgtcgaggcgatcgtgccgggcgtgatcatgctgatgctggtgctgatcccggcgatgatgacggcggtgggtgtggtgcgcgagaaggagaccggatcgatcgccaatttccgcgcgacgccggtcacccgtttcgagttcctggccggcaagcagctgccctatttcggtatcgcggcgctgagcttcctggtgctttccatcgtcgccggcctggtcttcgggctggaggtgaagggatcggggctggcgctgctgacgggtgccctgctttatgtggcagccacaaccgccttcggcctgctggtctcggccttcatgaagagccagcttgcggcgctgttcgccaccgccatcgtctgcatgatcccggcggtgaacttctcgggcctgctgaccccggtttcggcactcaccgggggcggccgggtgctgggcctcgcctttccggcggcctggttccagcagatcagcatcggcaccttcaccaagagcctgggttttgcggatctctggcacaaccatctggcgctggccggttttgcgctgctcttcctgatcgcggcccaatgggtgctgcccaagcaggagcgttgagccgatgcgtctcgccaacatcttccgcctgggcgtgaaggagctgcgcagcctcgccgccgacccggtgctggtctttctgatcctttataccttcacctatgcgatctatgcggtcgcgagcggcgccaatttcgaggtcagcaatgcggcggtggcggtggtcgacgacgaccgctcggcgctgtcgctccggctgcgcgatgcggtgctgccgccgcaattcgcctcggtggtcgagctgacggcgcccgaggccgatgcagcgctcgatgccggcgatgcggtcttcgtgctgcacattccctcaggcttcgaagccgatctgctgcgcggccgggatgcgacgctgctgctcgacatcgacgccaccgccatgactcaggccggcaacggtgccgcctatctccagtcgatcatcgcgcgcgagatctcggcggcggccgggcgcgacgacggtatgacgggggatctgccgatcgatctggtcgtgcggtcgcgcttcaaccccaatctgtcgtcggtctggttcaacgcggtgatgcaggtgatcaacaacgtcaccatgctgtcggtgatcctggccggggctgcgctgatccgcgagcgtgagcacggcacgatcgagcatctgctggtgatgccggtccgtccggccgagatcatggccgccaagatctgggccaacggctcggtgatcgtcgtcgcctcggtgctgtcgctgatcggcatggtccagggggtgctggcggtgccgatccacggctctctgctgctctatacggcgggggcggtgctctaccagttctcggtgacggcgctcggcattctgcttgccaccattgcgcgatcgatgccgcaattcggcctgctggtcatcccggtgatcgtgaccatgaacctgctctcgggctcgtccacgccgctcgagagcatgccggtctggctgcagaaggtgatgatgctctctcccgccacccatttcgtggcgttctcgcaggccgtgctctatcgcggcgccggcctggacgtggtctggccgacgctggccattctggcggggatcgggtttgggatcttcgcgatcgcccttgcacggtttcggcggaaaatcgtggagatggggtgaggcgtggagatggggtgaggcgtggagatggggtgaggcgtggagatggggtgaggcgtggagagtggggtgaggcgtggaaatggggtgagctcttgccccgtctcgatcgtcaggacaactgatcgagaaaactggcgcaggcatcgagccgcggtctggcggcacgcaggacactgtcgtggatatccggggggaaggcttccggcagtccggcggccgcggcgtcgaaggcgctgccgccccgctcgaccagctgctgcagggcggtcttgaagatcagaggcgggatgcctgctttttctgccgtctgagcgaagtggcggggctggatctgatccaggcgataatgacggttctgcccgaccgacatggcgagcttcatctgtctgcgctcaccctgcctgtggtcgaggctgggctgtgcggtcaggatgtcgtagagcggggtcatcctgaaccgcccgccgggcgcgagaaacacgctgaaattcttcgcatgaccatcggtcgcaccgatgatccagaacagcatctgggccatcagaaaatcacgatgatcccggcccggatcgtcgctgcccttcagggcatccaggatgtcgacgattccggggccgccttcgctctggtatttgagggtcgggggcgtgccggtgagctggcagaaatcttcctgcggcagccggatgagccagccattgttgagccgcttgcgatcgaaacgcctgacgaccagtgccttggtccctgaaaagaccatcatctcagcgtgattgacatccagtccgaaggcctgggcgagcttcaggcaatagaactcgttctcgacgctgttcgacagatctatgccgttgggcagatggccgatctgtgtcttcaggatatgcgtggtgggtgtggttcctgtcggtttcagccattgcccctcgtggaacagaagcgccgtcttctcctgcgcgccggcaatggagatccgaaaatcgtcatccccctgcagaccgagcggggtctgtcccaggttcttgagcatggtggcgatgtcgtcgtccgagaccggttctccctcgattctgtcgagcgatgagggaagtgtgtcgtcgtcgaggaactggagcgcaccgacgcagtcccggccgatcctggagagcaggccgtaagcgtccgtgcctggtgcgccgatccgttcggcgacacgccgcctgatggccggctgatcgggcaacagattgtcgaagaatgcggcgacttccggaccgcggtgcggttcagggcggagtggcagggagagtgacaccgggatcgcatccggccggtctgcccaggccggatcgtaggtaaaaaccacggcgccgttcagctgttttgacagacggccgacaaggtatccgttcagataaacatggaggtcggcataggtttttcgccgtgccatcaatcgtcgttcccgccaagaagcattcgggcgatggcgtcgtcgacggtggatcggtcgcgaggcgcagcctgaaggtccagatcgagagcggccagaaggtcgatgagcgtatccaggcggaggctgggatagccttgctcgatctgagagatcatgctttgccgctgacctgtcctgacacccagagccgcctgcgtgaggccaagcttccgcctttgtctccggatgaggttgcccagctgttggggggtgcggatgatatctgccatggctggcatgttcctctcagggggaactcaagccgctattttatccccgaaatcagataaacgcaatttatccccaatccggaataaagagaatttattccggattgcgaataaggcgtcaatatacactatcagagataaatggagatatttacagcctgtgacggcgcacccgtcacaggccggcaggtgcaggcctggagcctcctgacggatcagtcgatcagcccgcccgtcgcatcgaagaaggggtgggggccgtcgaaccggcccggataggccagatggctgaccagcagccgcggcggggtgaagcggaagagacggatcgccggcggttccatggtgaaagtggagggcccgcccagggtcagatccagcgtcaccgcatgggcggcattgggggcaatcgagaccgcgaccccgtcgagcacggtgtcgatggcgcgatggacatggccgcaggcgaggtgcagcacctgcggatggcggcggaggaccgcgatcagttcggcgccgtccttcagattctgcacgtccatatggccgatgccggtctcgaagggcgggtggtggacgaagaccagggtcggccggtcggggccggcggcgagcacccggtcgagccaggcgagctgggcggcgccgaccatgccccagggcacgccggcgaccgaactgtcgaggccaatcagccgcacgggatgatggtcgatcaggcaggcggcgaaatcggccgcatcgacatatggcaccacatccccaaaggcggtgcgcatctcgtcggcacgatcgtgattgccgggcacggcgtaccatggagccctgatccggtcgagcagcggtcggagcacggcatactcggcggcggaccccgtgtcggtgaggtcgcccgacaggatgacggcgtcgacctcgggcacgaaggcattgacgtagtccacggccgccgtcagcaggccggcggtatcgacccggccataggccggccggccgccgggcttcagatgggtgtcggtcagctgggcgatcagcatgggggctcaggctccaaggcggatgcgggcggcggcgggcacgtcgatgccgagcagggtaccggtctcgggcagatcggcgcgggcggtggtctcgaccatccagctttcgcctgcggggcctgagagcttcagccggcaacgatcccccaggaaatggcagacggcgaccgtgccggtcagcagcccgtccccgggggtggtcagccgggcgtcttccggacggaagagcagggtctcgccccggccgtccatcgcgcggttcatggtgccgacgaagcctgcgacgaaatcgtcggcgggcgcgtgatagatctcgcgcggggtgccgcgctgggcgatgcggccggcattcatcaccacgatctcgtcacccagcaccatcgcctcggcctggtcgtgggtgacgtagacggcggtgatgtgcaggctgcgcagcagagcgtcgatctcggtgcgcagatgctcgcgcagggcggcgtcgagcgccgtcagcggctcgtcgagcagcagcaggcgcggccggacggcgatggcgcgggccagcgccgtgcgctggcgctggccgcccgacagctggtcgatccgccggtcggccagggtgtcgatccgcatcagcgccagcatctcgtcgacccggctgtcgatctcgcgccggggcaggcgccggaccttcagcccataggcgacgttgccgcgcacggtgagattggggaaaagcgcataggactggaagaccatgcctacctcgcgcgcctcgatcggcagccgggtgacgtcctcgccgtcgaacagcacccgcccgcccgcgtcggggcggtccagcccggcgatgatccgcagcagcgtggtcttgccgcagccggacgggccgagcagaacggcggtgcggccggcgggaatgtcgagatcgatgggcgtcagcgcccgggtgccgtcgggccaggtgcgggcgcagccgcggagttcgaccgcggtggcgcccgaggaagcggtatcagtcgtcatcggtggtccttccggccacggcgtccggccagctgcatggcgaccagcagcggcacgatcatcacaaagaagacgagggtgtaggcgctggcgatttccagccgcatcgaggcatagctgtcggccaggcccaccggcagggtcttggtcagcggggtgtgcagcatccaggtgaggttgaattcgccgatcgacagcgtgaccaccatcagcccgccggccagcacgcccggccaggcattgggcacgatcacggtcaggaagcggcgcaggaaaccggcgcccaggctggcggcgccttcctccagcgtcttcatgtcggttgccaccatcaccgcgatcaccgagcggagcatgaagggcagggtgtagatcacatgaccggcgagcacgaagccgctcgacatacggaagctgccggcaccaccccaggtcagcagcaggccgagcgccagcgccaggcccgggatcgcgatcggcagggcgacggtctcttcgatcgcgcgggcaagcggccccggccggcgggccagggcataggccgccggcacgccgatcaccgcggtgatggcgagcgtggcgaaggccagccagatcgacctccagatcgtgtcggcgtaaagccgccagacctctgccacccagtcgagggtgaggccgctttccaggccgcggaagaagttgaccgtgacgccggcaagacccgagagcaccaccggcacgatcatgaaggcggcgaccacaagggtgaaggcgaggccgccccagaagcccgccccgcgcggatgtccgcgtcgcatggccatcagccgccccccgcagccgcgccgcggccgccgagggtgcgggcgatgaacagcgtcgcccaggtgatcagccccagcaccagggccagggccgaggcgccggcgatgttcgcctgcagggtgaattccgtatagatggtcatcggcagcaccgcgatgtcggtggcgagcgcgaaggcggttccgaaggcgcccatggcggtggcgaagcagatcgcgccgctggcgatcagccccggcatcagcgccggcagggtgaccgagaggaacaccctgaccgccccggcccccagcgagcgggcggcttccggcagcgacgggtccagcgtttccgccgcggccatgacgttcaggatcactcgcggaatcgagaaatagagatagccgacgaacaggccggcggccgaataggcgaagaccagcctgtcgccggtcagggccttcgagaccagattggcgaggccctgccggccgccgagcatgatcaccagaaagcccaccaccacgcccggaaaggcgagagggaaggtgagcatggcaatcagcgccgaccggcccgggaagacatggcgggccagaaacagcccggcgatggtcgagatcacgagtgcggccagcgtgacggtcacggcgaggacgaaggtcatcaccgtgtcgtggccatggcgggggttggtcaggatcgaaaaataggccgcgatgccgtccggccccgaggcgccggcaatggcgagacggaccagcggcaccagaaggaaggcggcgagcacgatcccggccggcagcagcatcaggaccaggcgcggggtgtcgcggcccgaggcggatgacatcggtcggtgttccacgtgaaaaggtgacccgccggcgggtgccagcgggtcgtggatcatgggcggggtgaagcggcggccgtcccggcgaccctcacttcacctcggcgagataggtttcggcgaaagccttctggccggcggccatcgcggcataatcgaccggctttgcccgggcgtaatcggcggcgggcaggaagcgggcctcaatctcggccggcagcttcacctcgcgcaccgggcgcagataggcattggcccagagcgactggcccttttccgagagcacgaagtccaggatcctgcggccgttatcggcatgcggcgcgcccttgaccaggctcatcacgtaaggaacgaccagcgtgccctctttggggattacgaattcgacgtcgcccttgtccttgtagcgggcgcgataggcgttgaagtcataatcgatcatgatcgggatctcacccgacaggacccgggcatacgaggtctgcttgggcacgatcgggtcgttgccggccagcttcttaaagaagtcgatgcccggctgccagttggtgaaatcgccgccgaaggcacggttgatcgcaaccgcgccggcatagccgacgaaggcgctggtcggatccagatagccgaccatgccctcatattgcgggttgagcaggtcttcccagctctgcggtaccggcaggtcgcccagcgcggccttgttcacgaacaggccgatcgtgcccgaatggatcgagaaccagctgccgtccgcggccttgagaccggggtcgatctcgtcgaaaccagccgggcggtagggctccaccagcccctgttcggcggcctggatgccgaaggagacgccgtaataggcgacatcggcaaccggattggcgcgctcggccgcaagctgggccagggtctggcccgaattcttgttgtcatggggcacgtccagccccagctcggatttgatcgccgccagctgcgacgcccagtccgcccattcgggcgggcagttgtagcagatggcgtccgcggcggcggcgccttgcgcggggatcgtggcggcggctaggatcagcccggccgcagcggccacggatttcagagcggtaccgatcatgggtcgacgtgtcctcgttggcgtcgtggtcggtggcgaccggggcggcgggaatgtgcctggcagtgcgtcccgccgttccggtcacatcgtgtccgcgcgctcttctctggggcgcccggaatggggagaggccggtccggcctgggggcctgagggcctgaaggtgaagggcaggatcagatcgcccgcctggccctctgcctcgccgagcatggcgatcagccgaagggccgcctgccggcccatctcggccgagggctggacgatggtggcgagcgggggcgtcagatgggcgccgaccgcgatgccgtcgaaaccggtcaccgccacatcgccggggaccgcgaggccgcggcgggcgagggcgccgatcgtggcgatggccagccagtcgttcgaacagaacagcgccgtcggcaggccgcccggctcatcggccatggcgtcgagggcggcatccgggtccggggtctcgaattccacctcgcgtacggcgggcgccggcagccccgcttcggccgcaccggccagaaagccgcgcagccgcgcggcagcgcgatccgagccgccgagcgccccggtgatcatgccgagccggcgatgaccaagcccgcagaaatggcgggcgaccgcccgaccggcgccctcgttgtcgaccgtgaccgtcggcgcgcggccgggggtcggctggttgtagaccaggacatgcggcacccgggcggcttcgagggcgtcgagcgcctggctgccggcggggtcggtgacggtcaggatcatgccgtcgacccggtaggccagcagcgcctcgaccgcgcggacctcttcttcggcgtgatagcccgagacgccgaaaagcagggtgaagcccgcggcgcgggcggcagtttcgataccggccaccgcatcggcgaagaccgggttggccagcgacgggatcatcactccgatcagccggctgcgctgggatttgaggctgcggcccagcccgttcggccggaagcccagatcttccaccgcctggcggatgcgcgccgcggtctcggcaccgacacgaccggtaccgttcagcaggcgtgacacgctggcgaccgacacgcccgccttgagcgcgacgtcgcggatggtgggggacatgggtctcgagacctccggcgggggatcggtcatctctcgtcccccagagaatgcggcagatcgatccgtgggtaaacgtttacatcatgaagtttgcacggcaggcatgtgaccgcccgatgacggtcagcgcttgcggcggcgcagcatgcccttgaaatcctgcaggcgcgcggcgccggtgatcaggctgaaggccacatagaccgggatggtcgcgccgatcagcagggtgagccagagcacccgggcggcatggggcatggtgccgaagggcggcagcgcttcgagcacgcccaggatggcggccgcgaacagcagattggcgagcaggatcctgggcagggtgcggcgcagccgggcatcgcccaccagaagccggtcgcggttgagccggcgggcgagcaggaagacgttgatccaggccgagagcgccgtcgcaagcgcgatgcccatatgcgccagaggctgcatgaaggccaggttcagcaccacattggcgaccagcgccaccaccgcataacgggtgggggtggcggtatcctcgcgggcatagaagcccgggctcaacaccttggcgagcacgaaggccggcaggccgaaagcgagcacggtcatcacctcgacggtgcgggtggtggcctcgggtgtaaaggcgccgcgctcgaacagggtggcgacgatcggcatgcccagggtggcaaggccgaccagggccggcagcgccaccagcagggtcatctccatcgcccggttcatgtggttgcgggcgtcgtcgagcgcgccttccttgatccgggtggagagcagcggcagcagggctgtgccgaccgcgatgccgaccacacccaggggcagctgcaccagccggtcggcataatagagcgccgacaccgtgccttccgcaagcagcgaggcgatcatggtgtcgaccagcacgttcacctgatagacgccggcgcccagcgccgccggtgccgcgaccttcagcaggcgcttcacctcgggcgtcagccgtggcaggcggaagcgcagttcggcaccggcgcggttggcggcgaccagcatcgcccccagctgcaccatgcccgacagcatcagcgcccaggcctggaccaccgccggatcggcatcgacccagtgctgcagcgagaccacgcaaccggcgatcaggcagaggttgaacagcaccggtgcgccggcaaaggcgccgaaccggccgagcgagttcagcacgcccccgaccagggccacggccgagatgaacacgatataggggaagacgatccgggcgagatcaacggcaaggttgaatttctcagggtcgtccgaaaagccgggggcgaaaaccgtcaccacccagggcatcgccgcctgggccgcaagcaggatcaccagcaggctgcagaccagaaccgacagggcggcttcggcgaaggcatgagccgcggccggaccgctttctacccggatgcggttgtagatcggcacgaaggcggcgctgaacgcgccttcggcgaacatgcgccgcagcaggttcggcagcttctgggccacgaaaaaggcgtccgccgccgcacccgcacccagcaggccggccacgaggacatcgcgcgcgaatccgaggatccgcgacatcatggtgaggccacccaccgtggccgcggcgcgcatcaggttcatgaggtgcgggtgtatccgaaaccgcgtccggcgggaaggggcatcaatgggacgacggggcagccccagggctgccccgtggccgatcattcggcggcgtcgccggcggcggtggcggtgctgcggatggtgccgtcatcggcgatcaccggccccgccgcatcgagtgcggccagcagttcttcccgcacccgggtcagcttgccctgatgggtgatcttcaggccgaacacgtccttgacgtagaaagtgtcgaccgcccgctcgccataggtcgcgacatgggccgacgagatggtgagcgccagatccgagagcacgctggtgatcgcgaacagcaggcccggccggtcgcgggcggtcacctcgatgaccgtctgggtgttgcttgcgcggttgtcgatcagcacccggggggtgacctggaacacgtcggtgcgcttgggcccgtcgcgccgggcagccagcgccttggcgggcctgagttcgcccgacagcgtccgcccgaccagatcgcgcatcctggcgacccggacctcgtcgtcataggcggagcggtcggagtcctgcacccagaaggtgtcgagcgccatgccgtcggtggttgtgacgatgcgggcatcgacgatgttgccgccggccagcgccatggcaccggcgacgccggcgaacaggccgtgatgatcgggggcatagaccgtgatcgcagccacggaccggaagcggtcgggggcgacgtcgatcaccagcggcgccggaccctggcggtcggctttggcgaccaggcgggcatggcgttccagcacctcggcatcatgggccagccaataggatccgggcatgcgctcgacatgggcctggaaggcggcgccggtccagtcggccaggcgttcgcgcagcttgtcctgcaccgcctggatccggccggcacggttcagcccctcgacatggccgcccgagagctgttcggccgcgcgataatagagttcacgcagcagcgtgcccttccagccgttccagacattggggccgacggcacggatatcggcgaccgtcagcacggtcagcaggcgcagccgctccatcgactggacctgatcggcgaagtcgtggacggtcttcggatcttcaatgtcgcgtttgaaggcgaccgcgctcatcagcaggtgccagcgcaccagccaggcgacggtctcggtttcctcgggcgtcaggccgaccctggggcagagcttgcgggcgacctcttctcccagcacggaatgatcgccgccacgccccttggcgatgtcgtggagcagaactgccatataaagcacccggcgcgacagcacctcgtgcacgatccgggtcgcgagcggcagttcgtcggggaagttgcccttttcgatccccgacaggatgccgatcgcccggattgtgtgctcgtcgaccgtatagacatggtacatgtcgtgctgggtctgggcgacgacgcggccgaaatccggaatgaagcgaccgaagacaccggcctcattcatgtggcgcagcgtcgcttccgggtccttgggcgaggtcaggatgtcgagaaagacctggttggccgacggatcctcgcgcacgccgtcgtcgatgtatttcaggttctgggtgatccagcgcaggatctgcggatggacgtccatctcgcggctctgggccacccggaacagcttcagcatcttgatcggctgttcggcgagttcgtggcggttcgcgagtgtcagccggccgccttcgatccggaagccgtcgatctcgcgccgcatcaggatgctgggcatgcggatcttgggctggcgctgattggcgctttccagtgccgcgcacaggatccgggtcaggtcgcccacatccttggcgaccagataatagtgcttcatgaagcgctcgaccccgcgcacgcccggccggtcggcatagcccatcaaccggccgatctcggtctggacatcgaaggtcaggcggtcctcggggcggccggccaggtagtgcaggtggcagcgtaccgtccacaggaagttctgcgccttggcgaagcgccggtattcgccggcggtgaagaccttctgctcgacaaggtccgacaggttgtggacgcggtaggagtatttggcgatccagaacagggtgtggaggtcgcgcagcccgcccttgccttccttgacgttgggttccagcacatagcggctgtcgcccatgcgacggtggcgctcgtcgcgctcgttgagcttggcctcgatgaactcgcccgccgtgccgaccatgatgtcggtggcgaagcggcggcgcagatcctcgtacagcaccatctcgccgcagagctggcggctttccagcaggctggtgcggatggtcatgtcgccgcgcgcccgcgagatgcattcatcgaccgagcgcaccgcatggccgaccttgagccccagatcccagagcagatagaggatgtattccgccacctgctcgccgcgcggggtctgcttgtagggcatcaggaacagcagatcgacatcggaatgcggcgccagctcgccgcggccatagccgccgatcgccaccaggcacagccggtcggccgaggttgggttggcgaccggatagacatgggtggtggccagatcgaacagggtgcgcacgatctggtcgatcagatagcagttctcgcgcacaacatgggcgccgtcggccccggcgtcgaagcgtttgcggatctcctcccgccccttcgccagatgctctttcagcatgctcaggatctcgcgccggagcttctcgaccggtttgcccgtctcctccacctgctgctcgatgtcggccatcagggcacgacggtggatgatctgcctcttgttgcggatggcggtcatgtggatcggggcctcggatgtcggcgatacggcggcggtatgtgcgacgggggcgggggatcctcgtgcaacggcgaaggccggtcgtcccgtaacgggcggccggccttgtcagactacctgagagatggggcggaggcgaggcgccgtcaccccttggatcctgcgtggtgaaatcagagccgtgcgtgcgggcgggcctaccacgccggcaggatcgcacccttgaatcgctcggccaggaaggccttcacctcgtcggactggtaggcggccaccagcttgcggatccttggcgcctgggcatcggccgcccgtgcggcgacgaagttgccatagggattgtcggtccggctttcgatcgcgatcgcatccttcgtggggtcgaaaccggcgtcatgggcgtaattgccgttgatcgccgccgcatccagatcgggcaccgcacgcggcagctgggcggcatccagttcgacgatctcaagcttcttcggattggcggtgatgtcgagcagggtgggggtgagccccttgccaggggccagctcgatcaggccttcccgggccagcaggttcagcacacggccgccattcgacgggtcgttggggatgccgagctttgccccttcggccagatcggccaggcgctttactcgggtggaatagattccgatcggctcgacgatggtgtagccgacattgacgatgtcatagccatgggccgcgatctgggcatccagatagggctggtgctggaaggcattggcatccagatccccggcggccagagcctcgttcggcagcacgtagtcctggaaggtgacgatttcgacctccagcccgtcgcgggcggctacctgcttcacgacctcggcgatttcctcttccgcgccggcgatgacgcccagccggacggtttcggtcccggccgcacgggcggcgagaccgccggcggcaaaggcggcgaccagggcggcaagccccagaatggcggtgaacaggcgacggcgaccatcttcgagggcggttttgcgccggggccgcggctgggcgaaggagcggaacatgatggcgatcctgtgcggtggtcctgcggggagaagaacgaccggcgaagaggcaatgccgggcccattccgatgatatcgcggaacagcgtgtaggaacgatgtattccacagtttatgtagtcaatgtaaaaatatatacaataatataatgttattttcaggcgcacaccggatgctgacgctggtatgcgtccgctcaccaggccgggaggaaggcgccctcgaagcgcgtgttcaggaaggctgcaacttcgggtgactgaaaggcttcgagcagggtatggatctcgagccggtcctgatccgcccggcggacgaccaggatgttgccatacgggttgctgcgccggttttcgaccgcgatggtgtcacggcgtggatcaagaccggcggcccgggcgtagttgccgttgatcgccgccgcatccaccagatcgatggcgccggcgacctgatcggccggcagctggacgaactggaacctgcgggtgttgatcatcacgtccttgggcgtgggcgtgagcttcgcccccggtgccaggccgatcatcgcccgctcggccagaaggcgcagggcgcggccgccattgctcaggtcttccgggattgcaatccgggcaccatccggcaggtcgcgcagctgtttgtaggtccgggaataaatgcccatcggctggaccatggtgtagccgaccgagaccaggtcatagcccttggcggccatctccgcttccaggaagggccggtgctggaaggcgttcgcgtcgatctcggcgcgcgccagcgccgcattgggctcgctgtaatcggtgtaggtgacaagctccaccgtcaggcccttgcccgcggcgaccgtcttcaccacctcggcgacttcggtctccggccccttcatcacgcccaggcggaccggcgacagctgttgcaccggtgtggcggcgtcggaatatgtgacaaaacccgcaagtgcaaacgcgatcagcagcaggggaaggaggccggatgccaggatggcgcgcaaaaggcgggacagtcggggcatgccaggtgctcacgcatgtggatggccgcgtatgccgggcagacccggaacccgcagcacccgcctgcgcgggcggaacgggaggtgcgtcatgcaaaatgacagacccgcagctcgggtatgccggccgcggctcctgcgccggcacaaacccgtttccgctcgcacacgatgtggtcggagcccttgatagtcaacagttttccgggatgtggcggtcagttccgcccggtcggccgaccctctggcgccatacgttccagaagctgcaacacttcgcctgatgcgctggtcagccggtccagggccgccagggcatcgcgcggccgaccggccgccatcgcccttgccgcctcgcggccgtggtcgtggacggccgcatgcggcttttccagagcacggaaagttgcgtctcccctccaggcggcagactggtcaccgtaataccagcggcccagccggcaggaatggtgatcggtcagttccctttccgacagcttcgcccggccggtcgccattgcggccagacgcttcttccacagggcgtgatcggccttggccagacgcacgacctgatccgggaaatgccggccggccagtgcctgcagcgccggggcgatgcggccttccagatggtcgagggcgtcggccacggcttcgatgccggcgcggttgtcggcaccaaggcctgccagggccgcaatgtcgccggccagacggtcggatgccacaccctggctgtcgatctcgccggcgatctcggccatctggcgcgaaacatcggcaatgccgcggcccagggcctcgatctcgcggccgagcccgtcgatcgcggcccggccttcggcggcaccgcgggcaccatcgcccatcaccgccacgatcgcggccatctcgctgcgcagcccatcgatgcgcgagcggatgtcgtcggtggcggcagcggtctgttgtgccaggttcttcacttccgatgccacgaccgcgaagcccttgccggcctcaccggcccgggcggcctcgatggtcgcattcaacgccagcaggcgggtctgacgggcgatcgcctcgatcgaaccgacgatggcatcgatctgttcggatgccgccgccagggcgtccacccggccggccgccgcggtgacgccgtcggcgagcgtcgcgaccgaccgggccgaggcacgcagctggcgcacgccggcctccgcctgttcattggcgacggccgccgcttctgcggcccggcgcccgccctcgcgcacccggttgccgctggcggcaagttcggccacggccgaggcggcgccggcggtgcgcgcctccaggtcgcgggcggccgcgacggcatgcaccacgcccacactggcttcggccgagtcgatgcacgcaccgacgatgcgatcggtgtcttcacgggcctgctcggcaagccgggcgccgaggcggagaatggccaggcccagcgggtcgttcgccgtggggggcgtggtgtcatagcggccctgggtcagggcgtcgacataggcgatcagcgcgtcgccggcagaggtgcctgcggccaggggggcgttcacgatgggggtctccggtcggtgtcagccgcgcaaggcggtcttgagcgcatcgatggaacgggcgacggcgtcgcgcgcctgatcgagcgcgcccgcggtgttgatgaaaccgtgcagcatgccgggatagacccggtgttcgaccgtgacacccgcccggctgagcgcctcggcataggcctggccttcatcggcaagcgggtcgcacccggcggtgacgatcagcgccggcggcaggccacggtgatccgtggccctgagcggcgaggcccgccagtcgacggccgccgcccggtcgggcaggtactggtccaggaaccaggtgatggtggcgtcgtcgagcagatacccctgggcgaaatcgtcgcgcgacgggtgacgatgggcgaggtcggtggccggatagaccagccattgcagccggggcaggtgcatgccgtcgtcccgggccgtgagtgctaccaccgccgacaggttgccgccggcgctgtcgccgccgatcgcgaggcgttcgggatcgatgccgaagcgggcggctgccccgggcagggcggcccaggcggcgatcgcgtcgtcgaccgcagccgggaagggatgttcgggcgccagacgataatccagcgagatgaccgcaatgccggccgccgccgcgatatggcggcagagccggtcataggcgttcaggctgccgatggtccagccaccgccgtgaatgtaaagcagggccggcaggggagccgcatcgggatcgagggccgccggccggtagagccggaccggcagatcgatgccctcaggcccgggcagggtgtgatcctcgaccaccggcagttccgcccggggcagatccagcagcaccaccacctcgtcgaacatccggcgtgccgcctctacccccatcttcggatagggatcgcggccggacgccttgaccagatccaggatccaggccgcctggggatcgggggtgcgattgcgggtgctgctcatgcgggcggggtctccatcggtcaccgggtgcggcggggccgcggcaacagttttgcgccggagacgggtcgggatcaacggcaaccttggcggacatgtgctcacttcgccgcggcggcttcggcctcggcgacggttggggtggcatcgacatgcgcaagcacaagatcggcaagacgatcgtaatccccgtcgaaatgatggccgcccggcaggggaatcaccgtcgcatggccggtgagtttggggcaggccgagacatcggtctcgtcggttccgtaaacgcagacgatcggcggatgggcgagtgccagcgcgggcgccaccacatcggtcgattccttgtgcggctcgtccagaagccagtcgcccggatgcacctcccagttcgcccaggtgtttgaggtgagcatcaccgccagaaccgagcggtcgatcagatccccgggcagccgggctgcgacatcgggcaggatgccggcgccgaaagaaaagccgatcaggatcaaccggtcgcgcttccagcgggccatccgatcggtgatcggcggcgccagatcgcgggccacctcgtcgggggtgcggcgggtccagaaataatgcagcgcatcgacgccgagcacggcgacgccgcgggcttccaggcgggcggcgagatcgcgatcgagatcggcccagccgccatcgcccgagatgatcaccgccagatcccgggcatggggaccatgtgcgccgtcggccggttcgtcgatcagccagtcggcacggatcgtatcgtgttcgggttcctgcgcggcgccgccatggacggcgcagagcaggaccagcactgcaagatgcgccacccggcgcagcgaccgccagatcatcgtccgatgacccctttgatgccgcccgagatgagtgcgacgacgtcgagcccgacctgcggcagggcggtgccgccaggcgaggcgaggtagcgcggccgccagtcgggcaggaatttctgcttgaagcggcgcagtccctggaagttgtagatgccctcgccgtgttcgtagatgaaggtgccgacccggctccaggccgaggcgagcgggttgtcgggcaggccggcgaggggggtcatgcccagcgagaagtacttccagccggcatcacgggcgtggagcatgatctccaccatcatgtagtccatgattccatagcccgcatcgggcagatggcgcatcagatcgagcgccatttcctcgtgcccggccgacggccagagattggcgaaggcgacgatccggccgttctggcggacgactgcgatcgggcagcggttcagataggcgggctcgaaccggccgagcgagaagcgcttctcgcgtgcctgacgctgctccatccagacatccgagaccttgcgcagttcgggcatcagcagccgcgcctcgcccggggccagcatctcgaaactggcgccgtccttgatcgcgcggcgatgggcatagcgcagctccgcccgcggcttgccttcgagcgagaactgcgcgagcggcaccaccgcctcctcgccgagcttcacgatcctgaggcccagatcgagatagagcggcagggcctcggccgagacctggtagaagaccgggatcgcgccatgggcatcgcagagttcgcggaacatccaggcgacattggcccaggcatggcgcggcccgaccgggtcgcccatggcgaccagcgagcggcccgaggcggcatacatcacaaaagcgtcgccgcattccgagaagatgaagctcttgtcgccggtgaaggcgagctgggcggcgctggaggtggaggtcgcgacgatccgttcggcctgaaccaggtcttcctcggtcggggggccggggcgggcacggacgggggcgaagaggcgggcggcgaacagcaccagcccgagcgccagcaccgcgaccgtcgcccgaagactgcgcggtgcctcggcttcgagcgcaaaggtgaacaggccctgggagaacagggcttcgtgacggaacgagaaccaggcgagccaggcggccgcccccaccatcatggcgagcgcgcccacccaggccggggtcatcggctggcgcagcagcgagccgcggcgatagaaggcccgacgcgcgaggaccagaaggcccgtcaccacggcaagcaggatcgcctcttcccagtcccaccccttgagcagcgacaggacggcgcccaggcccgaaagaatggtggcggccatccaggcggcgtccacgcggcgggcgaggccgcgggcgatcaccagcagcagcaggccgaccacgccgctggccagatgcgaggcttccaccacgaccagcggcaggccgtccagcagatcgagccggccggtggcggcgggggtcgcggccgaggcgagcagaacggcgccggaagcgatggcgagcagggcaaaggcaatgggcgcgatctgggccgcaccggccccggcccgacggatcgccggcgccatgcgcccggccgcccggccggcctcggcgagcgcgatcagggtggcggccaggatcagcggcaccaggttgtagacgaaacgatagacgaccagcgcgcccagcacttccggtgccggcacgccgggcaggaagagcaggacgatgccttcgaacacgccgagccccgccgggacatgggccagcacgcccgccacgatcgcgaccacatagaggcccaggaaggccgggaaagacagcggcaggtctgccggcagcagcacccagagcaccgcaccggcagcaatcagatcgccgatcgcgagcagggtctggccgatcgtgaccggcagggccggcacggcgatccgccagctgcggacatggatgccggccccccgcgcggatgccgtggcatagatcagaaagaccgccagcgccagaatgccggtcagatggaccacggtttcaggcaggttgagcgcggctgcgaccctggtcccttcgaacagcccggcaagcccgcccagggtgacggcgcccagcgtgaaggcggtggcgcagaacaccatcaacttcgccacggcggcgggcggcacgccggcattgccatagacgcgcagccggacggaggtaccggtcagggcggcaaaaccggccgtatggctgatcgcctgggcgcagaaggcggcaaaggcgatgcgcgggaacggcacccggatccccgaggatctgagcgccagcgcatcgaagccgataagcatcaggaaggacagcgccgtcagcccgcagccggcggcgacgtcgatcatgccgacattgccgattgcggcgcggatgtcctcgaaggacatggtccgggtttcgtaatggatcacccagagcgccagtccgaacacggcgaacatcgcgatcgctgcggccggccgcaggatctggggtgccagcaaccgtgccaaacgtccttgcccgttcatcccgttcctcgtcgctggaccagccagatgcgaacattcctctacccgtccgggccggacgggatgaaggaacgacactatccggccgtctgcgcggggggacaagcgacaagaagaccggcccttcgggcaggcccgcccgtcgggatcatcgatcccgacgggatacgccatccgtggttaagaaatcttccgcgtgggatcgggttccgcagatgagcctcaggaggcgccggccaccagcgggcagccgccttcggacatcggccggacgacctgttcggccggaatgcggttcagcacagtgtaatagtcccagggggccttggactcggccggcgatttgacctgcaccaggaacaggtccttcatcatccgcccgtcggcgcggacatgggcgccttcgccgaagaagtcgtcgaccggcagctccttgagtttcttcgacaccgccatcgcctcgtcggtgccggccgcctggatggccttgaggtaggagagggtggcgctgtagacgccggcatggttgtgcgtgggggccttgtcggtcttcatcgccgcccgccagcgaccggtgtagtcgcgcgaggcatcattccggtcccaatagaacggggtcaccacctgcaggccctgcgcggcttccagacccagcgcatggacgttcaggatatagaaggtggtgccggccagcttctgcccgcccgcgaccaggccgaattcggcggcctgtttgatggtgttggtggtgtcgccgccggcattcagcagggcgatgatcttcgcccccgatgcctgagcctgcaacacgaaggagctgtaatcggtgttgccgaccggatggcgtacctggcccagcaccttgccgccggccgcggtgatcacccgggtgagctgcgcttccatggcatggccgaaggcataatcggcggtgatgaagaaccagctgtcattgccggcttcgaccgaggccttgccgatggcattggcgatggccgtggtgtcgtaattccacagaaagccggtgggcgagcagcgcgggccgaaaagcgcatccgaggccgagctgacatgcatgaccacgcgccggcccgcggtcagatcctgcaccgcgagcgagaccgccgagttgccgaagtcgatgatcatgtcgacgccttcggtatccacccagcgccgggcgagagagacgccgagatcaggcttgttctgatggtcgcccgagatcacctcgatcggcttgccgagcacggtggggccgaaatcctcgaccgcgagccgggcggcggcgaccgagccttccccgccgaaatcggcataggcaccgctgcggtcgttcatgaccgcaatccggaccacatcgtcggaaacctgcgcctgaccggccgcagggaacagcatcagagcggccgcagcgatcgcggtcctccagcgagacgtcatggatgtcctccccaggacgatgggttccggcgcgaaaccaggggcccgcgcgtgccaccggagccgccggtccgagtggatggcggttctttattctaactgttgttagattatttactcacgggtaaggtatatgctcatgggttcaggcgtcaagtatccctgcaacgaaaaccgcgggaccgcatctgcggccaagaaaacagcgccctgatcaggcagaatgccggaaggaacccggttgtcttccctgcatcgcagcaatctattgcgttgcatcatgaaaaatgcaccggagcccggtgcggcgacacgaagaaagaccagggtgggcgtcacgaatccacccgctccagggaggttcacgtgaacggacttatgcaggacatgccgctgctgatctcgtcgatcatcgagcatgcggcgcgggcccatggcgccacggaaatcgtcacccgcaccaatgaaggcccgatcctccgcaccagctatggcgaggtcgcagcccgggcacggcaggtggccaatgctctggcggcacttggcatcgccgagggcgaccgggttgcgacacttgcctggaacacccatcgccactacgaactctatttcggcgtttcgggttcgggcgcggtcctgcacacggtcaatccgcggctgttccgcgatcaggtcgccttcatcatgaaccatgccgacgaccgggtggtgttcgtcgacctgaacctggtgtcggttgcggaaagcgtcgccgccgatctgcccggcgtgacccattgggtgatcctgaccgacgacgcccatatgcccgagaccagcttgcccggtgcgctctgctacgagacgctgatcgccgcccagcccacggagtatgactggccgcagctggatgagaacgcggccgcagtgctctgctatacctcgggcacgaccggcaatcccaagggcgtgctctacagccaccgctccaccgtgctgcacgggttgatcagctgttcggtcgacagcaccatcgcagcgtctgcggcagagacgatcctggttctggtgccgctgttccacgccaatgcctggggcgtgccctatgctgcggccatggccgggtcgaagctggtcttccccgcctcgaaactcgaccctgcgagcatcgtggagctgatcaacggcgagggcgtcacggtcagtggcggcgttcccacggtgtgggtgacctatcttcagcatctggaccagcaccccgaggaccggccgacccggctgaagcgggtcttcgtggggggcagtgccctgccgcgcgcgctgatggaacgcttcgatcgcgagctcggcgtgaccatgattcatgcctggggcatgaccgagaccagcccgatcgtgaccgtggccctgccgctggccaagcatgaggggctggacgaagaggcgctgcgcagcctgcgcctgacccagggccggccggtctatggcaccgaggtccggatcgtcgacgaggcgggcacaccggttgcccatgacggccggacgcccggcaacgtccaggttcgtggaccctggatcgtgaagggctatttcggccgcgacgagctggcggtcgacgatcggaactggttcccgaccggcgatgtcggcaccatcgatgccgacggctatctgcgcctcaccgaccggaccaaggatgtcatcaagtcgggcggcgaatggatcagctcgatcgagatcgagaacgaggccgtgtcccatccgggcgtgctggaggcggcggtgatcggcgtgccgcatccgcgctggcaggaacggccgctgctgatcgtcaccccgcgggcgggcgcggagctgacgcgcgagcaggtgctggcccatctggagccgcgcatcgcgcgctggtggatgcccgacgacgtggtggtgctggatgaactgccccacaccgccaccggcaagatctggaagatcaagctgcgggaggccttcaaagactacaggctgccgacggcctgatcgccttccgccccgtcgccttccccgggggcctctccccgcgcctcgcgccggagccggtagaccagctccagcgcggcgcggggggtgagatcgtcggggtcgagggcggcaagacgggcctgaagcgccagcgccgcctcggcttccggatcgggctccggtgccgccggcgccggcggcggttccggcaggcggaggctcgcgaacagcggcagatcgtcggcgagttttgcggccggagagccggcctcgccacgctcgatctggcccagcacggcctcggcccggcggatcacccgcttgggcaggccggcgagccgggcgacatggatgccataggaccggtcggcggcaccggcggccacctcgtgcaggaacaccacctcgccctgccattccttgatccgcatggtatggcaggacaatcggtcgagccgggccgaaagggcggtgagctcatgataatgggtggcgaacagcccgcggcagcggttgacgtcgtgcagatgctccaccaccgcccaggcgatcgacagaccgtcccaggtggaggtgccgcggccgatttcgtccaggatcaccagcgcccggggaccggcatgattgaggatcgtcgcggtctcgaccatctcgaccatgaaagtggaccggccgcgggcaaggtcgtcggccgcacccacacggctgaacagccggtcgaccacgccgatccgggcgcgggtcgccggcacgaagctgccggcctgggccatgaccgcgatcagggcgttctggcgcagaaaggtactcttgccggccatgttggggccggtcagcagccagagcccgggcccgccgtcacccacgggctgtccgtcaggcccccccagatcgcaatcattggcgacgaagcggccgccgccgctcgcctccacgaaggcttcgaccaccggatggcggccgccttcgatcgcgaaggccgtgctgcggtcgatgtcggggcggacatagttgcgggcgcgggcaagttcggcgagcgcggccgagacgtcgatcaccgccagggccgctgcggccgcggcgatcccatcggcggccgcgacgacctcggcggtcagctgttcgaaggcctgaagctcggcggcgagcgcctgatcggcggcgcgggtgaggcgggtttccagctcgccgagttcgacggtggtgaagcgcaccgcgttggcgagcgtctggcggtggatgaagccgtcgcgcccggccagcttgtcggcatgggcaggggtgacctcgatgaaaaagcccagcacgttgttgtgcttgaccttgagcgaggtgatgccggtgtcgcggcggcattcgccttcaagcgccgcgatatggcgccggccttcggtggcaagcgagcgcagttcgtcgagcgccggatcgaactgacgggcgatgaagccgccatcgcgggcgagcagcggcggttcggcctcgatggcggtgcgcagccgatgggccagcgcgccatgagagccgagggcggcaaggccccggcccagttcctcgggcaggtcgccgaaccccttgccgtcttcaagaagccggtcgcggatctcgccggcccggaaaagaccgtcgccgatggcgcgcaggtcgcgggggccgccgcggccgagcgacagccgctgcagggcgcgctccagatcgggcatgccgcccagcaggtcgcgcagctcttccgagagcaggtcgtcgtcgagcagatgggcgaccgcatccagccgggcgccgatcgcctccgggtcggtcagcggcgccgacagccggcgggcgagcagccgggcaccgccgccggtgaccgtcagatccatcagccccagcaggctgccgcgacgctcgccggccatggtctggacgatttcgaggctgcggcgcgtggccggatcgatcgccatcaccgtctccaccccctcgcgccggggcggcgacagatgcggcacgcggcccttctgggtgagggtgacgtaatcgatgagcgcgccgcaggcggcggcctcggcgcggctttcgatgccgaaggcgtcgagggcgccgaccccgtaatgctccatcacccgcttcgtcgcggcgcccgggtcgaaaagggcggtgggttgcggggtgagggcggggccgagttcggccagggcggccgcgatctcgggtcgttccagcagccggtcggcgaccaccagttcgcagggctccagccgcgcaagctcggccgccagcgccgccatctcgatgccggtcaccgcaaactcgccggtcgagacatcgacccaggccagcgccagacgattgtcggcccgggcgagggcgaccagattgttcgatcgccgggcatcgagcagcgtgtcttcgacgatggtgcccggggtgacgacgcgcaccacctcgcgccggaccagggccttgtacccgcgctggcgccgggcctcggccggatcctcggtctgctcgcagatcgccaccctgtggccggcgcggatcagccgcgacaggtagtgctcggccgcatgcaccggcacgccggccatggggatgtcctcccccttgtgctggccgcggcgggtgagggtgatgtccagcgtgcgcgccgcctcgatcgcatcgtcgaagaacagctcgtagaaatcgcccatgcgatagaacagcaggcagcccggatgctcgcgtttgaccgccagatactgggccatcatcggcgtggcaccggcgatctcgtcgtcggccgctgcgtcggggcgctcgtcgggggtccgctggcgggatctggtcatcgggcagctcggcagaagggggttggccgcaagggcgcaggcgggccggccgaccctagcgcgagagcccggcacccgacaagggccgctaccggccccccgcgtccggggcgggtttcacccgtcgacacatggaccggcttcggctataaaaaaacggacaaccgcgaccttttggaataatgcgaccggaagccgatgatttataaaactgtatgacccatcggcggtgccctctctgccgatggcggcggagacggagaacggtgcccgcggccccctgcctgcacggcatgtggccccaatcatgtcgcgcgacgatctcttgaaatttcgttacagtgtctgcctttcgtgacccgcgcaagggttgcggccgttttgcggcctggggggcgggccgtcgtcttgacctcagagaagatcaaaaacccgaagggctacccggatggatggcgagaagtattacgtgaccgagcaggaggcgctggagttccaccagggcgaccggccgggcaagctgtcgatcacgccgaccaaggcgctgatgacccagcgcgacctgtcgctcgcctacagccccggcgtcgcctggccgtgcctgcacatcaacaaggacgagaacaaggcctacgactacacgtcgaagggcaatatggtcgccgtcatctcgaacggcaccgcggttctcggcctcggcaatctgggggcgctcgcctccaagccggtgatggagggcaaggccgtcctgttcaagaagttcgcggatatcgatgcggtcgacatcgaggtctcgaccgaggacgtcgaggaattcgtgaactgcgtgcgcttcctgggccccacctggggcggcatcaatctggaagacatccgcgccccggaatgcttcatcatcgaacagcgcctgcgcgagctgctggacgtgcccgtcttccatgacgaccagcacggcaccgcgatcatcgcggcggcggggctgatcaacgcgctcgacatcaccggcaagtcgctgcgcgacatccgcatggtggtgaacggcgccggcgcggccggtatcgcctgcctggaactggtcaaggccatgggcatgccgcatgagaacgccatcctctgcgacaccaggggcgtgatctacaagggccgcgagcagggcatgaaccagtggaagtcggcgcatgcggtggaaaccgatgcccgcaccctggccgatgccctgaagggcgccgacgtcgcgttcggcctgtcggccaagggcgccttcacccctgaaatgctggcctcgatggcgccgaagccgatcatcttcgccatggccaatccggaccccgagatcaccccggaagaggtcgcccaggtccgcgacgacgccatcgtcgccaccggccggtcggattatccgaaccaggtcaacaacgtgctgggcttcccctacatcttccgcggcgcgctggatgtgcgggcgaccgagatcaacgagcagatgaagatcgcggccgcctatgcgatcgcgagtctggcgcgcgaggacgtgcccgacgaagtcgcccgtgcctatcgcaaccgccgcatgcagtacggccccgactacatcatcccggcgccgttcgatccgcggctgatgtcgaccgtgccggtggcggtggccaaggccgcgacctcgaccggcgtcgcccgcaagccgctggtcgatgcgccccgctatgtccgtgctctccgcgcccggctcgaccccaccgccgacagcctggagcggctgatcgagcgggtgcacgagaacccgaagcgggtcgtctttgccgagggcgaggaagagcagaccatccgcgccgccatccagtgggccaagtcgggcctgggcaagccggtgctgatcggccgcgaggagcggatcaaggccagcatgctgcgccttggcctgggcgatggtaccgatctcgatatcgacatccacaacgcccggctgtcggaaaagaacaaggtctatgccgacttcctgtacaagcgcctgcagcgccgcggctatctctaccgcgacgtccaacgcctggtgaaccaggaccgcaacgttttcggtgcctgcatggtggcctgtggtgacggcgacgccctgatcaccggcctgacccgcaactactgggtcgcgctcgagaacgtgcagctggtgatcgatcccgagccggacgagaccctgatcggcctgtcggtgatggtcagccgcggccgcaccatcgtcatcgccgacaccaccgtgaacgagctgcccgaggccgaggccctggctgatatcgccatgcaggcggcggcatcggcgaagcgtttcgggctggagccgcgggtggcgctgctgtcctacagcaatttcggcaacccccaccgcgagaaggccgaccgtatccgtgcggcctgccggatcctggaggagcgcggggtcggcttcgagttcgacggcgagatgtcggccgatgtggcgctggatgaagagctgatgcagcgctactacccgttctcgcgcctgaccgggccggccaatgtgctggtcatgcccggcctgcacagcgccaacatctcggccatgctgctgcagaagctgggcggcggtgtgcagatcggcccgatcctgcgcggcatgtcgaagccggtgcagatcgtgcagatgggcgcgaccgtggccgagatggtgaacatcgcggccgtggccgcccatgacgccatcctcgaccaggaggagaagaccggtcgctgatcgcggtcgctctccctctttcgcggttcgcctctgcctctttgcgacgcgcgtgtccccggggatgcgcgcgtcgtaaaactttcatgtccaggtcgcttgaccgcccgccgggctcgggcagtctggcgggccgcgcccggtgccggacccacggcggcaagtggatgcggggacagatgcggcgcgcagagacgcggcacggccgatggcgggtggacatggcggtattcgaccggaacgagatcaggcgcttcttcggcgcgacggcggcgatcgcggcccctgccgtgggtacgctcggcggcctgtgttttgcgggcgcgctggactggcactgggcgctggccggtgtggtggtctcggtcgccggctccatggccgtcgcccgcctgctgctcggcggcttccatgccctgcgggattttgccgaggcgcttgcccatggcgaggaacgcccggccccgccgcccggcgggcggatcgtccaggacatcgcccgtgcgatgctccggctctggctcaaggaacgccgccgtgccgagcggctggcggttcaggccgatgatttcggtcagattctcgaccggctgcctttgctggtgctgacggtcgatgatcaggtgcggatccgctcggccaatcgtgccgccgaagagacgatgggcgaggggctggtcgggcgcgagctggttgccgtgctgcgccatccggccctgctggatgcggtcgatcaggcgttgatgcggggtgaattcgctgatgtggtgttctccactgccgcccccgaccggcgggaatacaaggcgcatatcgaggccttgcgggccggcgatgagcataccgaggcgcgccgggcagtgatcgccctccacgacctgacccagatccgcaagctggagcagatgcgcgccgattttgtcgccaatgccagccatgaaatccgcacgccgctcgccactctgatcggcttcatcgagacgctgcgcgggcccgcccgcgacgatccggatgcggccgagcatttcctgtcgatcatggacgatcaggcccggcggatgtcgcggctggtcaacgacctgctgtcgctgtcgcggatcgagatgaacgaacatatgccgccggctgcggcggtcgacctgaccgatgtgatcgacgacgtcatctcggggctggagttcaaggcccatgcccgggggatcgagatcgagatcatgaccgatcccaccctggtgccggcgctgggcgatccggacgaactgacccaggtcgcccagaacctgatcgacaatgcgatcaaatacggccgcaacgacagccggatcaccgtgcggctgttccgcacgaccgaggcaccgcggccggttgggctggccgcaaccctggaggcggtgggcttctcggtgaccgaccagagtgacggcatcccgcgggagcatctgccgcggctgaccgagcgcttctaccgggtggacagcgcccggtcgcggcaggtcggctccaccggtctcgggctggccatcgtgaagcacatcgtcaaccgccatcgcggccatctggcgatcgacagccgggtgggcgaggggtcgtgctttacggtctatctgccgctggccggccgcggcaacggccgggcgccggtggcggccgcttcctgacatccctgcacgccatcctgtgcgctgctgccatggccgcttccgctgccccgtgaacccggattcatgctatgagctgaagaaccgccctgcggtgcaagaagatcgaagcttgagggaacgccatgtcggatctgatccgccgaaacaccatcaatgatgccgtgcgccgtgcggccgccaagttccgcgaccgtctggcgctccgccatggcgaccggcgctggagcttcgccgaggtgaaccgcgccgccgatgccatcggtcgccggctgatcgaggccgggctcggccgcggcgaccggctggcggtctatgcccgcaattccgacacctatctgctggtctggctgggcgccctccgcgcaggcctcgtccacgtgccgatcaactacgcactgaccgagaccgagctgcattacatcgtggagcagtcgggcgcccgcggcctgatctatgacccggatctggccgaaaccgcccgggcggtggcggggcgggtggatctcgccttcgccgtcccgatgacgggcgatgcggatttcgacccgctggaggtcgcgctgggctcggccggggcagagccgctggaggtcgggcttgccgacgaggatctggcgcagatcctgtacacctcgggcaccacggcggcgcccaagggcgcgatgatgacccatcgtgcgttgctggccgaatacaccagctgcatcgttgaactgaacctgaaaggcagcgatcgggcgctcgcagccctgccgctttaccattcggcgcagatgcactgcttcaccatgccccagctgctggtcggcgccaccaccatcctgatccagaccccggtgccggagcagtgcctggcgctgatcgaggaagaggccatcacctcgttcttcgcgccgcccaccgtctggatcagcctgctgcgccatgccgatttcgaccggcgcgacctctccagcctgaagaacgtctattacggcgcctcgatcatgccggtgccgatcctgcaggagctgcgccggcgactggccggggcccagccctataactgctatggccagagcgagatcggcccgcttgccaccgttctcggccccgacgagcacgaggcgcgccccgcttccgccggccggccggtgatgaatgtcgagacccggatcgtcgatggcgagatgaacgacgtgcccccgggcgtgcagggcgagatcgttcaccgttcgccgcaactgctgaccggttactggaacaagccggacgagaccgcagacgccttctctggcgactggttccattcgggcgatgtgggttatctcgacgacgagggctatctctatgtcgtcgaccgggtgaaggacgtgatcaagaccggcggcgtgatcgtggccagccgagaggtcgaagatgccatcttcacccatcctgcggtctcggaagtggcggtgatcggcctgcccgatccgaaatggatcgaggcggtgacggccctggtcgtgctccggcccggtcaggaggtcgggatcgacgagctggtggcccatgcccgcgagcggctggcgccctacaaggtgcccaaggccgtgcatttcgtcgacgccctgccgcgcaacaccgccggcaagatcctgaagcgcacgctgcgccaggagtttgccgagcagggctgatgccggaatccgtgacggcagccatgcatccggatcaggccgcggcaggtcacactgccgcggttttcctttatatgacagtcgcttccggaaggtttccccggaggtatagacaactttccatagattgtcgatgggggcctccggcgtgctggcctctggattaaaccaagaaattacaaacggttgcttcgaaaacggtgcgggtcggctgcggcgaagtgtgtcatgattccgtcatgaaactgtgatattcccgtcgtcgagcaggattagaccatgtgtgacgcgaggccgggtggaaacacgacgccgcctgccgcgtttcgagatcgggaccggtggcgtgtctgccgccggccagcacacatgacgaacatccaacaggagttggaacggtgttcaagaaagccgcgcttctgtcggcggttgcgatcgttgcggtcgccactccggcccttgcccgcgatcagatccgcatcgtcggctcgtcgaccgtctaccccttcgcgactgcggtcgccgaagagttcggcaagacctcgggcttcgcgaccccggtcatcgagagcacgggttcgggcggcggcctgaagctgttctgcgccggcgtcggcacgcagcaccctgacatcaccaacgcctcgcgccggatcaagaagtccgaggtcgaggaatgcgccaagaacggcgtgaccgagatcaccgaggtgaagatcggcttcgacggcatcgtgctggcgaatgcggtcaacggcccggacatgaacatcacccgcgcccagctgtggcaggcgctggcgaagcaggttccggtcgacggcaagctggtcgagaacccctacaagagctggtcggacatcgacggctcgctgccgaacgagccgatcgaggttctcggccccccgcccacctcgggtacccgtgacgccttcgtcgagctcgtcatggagcatggctgcgaggaattcgacgccgtgaaggcgatcgaagacaagaagatgcgcggcgcggtctgcaagtcgatccgcgaagacggcgccttcatcgaagccggcgagaacgacaacctgatcgttcagaagctggcctcgaacccggccgccttcggcatcttcggctacagcttccttgagcagaacggcgacaaggtgaaggccgccaccatcgagggcaaggcgccggaatacgacgccatctcgagcggtgaatacccggtctcgcgctcgctgtacttctacgtgaagaacgcgcatgtcggcaccgtgcccggcatgaaggaatacgtcaccgagttcacctcggaagacgccatgagcccggtcggctatctggcccagcgcggcctgatcgccctgccggatgcggagcgtgccgaagtggcgaagaacgcccagggcctggttccgctgaagatgtgatcggatgagggctggctgtactggcataccggcgcagccagccccagccatcgcaagacgacccggcggctttcgtccggtgcaggctggcaccgccggagccgccgttcgcctgccggggcctaccctcccggccggcccccatccgaagcagccgcgacagaacggccgcatcgaacgtttcgtccgcgaccttgcggaacccgcgaacctgaagggcccaaccggcccgatgcctgaaggcagaggcggcgcatgacggtaagctccttcgtgctcatcgtgctgatcctgagcgcggtagcattcttcctcggacggcggcgctcggtgtcgcttgcgaacggcaggctctccaccctgcattcgcgccccggctattacggctggtatgtggcattgtggtgcggcctgccggcggtgctgctggcatttgtctggatcgtggcccgcacaccgatcgtcaacggcgccgtccacgacgtcattccggaagacgtgatggcggcaggcgccggtgccgtgaacctgttcatggccgatgcctacaaccttgccaccggcaacatcgtctcgtccaatccgagccccgcagtccgcgaggcggcatcgatcatcaccggcctgacccggacggtgaacctggcttttgccggcatcggtctcgccctggcgctggccggccttaccgcggcctatcggcggatcaccgcggatttccgctcccgcaaccgggtcgagcggatcctgcggatcctgctggtcatcgcctcgacgctgtcgatcttcaccaccatcggcatcgtgttctcggtgctgttcgaatcgatccgcttcttccagcgcatcccgatcctggacttcctgttcggcctgcactggagcccgcagatcgcgatccgtgccgatcaggtcgcctcggagggctcgttcggcatgatcccgctgttcgcgggcacgctgctgatcaccttcatcgcgctggcggtggcgatcccgatcggcctgctggcggcgatctacatgtcggaatatgccggtcgcaagacccgcgcgctggccaagccgctgctcgagatcctggccggcatcccgaccgtggtttacggcttcttcgcggcactgaccgtggcgccgctgatccgcggtttcggcgagagcctgggcatcgacgccgcctcggaatcggcgctggccgccggtctggtcatgggcatcatgatcatccccttcgtgtcgtcgctggccgacgacgtgatcaacgccgtgccccagacactgcgcgacggctcgctcggccttggcgccaccacctccgagacgatcaagctggtgatcctgccggcggccctgccgggcattgccgccgcctgcctgctcgccttctcgcgcgccatcggcgagaccatgatcgtggtgatggcggccggcctggctgcgaacctcaccgccaatcccttcgaggcggtcacgaccgtcaccgtgcagatcgtcaccctgctggtcggcgaccaggaattcgacagtgccaagacgctcgcggccttcgccctggggctggtcctgttcgtcatgaccctggcgctgaacgtggtggctctgcacatcgtccgcaaatatcgccaggcctatgactgagcgacgggagcaacaggtcatgaccgacagcaccctgaaccccgccgaggcaccgatggcccggcgggagagcccccatgccggccaggcggctgctgcccgcctgagggcacggcgccgctcggaacgccgcttcaaggcctatggctttggggccgtcctgctcgccatcgtcatgctggtcgtgctgatcggcacgctggcgggccagggcctcggcgccttcacccagacccagatcgcggtcgaggtcaatctggacccggcgcggctggatccgcaaggcacgcgcgacccgaaaacgctggccgatgccaactacaccggcctgctgaccgacatcgtccgcgacaatttcggcgccacccagcgccgcgacgtgctcaaggccctgggcctgttcagccgcgatgcccgcttcgaactgcgcgacttcgtgctggccaatccggatctgatcggtaccactcagacggtgtggctgacggcctcgggcaatctggacatgctcgacaagggctggatcgaccgcgacctgccccaagcccagcggccggtcgacgatcaggtgctcggctggtatgacgcgcttgccgccaaggacgccgtcagccgcgacttcaacacccgcttcttcaccggtgccgacagccgctcgcccgagctggccggcatctggggagcgaccgtcggctctgccctcaccctcttcgtctgcttcatcctctcctttccgatcggcgtcaccacggcgatctatctggaagagttcgcgcccaagaatcgctggaccgacctgatcgaggtcaacatcaacaacctcgcggcagtgccctcgatcgtgttcggtctgctgggtcttgcggtgttcatcggcttcttcggcatgccgcgatcggcgccggtggtcggcggcttcacgctggcactcatgaccctgcccaccatcatcatcgcgacccgcgccgcgctgaaggcagtgccgccctcgatccgtcaggcggcccagggtctgggcgccagcccggtgcaggtggtgttccatcacgtgctgccgctggccatgccgggcatcctgaccggcacgatcatcggcatggcccaggcgctgggtgagaccgcgccgctgctgatgatcggcatggtcgccttcatcgccgacgtgccgggtggcttcaccacgccgtcgacggtgctgccggtgcagatcttcctctgggccgacagcccggaacgtgccttcgtcgaaaagaccgccgccgccatcctggtgctgctcggcttcctgatcatcatgaatgcgatcgccgtcctgctgcgcaggcgcttcgagcgccgctggtaagccggtacgggagaccttacctcctcccccggccggggcgcccttcccggggcttcggccgggcggatcagagaccttcagcggagagcccgcccatgacttccggcctcgtgcccaagatgaccgcgcgcaagctgaacctgttctatggtgagaagcaggcactgttcgacgtcgatctcgacatccatgccaacagcgtgaccgcgctgatcggcccatcgggttgcggcaagtcgaccttcctgcgctgcctgaaccggatgaacgacaccatccccaatgtccggatccagggcgaggtgaagctggagaccgccgacatctatgaccgctcggtcgacgtagtacagctgcgcgcccgggtcgggatggtctttcagaagccgaaccccttccccaagacgatctacgacaatgtcgcctacggcccgcgcatccacggcctggccgacagccgcgaagagctggaccagatcgtcgagcggtcgctgaagcgcgccggcctctatgaagaggtgaagagccggctgcaggaaagcggcaccgggctttcgggtggtcagcagcagcgcctgtgcatcgcccgcgcgatcgcggtcgaccccgaggtcatcctgatggacgagccctgctcggcgctggacccgatcgcgaccgcgcgcatcgaggagctgatcgacgagctgcgcgagaactacaccatcgccatcgtcacccactccatgcagcaggcggcccgcgtgtcgcagcgcaccgccttcttccatctgggccagctggtcgagttcggcgacaccgagcaggtgttcaccaacccgcgtgaggtccggacccaggactacatcaccggccgcttcggctgaccggatctgcccagggagaccagtctcatgcccatttccggtcagcacatcgtgaaatccttcgacgaagagattgcgcgcctcggcaacgacatcgtccgcatgggcggtcaggtggaagcgcagatcgatctcgccatgcgcgccatcgccagccgtgacagcgagctggcgagcgacgtggtcgcgggtgacaccaaggtcgacggcctggaagacatgatcgaggagcaggtggtgcggctgtttgcgctgcgtgcccccgtcgccaacgatctgcgcctggcctttgcctctctgcgcatcgcggccgagctggagcgcatgggcgatctggccaagaacgccgccaagcgcgcgatcatcctgaaccagtcggcgccggttcggccggtgcatgtgctgccgcgcatggccgcggtggtgcagcgcatgctgaaggacgtgctcgacgccttcgtcgaacgtgatgccggccgcgcccgcgcggtctggcagaacgatgccgaggtcgacgagctgcacaacagcctgttccgcgaactcctgacctacatgatggaggatccgcggcacatcacggcgtgcacgcacatgctgttcatcgccaagaacatcgagcggatgggcgatcacaccaccaatatcgccgagcaggtgatcttcgtggtcgagggcaccaagcccgacaccgcccgccccaaggccgagaccgttctcgaccggtcgggcgacgccgttctcgacgactgacggcccggtggtccgtccggcggaccgcctcttcccctgcgcgcaccccgcccctctgaccggccggcacccccttcggggcctctggtgccggccaactagacttcctggaggacatccgagcgatgcgtccgaagatcatggtcgtcgaagacgaaaccgcgatcgttaccatcctgcgctacaacctcgaacgggccggtttcgccgtcgaggaggcgaatgacggcgaggaagcgctctggcgcattcgcgaggtgaagcccgacgtcctgttgctggactggatgctgcccaagctttccgggctggagctgtgtcgccagctgcgccgcgaccccgagacccgcaatctgccgatcatcatgctcaccgcccggggcgaggagaccgatcgggtgcgcgggctggacagcggtgccgacgattacgtgcccaagcccttctcgccccaggaagtggtggcccggatccgcgccgtgctgcgccgcatccgccccgccttctcggaagaggtgctgtcctatgccgatctgcagatggatctggcggcccacaaggtgacccgttcggccgaacccgtgcatctgggcccgaccgaattccgcctgctgcgcttcctgatggagcatccgggccgggtcttttcgcgcgagcaactgctcgacggcgtctggggtcaggacatctatgtcgagccccgcacggtggatgtgcatatccgccggctgcgcaaggcgctgaacggcgagaacctgcccgatctgatccgcaccgtgcgctccgccggctatgcgctcgatgcccagggcacggctgcctgacggtccccgcagcccgacttgatgtggacgggcgcccgcagccgggcgtagcatggggtgactgcccgaccggcagtttatggcgcgggggccccatgacgctcgacatctggttgatctatctggcggcggcggccgggctgtcgctgacgcccggaccgaacgggctcctgtcgctcaatcatggcgtgcgcttcggcgtgcgccgcaccgccttcactgcggcgggtggggtgaccggcttcatggttctggtcgcggcctcgcttgccgggctcggggcgctgctggcggcctcggaacaggctttcaccatcgccaaatggatcggggcggcctatctggtctggctgggcatccgcaccttccgcgcgccgccgccctcggtgacgctggccgatgccgggggccgcattgccggggcggggccctggcggctgttcacccagggctttctggtggcggtctcgaaccccaaggcgctgatcttcttcgccgccttcctgccccagttcatggtgccgggcgtgtcgttcctgacccatcttctggttctgggaggcaccttcgccgtggtcgaattcgtctacgagctgatcctggccggggccgcgcggcgcatcgccccctggctggggcgccatggccgctggttcaaccgggcgaccggtgcggcctttgtcggcatcggcggcatcctgaccaccgccaaccggatctgagccggccgcaacgccgctttccgtgaaaattcatcgtgtcagcggcgcttgaccgcgccccggcccgcgcgtgatataggcgcgtttccattgaaccgcgcatcgcggacccaagctccggccggcatccacacccggcgggcggtctgcggatgccgaaggcgaggaccagatggcgaggatcttctccggcgcacagccgaccggcaacctgcatctcggcaactatctgggcgccatccgcaactgggtgacgctgcaggatagttacgagtcggtgttctgcatcgtcgatctgcacgccatcaccgtctggcaggatcccaaggcgctgatccggcagacccgcgaactgaccgccgcctatatcgccgccggcatcgacccggagcgctgcgtgatcttcaaccagtcggccgtgaccgcgcattcggaactggcctggctgttgaactgcatgacgccgatcggctggctgaaccggatgacccagttcaaggagaaggccggcaaggaccgcgagaaggcgagccttggcctctatgcctatcctgtgctgatggcggccgacatcctggcctacaaggcgacccatgtgccggtgggggaggaccagaagcagcatctggaactgacccgcgacatcgcccagcgcttcaaccagctttacgaaaaggacgtgctgccgctgcccgagccgatgatcctgggggcggcaacccgggtgatgtcgctgcgcgacggcaccaagaagatgagcaaatccgacccgtcggattatgcacgcatcaacctgaccgacgaccgcgacaccatcgcccagaagctgaagaaggcccggaccgacagcgagcccggcgtgacctacgagccggagcgccggcccgaggtcgccaacctgatccggatctatgccgcgctggacggccgcaccaccgaccaggtggtggccgactatgccgacgcgcccttcactacggtgaagacgcggctgaccgaccttgcggtcgagaagctgggcccgatcgccgaggagatgaagcgcctgatggccgatccggccgagatcgaccggatcctggccaagggggccgatcgtgcccgcgccatcgccgacccggtggtggccgaggtgcgcgagacgattggtctgttgcggccgtgatccgcccgtagccttcgggctgcggatcttcacgacatgcccggatcgcggaaaaccgcggtcttcgggttgcaagcgccgacgggccggaccagaatggtccggcccggtcgccttcaggaccggtccccgcgccagacggaccgtcatgcagatctatctccccatcgccgagctgtcgatcgatgcgatcgcgatcctgctgatggggctgggtgtgggctttctctcgggtctggtcggtgtcggtggcggctttctgatgacgccgctgctgatgttcgtgggtgtgccgccaccggtggcggtggcgaccggggccaatcaggtggttgcggcctcggtgtcgggcctgctggcccattggcgtcgcggcacggtcgatgtccggatgggcggcgtgctgctgatcggcggtctggcaggatccggcgtcgggatcctgatcttccgctggctacaggcgatcggccagatcgacctggtgatcggcgtctcctatgtgctgttcctgggcgtgatcggcgtgctgatgggcatcgagtccgtccgcagcctgctggtccgcaatcagccggcgaagaagcgccatcagcacaactggatgcacgggctgcccttcaagctgcgcttccggaagtccaaactctacatctcggcgctgctgccgctggcgctgggggcgggggtcggcgtgctgaccgccattctgggcgtcggcggcggcttcatcatgatcccggcgatgatctatatcctgggcatgccgacgctggtcgtggtcggcacctcgctgttccagattctgttcgtgtcgatgaacgtcacgatcatgcacgcggtcacgaccgaggcggtggatctggtgctggcggccatcctggtgatcggcagcgtgatcggcgcccaggtgggctccaggctgaccacgaagctgcgcggcgagcatctgcgcggcctgcttgcggccgtggtggtgctgactgcaatcaagatcggtgccgatctggtgatccggcccgacgagctgttctcggccgtggtcgtggggccgggctgatggccgacatgctgcgcatcgccaggctgccggccctgttcgtctttctgctgaccctggcggccgcgctggtgacggcggtgtcgggtaccctgcgcgcccgggcgcagccgctggtggccgacctttccagccatctgatctccatcacctccagcttcaccggcaccgaactgctgctgttcggcgcgaccgaaggcccgggcgaggtgatcgtggtgatccgcggcccggccgagacggtcgacatccgccgcaaggaccgtatcctcggcatgtggatcaatgcccgcacgatccgcttcaatcaggtgccggccttctattgggtgggggcaagcgcgccgcttgagaccttcaccaacgaccagatgctggcccggcatcgcatcggcctcacccggctggacttccccggcggcgaggatgcggcccctgaggaacgcgccgtcttccgcgacgccctgatccggaaccgccagcaggccggcctgttcgtgcccgcggtgcagccgatctcgcgactgggggaccgtttgttccgggtgacggtcgcctttccgtccaatgtcaccaccggcggataccgggccgagatttttctggtgaacgagggccgggtggtggccgcgcagaccacgcccctgttcgtgcgcaaggacgggctgggcgacaacatcgcccgtctggcccatgaacagccgctcggctacggcatcgccgcggtgctgattgcgctgaccgccggctggaccgcaggcttcgtgttccgccgcttctgaggaggttgtcatccgatggccgacgagacttcgacccccgaacccgcggccgtgcccaagccccggcccgccgtcaaattcctggtctgcgtcgatggcagcgcccatagccgggtggcggtgcgctatgcctgccggcgtgcccgcgcccgtggtggccgggtgaccctgctgaccgtgatcgagccggccgagaaccagcactggatgtcggtcggcaatctgatggccgaggaactgcgcgagcaggccgagcaggtgctgcaggagattgcggccgaggtgaacgctttcgccggattgatgcccgaactgctggtccgcgtcggcccgatcggcgacgagatcctgcgccagatgcgcgaggacaaggatatcggcatgatcgtgctggccgcccgcccgccatcggaagggccgggcaagctggtgcgctggctggcaagccagctggcgggggagctgctggtgccgatgacgatcgtccccggcaacctgtccgaggacgatctgctgcgccttacctgacggcggcggcctctgccggcacatccacgccacaatcctcgcaatcctcgggcagggtatagacctcttcctcggtggcgagcccgcgcagatggaaggtgccgagcggttcgagcctgcggcccatatgctcgacgatccgggcgatggtcgacgagatcgcgaccgtgcggcccagatcccgggccagaacctccagccggcttgcttcgttgacggcctggccgatgacggtgaagtccagccgttcgggggcaccgatattgccgtagagcacttcgcccgcatgcaggcccaggccaaaggccagcggttcctgacccagcgcccgacggcgggcgttcagctccgccatgccgcggacggcatcgcgggcggcatccagcgccgcgcagccggcgaaggggcaggccccttcgcgcaccggggtcgggaagacggcgagcacgccgtcgccgatcagcttcatcacctggccgccatgggcggtgatcgcgcggttcatcacctcgaaatggtcattcagcgtggcgatcagcacctcgggcgccacccgttccgacatggcggtgaagccgcgcaggtccgagaaccagatcgcggcattcatccgttccacatcgccgcgcttgatggtgccggccagcacccgttcgccggcatcatcgcccagataagtcttgagcagggtgcgaacctggccacgctggctgatcacctccaccgccagcgtcaccatcggaagcagggacgacacccggcgcagatcgccctcgctgaagccgcccggattgcgggtggcgagcgacagggcgttgggcgtgccgtcatggaaagcgagcggcatcattgcgtagtcggtgaagccctcttcgtgcagatcggccaggatcggaaaatcgccgatctgggcattggggccggtcagccgccggcgcacgccgacgccgtgttcggcgacgagcatgaaggggctgcgcagatatgcctcggtcaactccaccccgtgggcgcgacggatctcctcgaccggctggtcgggtcgccattcgatcgacacgccgcggaattgcgggtccagaaggcgcagatgcagggtagcccgatcgatcggcacacctgctgccagcaaccgctcggacaggccggcgatcagctctcccaccggcaggccgggaccttcctgggcaagccactcaccgatcggatccgggcccagcaccgacgggaccgcggcggcacggcgcacgggtgtacgcggcactaagacgtcgtccaggcgttcggcttccatcatcggatcgtcctgcaggcggtggggcggggcgtgtcggcacaacgcgcccacgttcatatcgtggctcgatgtgcccgcgtcgagtggtaaagctcacgcctgcccgataattgcggaggtgtgactttcacgggcgctccagaagcctggggcctgccccctcacggcccagcgcatcgccgggattgcgcagcgggcagtccgccagcgacaggcagccgcagccgatgcagccgtccagctcgtcgcgcagcctggtcagacggatgatgcgtgcctccagcatggcgcgccagcgcgacgacatgtcctgccattcagcggcgctcagctttgcatcgggcggaaagggggcgagcgccgcaccgatgtcttcaagcgggatgcccgcccgctgggccactttgatgatcgcgatccggcgcagcaccgccgccgggaagcggcgctggttgcccgcgctgcgcatgctgcggatcaggccgcggctttcgtaaaaatgcagggtcgagaccgcgaccccggcgcgttttgcgacctcccccacggtcaggatccgatgggcatcgatgcggtcttccggctttgtcggcatcctccggttccccattgacctgaactttacttgaggttctatagtccggccgatccggtccggcaagcctgccggccttcattcagcaacgggatcggttccgtgacagggtttatcgaacgggcgctcgacagcgcctggctctggctgaccgccagggtctgcctcgccgtggtcttcgtcgcctcgggccttgccaaactggtggatttcgagggcgggctcgccgagatgcgggcggccgggctggaaccggccatcctgttcaatctgctgaccgcggccaccctgctcggcggatcggcggcgattctggctgacaggctggtctggctgggggccggcgtgctggccgtgttcctggtggcgaccatcctggtggtccacaccttctggtccaagaccggtgccgaggcgcagctcgccctgttcttcgcgcttgaacatgtctcggtggcgggcgggctgatcgcggcggcgatcgccagcgatcaacgccgccgattgcgctggagggggtgagcccatgtcccgcagtctgcttgcagggcttgcagggcttgcagggcttgcagtggtggctgccgccggcctcgccggggcctggtttcttctggcggagccccggccggccccggcggcgcccgcctggccggcgacgaaggtggcattggccacggccgaacgggtgacggtgccgcggcgctttcagggcgtgggcgaggtggaggccatccgacaggtgctggtggcggccgaaaccagcggccggatcaccggcatcgacgtcacctcgggcgaagcggtcaaggccggtacactgctggtgcagctgaacgatgcggtggaacgtgccgagctgcagcagcaactggcccagctgcgcaatgccgaggcccgtcttgcccgcctgaagaggctggtcgagcgtaatgccgcctctcgcgagcagctggacgatgcccaggcggagcgtgacgtgacggcggcggccgtcgcacggacccgggcgctgatcgatcagaaggcgatccgggcgccgttcgacggggttgccggcatccgccgggtgcatccagggcagtatctggaaaccggcgcgccggtggtgagcctggtcgataccagcctgcttcggatcaatttcgcactcgacgagcaggccatgccggagttgagcctggggcagcgggtagaggtttcggccgacgcctggcccgatcaggtgttcgtggcggagatcaccgccatcgacccgttgatcggtgacgcccggatggtccggatccaggcgacgctgcccgagcctgacgggcggctcaaagccgggatgttcgccggcgtgcgggtggtcagaccctccggccccccggcgctggtggtgcccgagaccgccatcacctataccgcctatggcgacagcctgttcgtgacgcgcgccgatccggcacgcgggctggtcgcgacccgggtggcggtcgaggtgggcgcgcgttgggacgggcgtgccgagatcgtctccgggctcgccgatggcgaccgggtggtgacctcgggccaggtgcggctggtggacggtatggcggtggagccggttgcgcatgacacgctcgaggtgcggccatgagcttcaccgacatcttcgtccgccgcccggtgctggcgctggtggtcagcatgttgatcctgctgggcggcgcggtctcgctcggtcagttgccgatccggcagtatccggcgctggagagcgccacgatcaccgtcaccaccgactatcccggagcctcggccgagctgatgcagggcttcgtcacccagccgatcactcaggcggtctcgtcggtggagggcatcgactatctctcctcgtcctccgtgcaagggcggagcacggtgacgatccgcatggagctgaaccgcgactcgacccgggcgatgaccgaggtgatggccaaggtctcgtcggtccgctaccgcctgcccgaagcggcctatgatccggtgatcgaacgctcggcgggcgattcgaccgccgttgcctatgtcggctttgccagcgacaccctgccgatgccggccctgaccgactatctgtcacgggtggtggagccgatgttttcgggcatcgatggtgtcgccaaggtccaggtcttcggtgggcagaagctggccatgcggctctggctcgatccggactggctggcggcccgtgggctgacggggggcgatgtggcggccgccctcaggtccaacaatgtccaggctgcccccggccggctggacgggctctatgtgctctcggacctctcggtcaataccgacgtcaccgacgtcgccggcttccgcgagatggtgatccgcgacgatgcccgcgggctggtccggttgggcgatgtggccacgatcgagctgggcgccgcctccacccagaccagtgcggtgatggatggtgaggccgcggtcttcctcggtctgtttccgacgccggccggcaacccgctggtgatcgtcgacggcatccgcgatcttctgcccgcgatcggcaagaccctgccacccgatgtccgcgtcgatctcgcctatgaaagtgcgggcttcatccaggcctcgatcgacgaggtgctgcacaccctggtcgaggcgctggtgatcgtggtggtggtgatcttcctctgcctcggctcgctgcgcagcgtgctgatcccggttgtgaccatcccgctgtcgatgctgggggcggcgggcctgatgctcgctttcggattcagtctgaacctgctcaccctgctcgccatggtgctggcgatcgggcttgtggtcgatgatgcgatcgtggtggtcgagaacgtccatcgccatgtcgaggaagggcgcacgcccttcgaggcagcgctgatcggcgcccgcgaggtggcggggccggtggtcgccatgacgctgacgctggctgcggtctacgcgccgatcggcttgatgggcgggctgaccggggcgttgttccgggaattcgccctgacgctggccggatctgtggtggtctcgggcgtggtggcgctgaccctctcgccggtgatgagttcgctgctgctgacggcgaagcttcatgaaagccggatggcgcgggtgacggagcgggttttcggcgggctgacccgcagctacgggcatctgctcggcctgtcgttgcgccatcgctgggcaaccgggctggtggcgctgggcgtctgcatcagcctgccgctgctctaccagatgccggcgcgggagctggcgccggtcgaggatcaggcctcggtcctggcggcgatcaagtcgccccagcatgccaatctcgcttatgccgagcggtttgcggcccggttggacgaggtgttcgcggcgatgcccgagacggtcggcacctggatcatcaacggcaccgacgggccgtctgcaagcttcggcggcgccaatctctcccgctgggaggcccgcagccgcacggcgtcggacgtccaggcggggttgcagcaggcggtggccgaggtggagggcagcgcgatcttcgtgttccagccggcgccgctgcccggctccaccggcggtctgccggtgcagatggtgctgcgcacgcccgagcctcatgacgtgctctaccgaaccatggaagagatcaagcaacgggcgcgggagagcgggctgttcgtggtggtcgacggcgatctggactatgaccggccggtggtgcaggtggcggtcgaccggaacaaggcggcgagcctgggcatcgccatggccgatatcggcgagacgctggcggtcctggtgggcgagaactacgtcaaccgcttcgccatggccggccggtcctatgacgtgatcccgcagagcgagagagccgggcgtctgacgccggacgccctcggccgccagttcctgcgcagccgcgacggcacgctggtaccgcttcgggcggtcgcggagatctcgatgcgggtggagcccaaccggctcagccagttcgaccagcagaatgccgcgaccatccagaccattccggcgccgggcgtctccatggggcaggcggtcgcgtttctcgacgccgaggcccgggccttgccggccggattcagccatgactggcagtcggattcgcgccaatacgttcaggaaggggcgagcctcgtcatcgccttcctggcggcgctggtggtgatctatctggtgctggccgcgcagtatgagagcctggtcgatccgctgatcatcctgatcaccgtgccgctgtcgatctgcggggcattggtgccgctggcgatgggggcggccacgctcaacatctatacccagatcgggctggtcaccctgatcgggttgatcgccaaacacggcatcctgatggtcgagtttgccaacgaattgcagctgcatgaagggctggcccggcgcgaggcgatccggcgggcggcggagatccggctccggccggtgttgatgaccacggcggccatggtcttcggcctggtgccgctgctctttgccgcaggggccggggctgcaagccgcttcggccttggggtggtgatcgtctcgggcatgatggtcggcacgctgttcaccctgttcgtgctgccgaccgtctataccgtgctcgcccgcgatcaccgcccggggcatgcaggagtgccacaggaggggatcgtgcagaacggggctgcgtcgaagacgtcttgatcccgccggatcgaggtgccaaatcagggcacgacagacggcatgggttccgtcacccgaaagccgcagagaggatcaggtccgatgttcatccagaccgagcggacgcccaatccgctgacgctgaagttcctgcccggccgggatgtggccgagggcggcgcccagttcgcgcgcggcgacgacaccgcccgctcgccgctggccggcaccctgcttgccatcgacggcgtcgaaggcatctatctgggggccgatttcgtctcggtcaccaagtccgaacaggccgactggatgctgctgaagccgctgatcctgtcggacatcatggagcacttcacctcgggccggcctgtgctgaccggtgaaggcgatgcggcagccgctccggccgtcgacgaggacgaggtgacggcgaccatccgcgagctgatcgatacccgggtccgcccggccgtggcccaggatggcggcgacatcgtgttcgagggtttcgatcacggcatcgtctatctgcagatgcatggtgcctgctcgggctgccccagctcgaccatgacgctcaagaacggcatcgagaccatgctcaagcactatgtgcccgaggtggtcgaggtccgtcaggtctgagccgaccttccgcgtgatgacacgccgctaccgtctcgcctgcctggccgtcgccgttgcggccgggctggtcgcgttcgggtccgctctgggcgtgctgccgcggccggccggcggtttcggcctgtcgccggcgacgctcgcggccctggatctccgccgtgccgaggcggcggcgcccggtgcgctgccggccgagctggccggtgcgctcgataccgacacccgcaaggccctgtttcgcgacacgctcgaccccgccatccgggcggtgaatgcccgggtgcggctggaacgggcgctggtgacgctggcggccgatgcccgggcggaaggacgccggccgccgcgcgggctcaaggcgcgggtcgcagccatcgccgcccgctacggcgttcccgccgacgatccggtgcgtctgctggtgcgggtggacaccgtgccgccggccctgatcactgcccaggcggccctggaaagcggctggggccgctcccgcctggcgcacgacgcccatgcgctgttcggcgagcgggcctggcggctggccgacggggtgatgccgctggcgcgcaagcgcggggcggcccatgtcgcgcgcgccttccccgacatcaccgcctcggtcgcggcctatgtccacaatctgaacacccaccgcgcctatgccgccttccggcgccaccgtgccgaggcgcggctggacggcaccttgcccgatccgctgcagctggcgggcggcctcagcgcctattcggagctggggccgcgctatgtcgccaagctcagggcgatgattcgcggcgtctcccgcgacgacgaggtggctcagtccgaggcgccgccgccatcgggatcgggcagcgatgccacgatcagcgaccaggcctcgtcataggcggcggtaacgacttcggccacgcgggcctggccgacctgacggacctcttcgatcgcgatctcgatccgggtcgccgcctgatgcaggcgctggctgacccgctgatccagcggcatgccgaccagaccttccagccagttcaccacatcctcgatcagcgcccggtcgtcatcggcgtcgcgggtgggcaggtccatcgcatccagcgcctcgtcggcggtgatggcgatccggccccaggcgccgccgatccggcccagcgccgccaccacctcttcgcccagatgcgggccggcatgaagggcgagccgttcggtcagcgccacgccctcgcgggcggcacgggccagatcctgcagggcgatctcggcctcggtggcaaggccttcctcttcgggatgcatctgctcctcctgatcttcaggcggcgccgggtgcggagcgcgtggggggggtgacggaggccggttgtccggccggttccgggtgcccggcagctcggccgctggccggtcgggggtcatgacccggatcgcccggcgtttcaggccgaagctcgccggggttttggtcaggatttcgccgtcgacattgatccgcttcggcttggacggggtttcgacccggacctcacggcccgacatacggtgaacacccatccaggcatcggcggttccaagacgcagcgccggcagcagcaaggccatgcgccagtgggagacgggctcgatcacatagacgtccagccggccgtcgtcgatcgcggcatcgggggcaacggtcagcccgccgccgtgatagcggccgttggcaaccgcgaccatgatcgcccgcatctccacccgccggttgtcgaccgtcagaacggtgtggaagcgacggtgccgggtcaccaccctgaacagtgcgaacagataggcgagcgggccgaaacgacgcttttcctcgccatccagcgcctcggcgacgtcgaccgacaggccgatgctggcgacgttgaaaaagccgcggccatcgacggtgccgatatcgatctgccgcacgcgccccttcagcgccacgtccaccgcctgggcgggatcggccggaatggcgagcgtgcgggcgagatcatttgcggtgccgagcggcaggatggcaagcgtcaacccggtctcggccatggcgtcggccactgccgagagggtgccgtcgccaccgccgaccatgacgagggccggcggctccgccgaggcgcctgccgtgcggatggcctcgggaaaggcgtcgggcccgtccagatccgggatgtcggggcggaagccggcgcggatcaggcggcgctccagctcgtcgcgatcgaatcccttggccagccggtcgcgcttgcgcggcgggatcaggaccagggcgcggcggccgggtgccgcagacggtcggtcaggcgcggccataggcgggcaccagggcgccgctgaccggggcggcctccgacgaggtcaggaacaggatgatcttcgccagtgcctcgggcgtgacccaggcagcatggtcggcatcgggcatggccgcgcggttggccggggtgtcgatgatcgagggcagcacggcattgacgcggatatggctcgccagcagttcctgcgacaggctctggaccagcgacatcaccgccgccttcgaggcggcataggccgccatctgtgcagcccctgcgaccgcgggcctggcgccgatggcggtgatcgatccgccgccggccgccttcagatgcggtacgccggcccggagcgtgtgatagagactgcgggcattcatcgacatcatcgtgtcgaagcggctgccgtccacctcggcaagcggccccatgtcgaagccgccggcgatggcgacgatgccgtcgaggccgcccagggccgccgccgcggcgtccacggcggtcgccgtctggtcttcgctgcccagatcggcctggaccagcaccgcccggccgccgaatgccttttcggcggcggcgcattcctctgccaccagataggtcgcggcgacctcggccccccggtccagcgcggccagcaccaccgcgcggcccagtgcgccggttcccccggtgaccagcagcttgcgtccctcgatcgacatctcggcggatctcccctcgtgatcgcgtcaggttccggcagtcagccggccggcatcagccgcgtgcctgcggccgtgtcgctcaacaccggcaggcgtcgggcgtcgaagagctgataatgccaccattcattgcggtagaaatcccatcccgcggtggtcatgatccccatcagcaacagccggttgcgttccgcctcgggcgtgatgccggcggcaccgtgatgcgacagcggggtgaagtcgtcgaaccccgtgcccatgtcgagcgcctgtcccgccccgtcgatcagggtcaggtcgaccgcagccccgcgggaatggggcgagccccgacgcggatcggcgacgaaattcggatccggcgtgtgttcccacagcttccactgggcctcggacggccggaaggcgtcgtagatgcggaagcgcagcccctggcgtgcggcgatggcgatcgcccggcgcatcgccgctgcggcctcgggatgcaggaagcaggcggcgcgggcatagatcggccggccggtgaagttgcgggtggtggcgtaggcgatgtcgatatcgaccccgtcccgcgcgctcaggatttcttctaacatcagctgtcccgtccgtgctatgcggcgggggaaccctagcacaaggcacggctccgggggcacggacatacatatgaccttcggcggacggacggcagttctggcactcgacacctgcgccggggcgacctcggcggcgatcggccgccacggggaggtcgtggcccgggtctttctgccggatgcccgggcggcagcggaacggctggcgcccctggtcaaggggctgatggccgaggcgggtgtcgcaccggcggagcttgccgccgtggcggtcacccgcggccccggcaccttcaccggcgtgcgtatcgggctgggatttgcccgcggtctggcgctggcggccggctgcccggttcttggcatgaccacgctggagctgctggccgccggtgccgctaaagatgtcgccgctgcggatgcccgcgggcgcggggcgctggcagtgatcgatgcacggcgcggcgaggtctatgttcagcgcatcgctgccgatggcagccccggcgagccggcggccgtgacgcccgagacggcggtggccgatctggtcgcccggccggcgctggcggtgggggcaggggcgcggctgctgcgcccgctgctggatgcccacgggctggccgatctggtccgtgacgatctgccgcacgggcatgggcaaccggatgccgccgatctgatcggcctggcagagcgccatctggcggcggggcaggccggcggcacaccgcccgtgccgctctatctgcgggcacccgatgccctgccgccggctccgagcgggatcgagacgccgtgaccggcacccatgatctggcgccggcaacggcggatacggcgccggccatggccgcactctatgcgcgggccttcgatgccccgtgggagacgcagtggagtgccggcgccatccgcgatctgctggccctgccgacggtggccgcgatgatcctgggctctgagcctgcactttccggcatggtgatggcgcaggccgccgccggtgaggccgagatcctgaccatcgccgtcgatccggcctgccgggggcgcggattggggcggcgcctgctcgacggggcggcgatctgggcagcggcccgcggggcagaccggctgctgctggaagtggcggtcgacaacatgcctgcccgggccctttatctgtcggcaggcttccggatcgcaggtcgtcggcgcggttactatgcccggggcaaggccccggctgtggatgccgaagtcatggaactgcctttggttcccgcctgaaatccgtccgagatttcgttatccgccggcgattcggaaggtcagccgccacacgtccggcgtgtccgtttcagccgacaggtccacgatctggtgccccagttccacaaccgaccgcggtacgttctccagaggctcacccgccttcagtcggacttcaccgatctgacccccggacatcttcccgatcattaattttgttttgacaaacgtcatcgggcagacatcatgcgtgacgtcgagaaagcgatctgcacttggtttcattgcgaaccatccggtcgtcgtctcggagtgcgagggacgggcaggtcccggtgacggccatcctgggcggaggccggtaccggtgccgggcccggacatcagtgccgatgtccatcctcgtcatcgtcatcccggtcggacagaccagccgccaggctctcagacctcgacgttgccccccgggccgtcgaagtcaagggcattcccgcgcggaaggcccggcctgtcccgacacctgctcccgaccctgatttccgcccgagacaccgaggtccagaccatatcatggccgaaaatccgagcccgctcgatcttctctcgctgaccgcacagatcgtgtcgtcccatgtcgcgaacaacaccgtgtcggccggcgaactgccgcagctgatcggcgaggtctatcagagccttgccggcctcggccgcgagcctgaaccgcgtgaggaagagcagcgcccgaccccggcggtgccgatccgcaagtcggtgcacgacgactacatcatctgcctcgaggacggcaagaagctgaagatgctgaagcgccacctcaagacggcctacgacatgaccccggaagaatatcgccgccgctggggcctggccgacgactatccgatggtcgcgccgggctatgcccgccagcgcagcgatcttgccaagcgcatcggtcttggccgtcggggccgcggcgacgcggattgatccggcccgcagctgcctcggctgacgattttgcgggcgccggtcggaagactgtggcgcccgccgcttgtcgttgcgcggctgctgtccgataatggcctgacgggcgggatggtcttccagaccatcccgccacgaccgattgcggggaccgtgcctctggtgggctggtccttatccgttcgtgacggtcgtccgaaggcgcgacgatggcgcggcctccgttccggacggaacagggggtggcggcatgcagaagcgcgcagaccggccatccgcgtgttccgccccctttctgcccaaggagccaggccatcttggagatgtcgcgactggagcgtctgtgtctcgaaaagggtctgaagatgaccgaccagcgccgggtgatcgcccgcgtgctgtcggaagccgacgaccacccggatgccgaagagctgcatcgccgggccagtgccgttgatccgcggatcagcatcgctaccgtctatcggacggtgcggctgttcgaggaagcgagcattctggagcggcatgatttcggcgacggccgtgcccgctacgagaccattcccgaagagcatcacgatcatctgatcgacatgcgcaacggaaccgtgatcgaattccagaacaccgagatcgagcgtctccagcaggagatcgcccgcaagctcggttaccgactggtcgatcatcgtctggaactgtacggcattccgctggatcagccccaggacgacgacacggacgccggcaaggcctgatcggccgccccgccgccgaccggcgcgggcccccaccgggatcgtccgggatcccgggacagagggccacgctccggtccgccccttcacccacgaccggccaccccggtggccggtcctcttcgccgcgagacttcagggcatgttcggatgaccgaaacactccaacccgacctcggcctgcgttccggaaatctgcgggtgtgcctcgcggacggagccgacgacatcgaggcggcccagcgcctgcgctaccacgtgttctacgaggaacgccacgctcagccgagtcccgagatggcggctgtgaagcgcgatctggacggtttcgatgcgatctgcgaccaccttctggtgatcgacgatgcccatccgagcggggcgccgaccgtggtcggcacctaccggctgctgcgccggtcggtggccctggcccatggccgcttctataccgccgacgagttcgacatcggcccgctgatgacggtcgagggcgagctgctggagcttggccggtcctgcgttgcggcagaataccgcaaccgctcgaccatgcagttgctctggcgcggcatcgccatctatctcgagcattacgacattcagctgatgttcggctgcgccagtctggacggcaccgatatcgacatgctgaaaacccagctcgcctatctgcatcattatcatctggcgcccgaggccctgcggccggtggcggtgcccgagcgctacgtcgcgatggatctggtggcaaaggacgatctgcatgccacccgcgccctggccgagctgccgccgctggtgaagggctatctgcggcttggcggcttcgtcggtgacggcgcggtggtggacaagcagttcaacacgaccgatgtctgcatgatcgtgaaaagcgacctgatcaccgggcgctaccgggatcgctatgaaggcggctcggggcgcggccggggcaaggccggcgacgagggcgcatgaccggatggctgcgggccgccgtgcttctgccggtctatctggcggtgacggcggcactgatcccggtgcaggcggcactggtggctttgaagctgcccggcgccgtactgttcccgcgcttctatcaccggctgacctgccggctgatcggcttcgacgtcgatgtggtcggcacgccggtccgggaccggccggccctgttcgtttccaaccacagctcctatctcgacatctctgtgctgggatcggtgatcgccggctcgttcatcgccaagagcgaagtggcggactggccgctctacggcctgctcgccaagctgcagcgcaccgtgttcgtgaagcgcgagcgcagccgcacggccgaacaggccgacgaagtggccaggcggctggaagcgggcgaccggctgatcctgttccccgagggcaccagcaatgacggccagcgggtgctgcccttccgcaccgcctttttctcggtggcggatcgccggccgggcgggcggccgctggtggtgcagccggtctctctggcctatacccatgtccgcggcatgcccatggggcgcaagctgcgtccgtcctatgcctggtatggcgacatggatctggcgggccatctgtggaccgccctgacccttggccccgcccgggtggaactggttttccatccaccggttaccatcgatgacttcaaggaccgcaaggcgcttgcccgccattgcgagcaggccgtctcggcgggggttgcccaggcattgcagggccgttcgacggcggcgctcgccctcatcggccaggcgctggcgcagcgcggtccggcagtggagggcggcgcccttcaggtggccgaagaggacgagccgctcgacccccaggagatcgatgcagccgagggtgatgggacctccgaggacgtcccggcctgacgaagaccgggtgtgcgtcttgaagcggccgcggtgcggctgatatcttgcgggtgaggcggtcagcggaccgcggcccgatcagaacgaggcccgaggcgagggtgacgaagaagctctacatcaagacttacggctgccagatgaacgtctacgacagcgaacgcatgtcggacgtgctggccgcccagggctttgcgccgaccgaggtggcggaagacgcggatctggtgatcctgaacacctgtcacatccgggaaaaggcggccgagaaggtctattccgatctggggcggctgcgcgcggccggcggtcccgcaggacggctgatcgcggtcggcggctgcgtggcacaggccgaaggcgtcgagatccggacccgtgcccccttcgtcgacatcgtcttcggcccgcagacctatcatcgtctggccgacatggtggagcgtgccacccgtgggcaggcggtggtcgagacagatttcccgaccgaggccaagttcgaccatctgccgacggccaccggccagcgcggacataccgccttcgtggcggtgcaggaaggctgcgacaagttctgcaccttctgcgtggtcccctatacccgcggagccgaatacagccgtccggcgggggccatcctggacgagatccgcgcgctcgcggccaatggcgtgcgcgaggtgatgctgcttggtcagaacgtcaacgcctatcacggtgcggcccccgaaggggcccgcgggccggccggcgactggaccctggcccggctggcgcgtgcgattgccgaaatcgacggcattgcccggatccgctacaccacctcgcaccctcgcgatatgggcggcgacctgatcctggcccatcgcgacctgccgcagctgatgccctatctgcacctgccggtgcagtcgggatccgaccggatcctgaaggcgatgaaccgtaagcacaccgccgaagactacctgcgcatcgttgaccggctgcgcgaggtgcgccccgacatggcaatgtccggggacttcatcgtcggcttccccggcgagagcgatgcggatttcgaggcgaccatgcggctggtggagcgggttgactacgcgctcgcctattccttcaaatacagcccgcgtcccggcacgccggccgcggatctggaagaccaggtgccggacgaggtgaagtccgagcgcctgcagcgcctgcaggacctgctttcgtcccagcagcgcgccttcaatgccagcatgacggggcggcgcctgccggtgctgctggagaggcccggccggcatgccgggcagatggtcggccgctcgccttacatgcaggcggtggtggtcgacgcacccgcggaggccgcgggccggatggtggaggtcgacatcgacaccgtcaattccttcagcctgaacgggcggatcaccggcggcgaatggctgccgaccgggatcaccaccgccggggacagccggatcgccgcgtccgccggggtggtttcttgacggcccggcgcaccgatcgcgcggcgcgcggtcgcacccccatggctgccgagcgggttgccgcagccgacatcgatgcggtgatcctggatttcgacgacaaccacctgctcgcgctgctggtcggcgaacatgatgagcatctggtgcggatcgaaagccagcttggcgtgcacatcgtcagtcgcggcaaccgcctggcgattcagggcagtgaaagcgcccaggatgccgccgccgatgtgctggatggactttaccagcgactgaagcgcaacctgatcgtgaccatggccgaggtcgacgccgcaatccgcatggtcacccaggcagcgacggcggcactcggtaccgaggcggtggaaattccgccggcagaggcgaccaccacggtcacgcatccggcggcgggacggaacggcgatcacggtgcgcaggccggcgcctacatcaccggcgaagtggtcatcaagaccaagaagaagcgcatcacgccccggtccatgcgccagggggcctatctgtctgcgatccgcgatcacgatctggtctttggcatcggtccggcgggtacgggcaagacctatctggcggtggccatggcggtggcgctgttcctggaaaagaaggtcgaccgcatcatcctgtcgcgtccggcggtggaggcgggggagcggctgggctttctgcccggcacgctggaggagaaggtgaacccctatctccgcccgctctacgatgcgcttcaggataccctgcccgacgacatcgtctccaagctgatcgaaagcggcaagatcgaggtggcgccgctcgctttcatgcgcggccgcacgctgtccaacgccttcgtgatcctggacgaggcgcagaataccaccgcggtgcagatgaagatgttcctcacccgcctgggtgagaacagccgcatggtgatcaccggcgacctgtcgcagatcgacctgccggccggcaccgtttcgggcctgtcggatgcgctgtcggtgctggggcggctcaaggaggtgccggtcgtcaccttcgacgataccgatgtcgtccgccacccgctggtggcccgcatcgtgcgcgcctatgacgcccgtgacgaagcccggcgccgaccacgccggcaggcggaacgtggcgccgtccccgcaaaggccggggagggcacggcatgaccggcctgccgccgcgggaggatggcgacgagggtgtggcagaggatgtcgaaacgctcgctctcatggggggccgggtggagatcgccctgcagcgcgtcggggacatctgggccgatccgtgctgggacgagccggcggcccggctggacgggccgctgtccgaggcgatcggtcgtctggctggcgccttgctgaccatggcggcctcggacctgctcgcgcgggtggaggaccggctgatcgagatctcggtcacgctgacagacgatgccgccgtgcgcgaactgaaccgcgactggcgggagaaggataagccgaccaacgtcttgtcctttcctgcagagtccatcgatccggacgatccggagacgatggacgaggtcctcgacatgctgccggcagaggcaccgctgatgctgggcgacgtgatcgtcgcagccgagacggtgagggccgaggccgccgcgcagggcaaggtaccgcgggcccatctgatgcatctgatcgcccacggcctgctgcatctgcttggccacgaccatgtcgatgacgatcaggccgagcagatggaatccatcgagatccgctgtctggcgggcttcggcatcgcagacccctatgccgagatcgagggcgcgcccgacgcggactgagtgcgcgcgaaggttgcccggcaccatgctgccgccgcgctgctgccgcgttcagatggatgattgacgacacccccgccttcgttggagagtctgagaagtcggaggatcgggaggccgttccgggcagggcggcaatacgatcgaccggaccgcagggctgacctgggtccgagggcaggggccccgggcccggatcatgaggatccgtcggccggcggcccatcgggcaggaagcgatgagcgaccaatcttcgtctagacggccccgctcgggcggggccggcaatacttccctggggcatctgctgatgtcctggctcggcggcgggcgttcccgcgaccgggacgaactgcgcgagagcctggtcgaactggccgagcgcatcgaaggcgaggaggatgagcgcgaggcgctcgatcccgccgagcgccagctggtgaccaacgtcctgaaactcggcgacctgaccgtcgaggatgtgatggtgccgcgtgcggacatcattgccatcgaaatctccactcccatcgatgcagctctccgggcgatggccgaggcggggcattcccggctgccggtttatcgcggcacgctcgacgagctggtcggcatggttcacctcaaggatgtggtcgggcgtctgggcgaggccggcacgctggaaagccccgggctggtgcgggaagtgctgttcgaggcgccgtccaggcgggtgctcgacctgctgaaccgcatgcggaccactcgcattcatcttgccatcgtggtcgacgaatacggcggcaccgacgggctggtgacgatcgaagatctggtcgaacagatcgtcggcgagatcgaggacgagcacgacgatcagcagcagccgcggctggaggaagtggaagacggcgtcttcgaggccgatgcccggctggatgtcgaagagctggaagcgcggctcgacagggttctggtcgatgacgacgaggatgtcgacacgctgggcggtctggttttcgccctgaccggtcgtgtgccggcggcgggagagaccgtcgagcatccggcgggtctggtcttcgaggttctggatgccgatccccggcggatcaagcggttgcgcatccgcgtaaccgcccctgaagccacgacggccgcgtgaccctggccgatagggaccgcccggctgcggaaggccgattgcaccgcctcgccgaccggatcggcgggcttggcgtgcgtgcacgtctgggactggcggccctggccggcggcctttcgacggcggcactgccgccggccgacgcctggcccctgggcttcattgcctttaccctgcttctgctgctgctcgacggcgtccgcggccggctctggccaggattctggaccggctgggccttcgggctcggccagttcgcggcagggctgtactggatcggtgtggccttcttcgtggatgcggcggccttcggggcgctggccgtgccgtcggtcctggggctttcggccggacttgcaatcttcacgggcctggccggcctggcgcaggcccgggcggcgccaaagggcgccgggcgcgtattgtttctggcggttgcgtgggtggcggccgagtggttgcgcggccatctgctgacgggatttccctggaatctggccggtgcctccgccctggctgtgccggccctggcgcagggggctgcgatcgtcggtacctatggcatgggcctgcttgccgtcgccgtctttgcagccccgtcgctggtgctggtgcgtgagccggaggaccggcggccggcggcgatcaccggtggtctgatcctcgtggtgctggcaggcgtcggtgtgtggggcgccttgcgtctcgaggcccatccgacggccatggtgccgggggtgaaactccgccttgttcaggccgcgatcgaccagaaggaaaaatggcgcggcgggatgaaggcgcagcacctgcgcacgcatcttgacctgacccggggcccgggcttcgatacgatcaccgacgtgatctggcccgagaccgcggttggctactatccgcagcaggaagccgacattcgcgaggtgctggcccaggccgtgccaccgggcggtctgctgatcacgggggctccccgtgtggaatggacgcagccgccgcctggtgcgcctgctggaaccgaaccgcagccgcgggtgttcaattccgtgatggcgatcgacgatcaggcgcggatcgtgggtgtctacgacaaggcgcatctggtgcccttcggcgaatacgtgccgctgcgcgagttcaatcccttcccgaagctgacggccggcagcatcgatttcacgcccggccccggcccggcgacgctggccctgcccggcctgccgccggccagcccgctgatctgctacgaggcaatctttccgggggaggttaccgcgggctccgcccctattgttcggccaggttttctgctgaatgtcacgaatgatggctggttcggcctgaccgccgggccgcatcagcatttcgcgtctgcacggctgcggagcatcgaggaagggctgccgctggtccgcgccgccaacaatggcatttcggcgattgtcgatccgctcgggcggatcgttgccctgctggagctggatcgtcggggcgtgctggatggaccgcttccggcggctctgccgccgaccctctatgcccgcctgggtgatgcgtcggcggcgatggcaggactgattgtactggccctcgcctttctgccggggggctggggacggcgcaagcggcagagggaggagtgatgggggcttctcacattccgggttgagagatgacggctttcgcgtaaggggagcctgacctgaggcgtcagatcgcagaccggttgttcgcctacctgccgacaccgtggcatcgaagctggcaatcggaacgttggccacatgtcatcaaaggcgagtaggcctgacaatgcaacccggaatgcgcgtttcggccactgcgatgcccgcgccggggttgacccatgccatggcgtgatgtcatctatccgcctgacaaacgggccggaattgaaggcaaccgtgagcgaggagggatgtgacggatggcgacgcgactgaacccaattgatgcccatgtcggtggtcgggtgcggctccgccgccagctcatgggccttagtcaggaaaagctgggacagcgggtcggcttgacgttccagcagattcagaaatatgagcgtggggccaatcgcatcggtgcaggccgcctgtttctcatcgcccatgcgctcaatgttccggtctcatttttctatgaagatgttggagcggtgacaccggaccggggagccgacggtctggatgacggtttcgactggatggtgatggatggcccggaagcacagacactcgctttcgactttgcgcgcatctccgatccgcgtgcgcgtgcacgggtggtggagcttgcccggaccatcagtgacggcttggcggggctctctcaaaaaatccctcttgattccgacgtcacgccgtgaaagtttcctctgacgacgttttctaaaactttcacgcgagtacgcgcagtgccggccgcgccggccgcggggacgcgggaaaggtaagaaggtcgtccgtggtcggatttgtgccgcttgccgccacgttaaacagtgcgctaagtgggcttggtggtgcgctgtcgcgttatctgccgagaacccagacgcacggagtccatcagtggtgccagcgcggttcgccacccgcactggtgcccggaccacggattccgatctcgtggtccgtcgtcggttcttgaggggttgaagacgcgccatggcccgcagcaactatctttttaccagcgaatcggtttccgagggacatccggacaagatctgcgaccggatttcggatgcggtgctggatcatctgcttgccgcagatccctattcccgcgtcgcctgcgagacgctcgccactaccaatcgcgtggtgatcgcgggcgaaatccgttcgcatggtgacaccgcgcctgccacgatcgaacgtgtggcccgcgacgtgatccgcgacatcggctacgagcaggacggcttccattggaacacggcgaaggtcgaagtgctgctgcacgagcagtcggccgacatcgccatgggcgtggatgccgccggcaacaaggatgaaggcgccggcgaccagggcatcatgttcggctatgcctgccgcgagaccgacgcgctgatgccggcgccgatccactatgcccacaccatcctgcgcaacctgcgcaccgctcgccgctcgggcgacattgcggtgcttggccccgatgccaagagccaggtgacgctggaatatgtcgacggcaagccggtgcgtgcgacttcgatcgtgctgtccacccagcatctggcctcggcgtcgcaggaagaggtccgtgcggccgtcctgccggtcatcgaagcctcactgccggccggctggatgtgcgatgacgcggggctttacatcaacccgaccggcaatttcgtgatcggcggtccggatggcgacgccggcctcaccggccgcaagatcatcgtcgacacctatggtggtgccgctccccatggcggtggcgcgttctcgggcaaggatcccaccaaggtcgaccggtcggccgcctatgccgcgcgctatctggcgaagaatgtggtggcggccggccttgccgatcgctgcaccatccagcttgcctatgcgatcggcgtgtcccatccgctgtcggtctatgtcgacacctacggcaccggtcaggtcgacgaggcgaagcttgaaaaggcgcttcgcgaggcgatgaacctgactccccgcggcatccgcgagcatctgaagctgaaccggccgatcttcggccgcacggcggcctacggccatttcggccgcgaccccgaggccgatggcggcttctcgtgggagaagaccgatctggcggagacgatcaagcagcttgtgctctgatccccattcgtgcgatcagcggggcggcggccgggaacggccgccgccccgttgcgttttcaaccccatcttcagccgcaagccggacccgtgccgacgatgaccagcgccgacgatacccggaccaccgggaccgacaccctggcggatgccgccggtgagagcatgggccgccgccatttcggccggcgggtggggcgtccgctcaaggccgggcgcagccgggcgatggaagagaccctgcccgaactggcgatcgccctgccggaacccgggacgcggctggaccctgccgggctgttcgatcggccgatgcgtgaaatcgtggtcgagatcggattcggtggcggcgagcatctgatcgcccgagccgaggccgagccggataccggcttcatcggctgcgagccctatatcggtggcatgtcggcctttctggtggaactggagcgccgggggctgcgcaatgtccgggtgctgggggacgatgcggcgaaactgctcgatgccctgcccgacgcctcgctggcccgtgtctatctgctgttttcggacccctggcccaagcgtcgccacaacaagcgccgcttcatccagacggagacggtggcggggcttgcccgcgtgctccggccgggcgggcggctgatcgccgccaccgaccatcccgatctctgcgcctggacgctggcccatcttcgcgcccatcccgatttcagctgggaggcccggcggccgggcgactggcagcggcggccggacgggcagatcgagacccgctacgaagcgaaggcccgtgccgccgggcgtgtgccggtcttcatgagttttcggcgcggttgacccggaccgcagggcggacctgcaaccgccgcgcatccctgcgcggggatgctgtggataaaccccttgcggttccgcgacatatgcgtatattgaccagcgtccgcgattgcggaccgccggcgatcccgccagcgcccaagccgacgagccatccgccccggtgagggagcggcgaggtacgtccggacgagggcccgccggtggtcgcggtcacatgcagcttccgccgggtgggccttccaagcccgcctttttttattgtgccgcgtcggaccgccgccccgagagggttcgcgagtcgccccgccaccggaggagcgcatggacgtcgttcgtcgtatcacggagttgatcgagccggccgtcggcgatctcggttacgagatcgtgcgggtgacttttcgttccggcgtcaatgccacgctccagatcatggcggagcgggtggacggtcagcccatgacggtggacgattgcgccgagatcagccatgtcgtgtcggctctcctcgacgtcgaggatcccatcaccgaggcctattcgctggaagtgagttcgcccggcatcgaccggccgctgacccggctgaaggatttcgagcgtttcgccggcttcgaggccaagatggaactgcgccgcccgcatgaggggcgcaagcgtttccgtggccggctggccggcgtgcgcgaaggcggtctggtggccatccgcctcgatgacgggtcggaaccggccctgccattcgacgagatttcgtcggcgaagctcatcctgaccgatgagctcatcgccgccgttcaggacaaccggagctgagtgcgcccatggacatcaacttcaacaccggcccggtccggcacgagctgcttcaggtcgccgatgcggttgcccgcgagaagtcgatcgaccgcgatgccgtgctcgaggccatggagcaggccatccagaccgccgggcgccgcaaatacggccaggaccacgatatccgcgcgaccatcgaccgtaagaccggcgagatccggctctatcgctacactcaggtggtggacgaggtcgaggacgaggcgacccagatgtcggtggccgatgcccgtcaccgcaagcccgatgccgcccccggcgatttcctggtcgacccgctgccgccgatcgatttcggccgcatcgctgcccagaccgccaagcaggtgatcgtgcagaaggtgcgcgaggccgagcgtcagcgccagttcgacgagttcaaggaccgcgtcggcgagatcatcaacggtatcgtcaagcgcgccgaatacggcagcgtcgtggtcgatctgggccgtgccgaggccgtgatgcgccgcgacgagctgctcccgcgcgagagcttccgtgtcggcgaccgcgtgcgcgcctatatctacgccgtgcgtgaagagccccggggcccgcagatcttcctgtcgcggacccatccgcagttcatggcgaagctgttcgcccaggaagtgccggaaatctacgacggcatcatcgagatcaagggctgcgcccgggatcccggatcgcgtgccaagattgcggtgaccagccacgacagcagcatcgacccggtcggtgcctgcgtcggcatgcgtggctcgcgcgtgcaggccgtagtggccgaactgcagggcgagaagatcgacatcatcccctggtcgccggatccggccaccttcctggtgaatgctctggccccggccgaggtcgccaaggtggtgatggacgaagacacccagcgcatcgaggtcgtggttcccgacgagcagctgtcgctcgcgatcggtcgccgcggtcagaatgtgcgcctggcgtctcagctgaccggctgggatatcgacatcgtgaccgagaccgaagagtcggagcggcgccaggaagagttccgcgagcgctcgcggctgttcatcgaggcgctgaacgtcgacgaggtgatcgcccagctgctggtgaccgaaggcttcgagtcgattgaggagatcgccttcgtcgcggaagacgagctgtcgggcatcgaggggttcgacccggatgtcgcagccgagcttcagaaccgtgcccagatcttcctcgaggcccgtgatcgtcagatggacgacaagcgccgcgagctgggcgtggaggatgccgtggccgagatcgacggcatgaccccggtcatgctggcgagcctgggcgagaagggcatcaagacgctggacgacctggccgatctggccggcgacgagctgatcgagcttctgcccgccggcacgatcgatgaggcggaagcgaaccggatcatcatggccgcgcgtgcccattggttcgagggcgaggacgcccccgaagccgatgccgcccccgcgggcgacagcgaggcctgagcagacggtggtggtgcagggcgtgacggtggatgagaacgcgatgacggacgcggcggcggatctgccgaccgatggcggtccgcgtgatcgtgcgcctgagcgccgctgcattgcgaccggacagagcggatcgccggacggcatgatccgtttcgtcgtcgccccgggcggcgaggtggtcgccgacatggatggccgcctgcccggacggggcgcctgggtgactgcccgggccgatctgctggaacaggcgatccgccggaaggcctttccccgggccttcaaggcgccggtgaaagccggtgaagacctgatcgggacggtcgagcgattgctaaccgcccggtgtttggaatatcttgggctcggccgccgggcgggagcggtcgttgccggatacgaaaaggtacgggcctggctcgatgccgggaccgtcggtgccgtgtctctggcatctgatgccggagacgtggccgtatcccgcatgggggcgctgaagggcgttcccgtcgtagcgttgttgacgcgtgacgagatgggccgcgctctcggacgcgagaacgcggtcaacgtcgcaattgccgaaggacggctcgcgaagcgtttcctggcggaagccgggcgcctcgcgggtttcagggatgccccctaccctgtcgaccgggtgtcggccggcttgagagagaacggataaccggagcgatatgagcgagaccaacgaggacggccagaagaaggcgctcagcctgtcgggagccgggcgtcttgagctgaggaggaagcctgcgggcgaaggcgcgcaggttcgccagaacttctcgcacggccgttccaagaccgtgacggtcgaggtcaagcgcaagcggaccgtgtcggtgcccgagcagggcggccggggcggttccggcggcggtcgcggacgtgcgcgcggcgccgccgctgacggcggcctgacgcaggacgagcgggatgtgcgcctgagggcgctggaacaggcgatccaggaccagaagcgccgggccgaagaagaggtccgtcgtgccgaggaagaggcacggcgcaaggtcgaagaggaagcccgccgcaaggtcgaggaagaggccaggaagaaggccgaggaagaggcgcgcaaggtcgccgaggaagctgcccgcaaggctgccgaagaggctgcccgcaaggccgccgaagaggccgcagccgcggctgcggcagcagcccggccccagcccgcgcccgaggcccagcccgaggtgcgtgccgagcgcccgcgtggcgaccggcccgatttccgcagcggtgaccgcccgggtggcgatcgtccgcgcggcgatcgtcctgccggtgaccgcccgcgcggcgaccggcccgatttccgcagtggcgaccgcccgggtggcgatcgtccgcgcggcgatcgtcctgatttccgcagcggcgaccgtccgccgcggggtgaccgcccgcagggtgatcgtccgcagggtgatcgtccgcgtggcgaccggcctgatttccgcagcggcgaccgccccggtggcgatcgtccgcgtggtgaccggcccgatttccgcagcggcgatcgccccggtggtgaccgtccgcgtggcgaccggcccgatttccgcagcggcgatcgccccggtggcgatcgtccgcgcggcgaccgtccggacttccgcagcggcgaccgccccggcggtgatcgtggtccccggcccgagcggccggccggtgccggccgtccgccggcgggtggtgcggcggccgtgcccgcgacgcccctggacgaggatgccgagcgcgcccgcgcccgggccgctgagcgtgcccgtgagcgcaaggtggagcgcgacgaggaagagagccgcgccaaggctgccagcaagcgtgcgacgccgaccccgcgtaccaccgacgatcgtcgtcgtggcggcaagggcgacatcaagcgtctggtcgaaggcgacgagagcgagcgtcagcgcagccaggcggcgatgcgccgtcagcgcgagcgcatgcgccgggccggccgtcaggccgagccgcaggcccgcgtggtccgcgacgtcatcgtgcccgaggtgatctcggtgcaggaactggcgaaccgcatggccgtccgtggcgccgacgtcatcaagaagctgatgacgctgggcgtgatggcgaccatcaatcaggcgatcgatgcggacacggccgaactggtcgcgaccgaattcggccaccgggtgaagcgggttgccgaggacgacgtcgagctgggcattctgggtgtcgaggataccgatgacgatctgaccccccgggcgccggtcgtcaccgtcatgggccatgtcgatcacggcaagacctcgctgctcgacgcgctgcgcaagaccgatgtcgtggcccgcgaggccggcggcatcacccagcatatcggtgcctatcaggtcgagctcgagaccggtgaccacgtcaccttcctcgacacgccgggccatgcggccttcaccgccatgcgggcccgcggcgcccaggtcaccgacatcgtggtcctggtggttgcggccgatgacggcgtgatgccgcagaccgtcgaggcgatcaatcacgccaaggcggccggcgtgccgatcgtggttgcgatcaacaagatcgacaagccgggcgtgaatccggaacgggtgcgcaacgagctgctccagcacgagctggttctggaagagctgggcggcgacgtgatcgcggtcgaggtctcggccaagaccggcaagaacctggacaagctgctggaagcgatcctgctgcaggccgaggttctggaattgcgtgccaacaccgatcgcgccgcccagggcgccgtggtcgaggcgaagcttgacaagggccgcggcccggtcgcgaccgtgctggtccagaagggtacgctcaagaccggcgacgccttcgtggtcggcagccagtggggccgtgtgcgcgcgctgatcgacgacaagggccgcaaggtcgaggaagccgggccgtcggtgccggtggaaatcctgggtctccagggcgttccgcaggccggcgacgagctggtggtggtcgaggacgagcgcaaggcgcgcgagatttcggccttccggtcggagcgcgagcagcgtgcccgtgccgcaaccgcactgggtgcccgcggcacggtcgagcagatgctctccgagatctcggccggttccaagaaggagctggcggtgctggtcaaggccgacgtgcaggggtcgctggaagcgatcaccgccacgctggccaagctcggcaacgacgaggtcgcggtgcgcatgctgcatggcgcggtgggcggcatcaacgagtcggacatcacgctggcacaggcgagcaacgccctgatcatcggcttcaacgtccgtgccaacgcccaggcccgcgatctggcccgccaggccggtctggaactgcgctactactcggtcatctacgacctgaccaacgacgtgaagagcatgctggaaggcatgctgtcgccgatccgtcgtgagacgatcaccggtcaggccgagatccgcgaggtcttcgccatcaccaaggtcggcaagatcgcgggttgctccgtcaccgagggctatgtccgccgcgacagcaaggtgcgcctgctccgcgacgacgtggtcatccacgagggctcgctcagctcgctcaagcgcttcaaggacgatgtccgcgaagtgcgggccggccaggaatgcggtatggccttcgagaactatcaggatctgcgtgccggcgacgtcatcgaggcctacgaggtcgaagagatcgccgccgagctcaagagcccggtctgagccgcagagccggaaacgaccgcgatgcgggccggccgggatccctcccggccggcccgcacgcattccacccccttctttcgatgaacggcagacaagccatgtccaaacgcgcccagggcgctgccggtcccagccagcgccagctccgcgtcggtgaacagatccgccaggtgctggcggagctgctgatgcgcggcgagacccacgatcctgatctcgacggccggccgatcacggtcagcgaggttcgcatgaccccggatctgcgcaccgcgaccgcctatgtttcgccgctgggcctggacagcgacggcgccgacgtggtgatcaaggcgttggcccgttcggcctccacactccagcggggcatcggccggcaggtgtcgctgaaattcacgccccggctgctgttccggctcgataccggcttcgactacgccgcccatatcgatcgcctgctggcaaagccggtgatccgccgcgatctcgacgacgaggatgatgtcgcagaggacggcgtggcagaggatggcgaccgggaggattgagcgcgtggcacgccgacgccgtggcctgccgatcgatggttggctcgccatcgacaagcccgagggcatgagttcagcacaggcggtcgcggccgtgaaacggctgaccggggccgccaaggtcggccatgccgggacgctggatccgctggcgtcgggcgtgctgccgattgcgctgggcgaggcgaccaagacggtcgcccatgccatggacggcgcgaaggaatatgtcttcgaccttcactggggcgaggcccgggccaccgacgaccgcgagggcgaggtgctggagaccagtgatcatcgccccgacgctgcggcgattcgtgcggccctgccggatttcctgggcgagatcgaccaggtgccgccggcctattcggcgatcaagctggctggccggcgcgcctatgcgctggcccgggccggcgagacgcccgagatgccggtgcgccgcgtgcggatcgacgcgctggagctgctgaccattctggacgccgaccatgcccgcttccggctggcctgcggcaagggcacctatgcccgggcggtgggccgggatctggcactggcgctcgacacggtcgggcatctgtcgatgctcaggcggacccggtcgggcgcattcggcgaagcccatgcaatcactctggaaaagcttgaagcgctcgtgcatagtgccgcgctcgatacccatctgtttccggtcgagaccgcgctggacgacatcccggcgctggccctgaccggtcccgaagccgatgcgctccgaaacgggcgcccgctcagggatatggccgttcccgaaggacgattggttcgtgcgacgctcgacgggcgcctggtggcgctcgcccgggccgaggacggattgcttcgttcggtgcgcggcttcaacctcggcgccaccagcgccgcctgatcaaggaaggacacccgatgtcgatcacgaagtcgcgcaagaccgagctggtcaccgaatacgcccgcggtaccaatgacaccggttcgccggaagtccaggtcgcgatcctgaccgagcggatccgcaacctgaccgagcacttcaagacccacgccaaggacatccactcccggcgcggtctgctgaagatggtcagccagcgccgcaagctgctggactacctgcgtcgcaacgacgaggcccggtacaaggaagtcatccagcgcctgggtctgcgtaagtgatctgatggccgagggggggcgatcgcgtcccccctttcgtcatccggggccaccctgcgcgcgggggtgtgcttgtctcgagcggatggatctgccgtccgcgaccgcgcgggagatgaagggggagagggcctgctccccggccgacggatccaccgggatccgcctctggtcgaaccgggccccggctcgcggccgtcatgggacggcgcgcggcatgtcgtcgccgtcggggcaggtggagtgatcaggaacccccgacggagcatgcggccggtccggatccgttccggatgcggccgcgatgcggatcgccgcccggccggatgaaggccgggaacgcgccccggaacgagaacgggcgcaaggtcaggcggtccgcccgcgggacccccgttccggcaaagggccgggacgacggggataaacgtgcggggatgtcgaaggccagggtccggcggagcccggcctgcaacatcccggacgccccgccgatggaatggaagagagagaccgagatgtttacgatctatcgcaaggaagtcatgtgggcggggcgcaagctcaccttcgagacggggcgcatcgcgcgtcaggccgacggcgccgtgctcgccacctatggcgagaccgccgtgctggcgacggtggtcgccgcccgcgagccgaagcccggcgtcgacttctttccgctgacggtcaattaccaggagaaggccttcgccgcgggcaagatccccggcggcttcttcaagcgtgagggccgcccgaacgagaaggagacgctgacttcgcgtctcatcgaccgtccgatccgcccgatgttcgccgacggctaccgcaacgagacgcagatcatctgcaccgtgctgagccacgacaccgagaacgaccccgacatcgtgtcgatggtggccgcctctgccgccctgaccatttcgggcgtgcccttcctcggcccgatcgccggtgcgcgcgtcggctatatcaatggcgagtacgtgctgaacccgctgcgctcgcagatgggtgacaccgccctcgacctggtggttgccggtaccgacgaagccgtgctgatggtcgaatccgaggccaaggaactgaccgaagaggtcatgctcggcgcggtgatgttcggtcatgaaggcttccagccggtcatcgacgcgatcatcgaccttgccgaggaatgcgccaaggatccctggccgctgcccgagaacccggctgccaaggccgtggcggcgcgcgtcgaggccgtggcccgtccaggcctggaagaggcctatcgccaggtcgtgaagcagcagcgccagctggcggtcaagtcggtcaaggagaagaccgtcgaggccctggtcgccggcgagggccttgagccccagctggtctcgggcgcgttcaaggccctcgaggccaagatcgtgcgcggccggatcctgaaggaaggcgtgcgcatcgacggccgcgacctgaagaccgtccgcccgatcgtctcggaagtgggtgtgctgtcgcgggcccatggttcgacgctgttcacccgcggcgagacccaggcgctggtggtcaccacgctcggcaccggccaggacgagcagatcatggacatgctcgagggcgagtaccgcgagcacttcctgctgcactataacttcccgccctattcggtgggcgaggccagcccgatgcgcagccccggccgtcgcgagatcggccatggcaagctggcctggcgggccctgcgcgccgtgctgcccgagaagtcggccttcccctacacgatccgcatcgtgtcggagatcaccgagtcgaacggctcgtcgtcgatggccaccgtctgcggcagctcgctgtcgatgatggatgccggtgtgccgctggcgcgtccggtggccggcatcgccatgggcctgatcaaggaagatgacggcttcgcggtgctgagcgacatcctcggcgacgaggatcatctgggcgatatggacttcaaggtggccggcaccgaccagggcatcaccgccctgcagatggacatcaagatcaccggtatcaccgaagagatcatgaaggtggcgctgggccaggcccgcgacggccgcctgcacatcctgggccgcatggccgaggcgctgggcggtgcgcgcgaggaggtcagctccaacgcgccgcggatcacgaccatctcgatccccaaggacaagatccgcgaagtgatcggcaccggcggcaaggtgatccgcgagatcaccgagcagaccggcgccaaggtcgacatcgaggacgacggtaccatccgcgtcgccgcggtggacggcaaggccgtggacgccgcgatcaactggatcaagggcatcgtggccgagcccgaggtcggcaccatctacaccggcaaggtggtcaaggtggtcgaattcggcgctttcgtgaacttcatcggcacccgcgacggcctggtccacatctcggagctgtcggccgagcgcgtcaaccaggtcaccgacgtgatcaacgagggcgacgaggtcaaggtgaaggtgctgggcatcgacgaccgcggcaaggtgaagctctcgatgcgcgtcgtcgatcaggcgaccggcgcagagctgcccgatacccgtgagcctcgcgaacctcgtggcgaccgcgagccgcgtggcgaccgtgagccccgcggcgatcgggatcggggtgaccgcggcgaccgtccgcgcaagccccgcggtccgcgctgatcgcgcggctccgcattccgtgatatgacgacgcgccggccggtggcttccccttcaggaaatcgccggccggcgtcgccatgtctgccgactgccttgccggtgagggccgcgctgtgcgggtgcggtgcaaaaaaccacggcgggcagggctggacttcatgggaaaccatggccagttaaccggcgaacctgcccaaagcccggtcccgagacccggccattggtagatcggttcgaacgcatcggcgcggatcggacggcggaaccgccggcccgggccgccgctttgaacaaaaagaacgcaaggacgagtagcggaggcatcgtgaagcccttgaaccccatcctcctgtccggacgggaagtcctgcccttggtcgaaggcgggaaaggtgtcgccgtgtcgaacggtgaaagctccggcgcgtgggctgcagccggcggcgtggggacgttttcgggtgtgaatgccgacagtttcgacgccgacggccgcccgatcccgcagacctattacggcaagacccgccgcgagcggcatggcgagctggtggcctacggcatccgcggcggcatcacccaggcacgcattgcccacgagctggcgggcggcgaaggccggatccacgtcaatgtgctgtgggagatgggtggcgccgagacggtgctgcagggcgtgctggaaggggccaaaggcctgatccacggcgtgacctgcggtgccggcatgccctatcgcgtggcgcagatcgccgccgagcacggggtttattactacccgatcgtttcgtcggcccgcgccttccgggcgctctggaagcgcgcctatcatcgcttcgccgaatatctgggcggcgtggtctacgaggatccctggcttgccggcggccataacggcctgtcgaacgccgaggacccgcgcgagccgcagtcgccctatccgcgtgtgcgggaactgcgcgagctgatgaaagagatcggcatccccaacgtgccgatcatcatggccggcggcgtctggtatctgcgcgagtgggagcactggctggacgatcccgaggtggcgccggtggcgttccagttcggcacccggccgctgctgaccagggagagcccgatttccgacgcctggaaggagcggctgcggacgctgaagccgggtgatgtctatctgcatcgcttcagcccgaccggcttctattcctcggcggtcaacaacgacttcctgcaggaactccgtggccgcagcgatcgccagatcgcctataccaccgagcccgtgggcgatcacgaggtggcgctgccgatcggagcccgcggccggccggtctatgtcacagcccatgatttcgagcgcgcccagggctggatcgccgagggtcataccgaagcgatgaagaccccggacagcacgctgatcttcgtggaccccgccgcggcgaagcagatccatatcgatcagatcgactgcatggggtgcctgtcggcctgccagttcagcaactgggcggccaacgagaaggggaccaccggccgtcgggccgatccgcgcagcttctgcatccagaaaacgctgcagaacatcgcccatggctcggatgtcgagcacgagctgatgttcgccggccacaacgcctatcgttttgccgaggatccgttctattcgaacggcttcgtgccgaccgtgcgtcagctcgtcgaacgcatccgcaccggtgactgatctgcatcttccggccggagatcggggggcttccctggtctccggccttgcactcagaatggaacgcacctaaattcctggctaactgaccgtccctacgcgactttcccatggcgcgtagtggaccttcaacaagacgagagccgggaatgtccaccaaccgcccctataccgccgtgctcgagaagctcaaggcagccggtctccggccgaccaagcagcgtctcgctctggcgcgcctgctgctcgacggcaccgaccgtcatgtgacggccgaagagctgcaccgcgaggcgcaggcggcggcgctcccggtgtcgctggccaccgtgtacaatacgctgcaccagttcacccaggcggggctgctgcgcgagctggtcgtcgacagcggccggtcctatttcgacaccaatgtcagccaccatcatcatttcttctatgaagacggcggccatctccaggacatccccggggatgcggtccagatcgcccgtctgcccgaaccgccgggcgatgcctccatcgcccgtgtcgacgtgatcatccgcgtccgctgatgcccggcatgggggcggggcggcgggatcgcgaaccggagagccacggagccatcaccccatgaccgaccgttccgacgaccgtttcccggccgccgaaccgccgcttgccggcacgcggaccgaggccaatctgatccgcgccttcatgtccgaggcggctgccaaccgccgcttcctctatttcgcccgtcaggccgatatcgagggtttcaacgacgtggccgcagtgttccggtcgatcgccgagggcgagaccgggcatgcgctgggccatctggaattcctggaagaggcgggcggtgacccggcgaccgggcttccgatcggcaccacctctcagaacctccgcgccgcgatcgcaagcgaggaggaggatgccaccggcgtctatcccgagatggcccgcgtggcccgcgacgagggccagatcgaggcggcggagtggttcgagaccctggcccgggcggagcgtgcccatgcggcgcggttccggcgctcgctcaccagcctggaagagatcctggacgagaccgcagccgaaggggatgacgacggcgcctgaggcgccgtcgggccgccagtggacggcgggctgtgaggagatgtcgggccgtcagtggaaatcttcgtccggatagacgccccagatctcgtcgcggcggatccaggcgcgggtgttggcgatgtccatttcgcaccagttccgctcgcaggccatcaggcggccgaccacgcccggctcggcgcgcagcagcggcacggcgtccgctgccgggcggttatagagcgtgcggacctccccctggatgatggcggtgcgccggcccgacagcaggctcatatgcgcccagccctcggccccctcgacatcgcggatcttgcgccagttttcgtattccgccgttacctcgaccggcagatccttgcgattgtagatcgcggcgacgggatagcgggtgccggggccggtgcgcacattcacctcggccgagcgcagtgacacgaaacggggcaggggcggccgttcggcgctgcggccgatccatttggcgccgccttcatcctcggccggggcatccttcgcctcatcggcggtgggcgcgtcggcggcgccggccgtgaagaacagcgcggcgcctccgatcatggccagacagacgaacagcgtcagcaggaatgcgaaacgggggcgggcggtggtgcggtcgggcatgagatggatgggtcctgaagggcgggcctgaaagcatgggggcggtgccggccgtgcggttcccttgggggcaagggccccggcggggctttccagaccttacgctgcaggggatcgtcacgcaatcggtcggccggtttgtatcgcaccggccgatttgctaagaaaggggaccgggcgggtgccgtcgggcagggcaccagatgcggggccgttcctgcgcccggtacaggacgcctggataatacgccccggggccggacgctgggcggccgtaaggtgggcggtctatgggagagtgtcgatggtgaagccgaagccggtggttgtggtcacccgcaagctgcccgagcagatcgagacgcgcatgatggagctgttcgacacgcggctcaatcatgacgacgtcgcattcgggcaggacaagctgatcgaggcggtcaagaccgcccatgtgcttgtacccacggtgaccgaccggatcgatgccggcgtgctcgcccatgccgggccgcagctgcggctgatcgccaatttcggcaacggcaccgaccatatcgatctcgccacggcgcgtcagcgcggcatcaccgtcaccaacacgcccgacgtgctgacggaagacaccgccgacatgaccatggcgctgatcctggcggtggcacggcgcgtgccggaaggcgagcgcatggtccgcaagggtgagtggaacggctggagccccacccacatgcttggccgccggatctggggcaagcgcctgggcatcatcggcatgggccgtatcggccgtgcgctggcccgccgggcccgcggcttcggcctgtcgatccactaccacaaccgcaaccggctgcatgccgatatcgagggtccgctcgaggcgacctattgggaaagcctcgaccagatgctggcccggatggacatcgtgtcggtcaattgcccgcatacgccggccacctatcatctgctgtcggcgcggcggctgaagctgctgaagaaggatgcctatgtcgtcaacaccgcccgtggcgaggtgatcgacgaggcggcgctgacccgcatgctgcgcgacggccagctggccggtgcggcgctcgacgtgttcgagcacgagcccgcagtgaatcccaagctggtcgaactcgacaacaccgtcctgctgccgcatatgggctcggcgacgctcgagtcgcgcatcgacatgggcgagaaggtgctgatcaacatcaagaccttcatcgacggccatacgcccccggatcgggtgctaccgttctgatgatggcaggatcttgccagatctgaggtctgctgctatcttctgagcatcgacccccggctagtaccccgtgcacatatagggcacgtgacgaaccccgggggtatttttcatactaaatttctatctggggttgattatgtccacggcgatcctgattgatggcgccttctttctcgtgcgactgaacagcctctatcacgcatggcccggactgaccgacccggatcaggtcgccacgatcatccatcgtaccgccctcgggatgctgaaacagggcgagacggaggcgcgccggaacctgtaccggatcttcttctacgattgtccgccgctgcagaagcgcgtcactttgccagtttcacggcagacccgaaactatgcgcagaccgatatggcgacctttcgcctgagccttcatgcgcgattgagggcaaagcgcaaaatggcattgcggctgggaacgttgaagggaggaacgtcctggcgactgaaggcgcctgcgacccaggaacttctgaaggggcggcgcggttgggcttccctcactgatgatgatttcgaactggatcttcgccagaagggggtcgatatgaggatcgggctcgatatggcgagcctgacactgaagagatttgtagatcagatcattctgatctcgggtgatgcagacttcgttcccgcggcgaagctggctcgccgagagggggtcgacgtgattctcaatccgctctggaagccgattcccgaggatctcaatgagcacattgacgggctcaggaattatcttgcccgctatgcgacgccagccgccgccgaagccgatgcagtaccatccggggcggacgatctgctggaaacctgagcaggcgcccgctttcagatgaccacgagccgccccgtgtcgcccaggatccggtagaggctgaccaggccgccctcttcgaagggcaggtcgtccctgagcgcggtcttctccaggccgatggcgcgcaggcccatatcgcagaccatgaagcgggcgccgaggtcgcggcaggcttcgatcaggtcttccacgccggcggcgccgcgggcgacgaggccggcattccagcccgtggcgtcgccggccacgcctgcggcgacaaggtcggggccgagcgggcaggtcacccagcccggccgtccatccggatcgggcgcgcgcaggctcagaagggcggcgttggtgaagaacaacaccacaggttgcgagaccgccagggccgctgcggccatggccaggccataatggacacgattgaggctgcccgattcgaggatcaggccggtatatgatctgtcactgaccatgaacgtgtcccgtcatgcaccatgggcgccgagatccgtgatgaccgggtggtcaccacagagcgggcaggccggatcggcgggcaggcggacggtgcggaagcggttggagagggcgtccacgatcagcatccgaccggcaagcccctcgccgatgccggtcagctccttcaccacctccagcgcctggagcgagccgaccatgccggccagcgcaccgatgatgccccccgaggaacagctggggatcagtcccagcggcggcggggcggggtagaggcagcgatagcagggcaggcgtggcccccccgaacggtgggcgtgcgagcggaaggtgtagatctggccgtcgaagcgcaggatcgccgccgagaccagggtgcgacccagcagatggcaggcatcattgaccaggaagcgggtgtcgaaattgtccgagccgtcggcgacgagatcataggcgccgatcagcgccgccgcattgccggcatcgatccggctgtcgtggatgtcgacccggatctcgggattgagtgcccggatggcacgggcggcgctttcgaccttcggccggccgatatcttcggtgcgatgaatgatctggcgctgcagattgctgagatcgacccgatcggcatcgacgataccgatcgtgcccaccccggcggccgcgagatagaggctgagcggtgcacccaggccgcctgcgccgatcagcagaacccgggcgcgcttcagggcaagctgggccgtctcgctgaattccggcagcacgagctggcggctgtagcgttcgatttcggcgtcggtgagctcgatgtcgtccacgacaggcggggttccgcagcagaagggggcggccgcgacggaagcgccgcggccgcggacgggatcactcgagaccgttgaagagatcggtcgagagatagcgttcggcgaaggaggggacaatcgcaaccacggtcttgccggccatgtcgggccgctgggcgatctcgaccgcagccgccacggcggcacccgacgagatgccgcaggggatgccttcggtccgcgccagggtgcgggcatagtcgaaggcggtctcgttggcgatggtcagcacctcgtcgatcaccgagcggtccaggatctcaggcacgaaaccggcaccgatgccctggatcttgtgcgggccgggcaggccgcccgacagcaccgcgctgtcctcgggctccaccgcaacgatccgcacgtccgggttcttctgcttcagcacctggccgatgccggtgacggtgccgccggtgccgacgccggctacgaccacatccaccttgccggcggtatcggcccagatctcctcggccgtggtcacccggtgcacggccgggttggccttgttgcggaactgctggagcatgatcgcattcgggttgccgtccaccagctcctgggcgcgggcgatggcgcccttcatgcccagcttcgcgggcgtcagttcaagctcggcgcccagcagtttcagcatcttgcggcgttcgatcgacatgctctcgggcatggccaggatcagccggtagcccttggcggcgcagacgaaggcaagcgcaatgccggtattgcccgaggtcggctcgaccagaatggtgtcggggccgatggcgccttccgcctcggcggcggcgaccatcgcgccggcaatgcggtccttgaccgaggcgagcgggttgaagaattcgagcttggccagaacctcacccttcacgcccttggcggcgccgaggcgcgaaagacggaccagcggggtatcgccgatggtgtcgatgacattgtcatagatccggccacggccgtgggtgggggtcggctgccaggtatcggtcatgtcgactgcgctccttcgtggggcctgcctcggggcgggggcggccttcgcctcagatcgagaaatccatgcgggtcatggcttcgctgcggatgccctgttccacggcgcgctgacagagatcggcgacggtgatgccgtccaggcgttccatcaactcatcctggatgtcctgccagaccgggcggaccaccttgtggcccagatcggacccggccggatcggccatggggtcgtcggtcttctccatggcgcgcaccacgcgggcgatgtcgccgatggtgatcttgcgccgctcgcgtgccagccggtagccgccgcgggggccgcgcacgccttccaggatctcggcatgcaccagctgctgcatgacctgttcgagataccgctgcgggatgccctgacggcgggtgatctccttgctctggaccggctcggcaccgccgttgtgggcgatgtcgaccacggcttccagcgcgaacagcagtttcttcgacagcctgagcatgggcgtttccgtttcgatcctgttcgtgaaccccggccttgcaccaccgttccgcggcaggcccggatctgttctcagtgcccggtggaaccgaagccaccggcgccgcggacggtgtcgtccagcgcctcgacctcgaccaggcgggtggcggtgaccggggcgatcaccagctgtgcgatccgcatgccgcgggtgatctcgaccggcgcatcgcccagattgaccagcaggactttcaactcgccgcgataatcggcatcgatggtgccgggcgcgttgagcacggtgacgccctgagagaaggccaggcccgagcgcggccgtacctgcccctcatagccttcggggatcgccatggtcaggccggtcggaaccagggtccgccccccgggggccagcacgatcggcgcgtcggccggcacggcggcgggcaggtccagcccggcggcaccggcggtcttcatctcggggagcggcaggtcgcggccgtgatcgaggcggacgaccccgatccggaggtggcggtccatcaggcggaatccttggtggtgggcgctgcgaagtgatcggcaatgcggcgggccagccggtccgccaccgcctgcttggtcatggcgggccagctgtcggtgccgtcggcatcgatcaggtggacggcattgtcgtcgccgccgaaggtgccggtgccggtcgaaacatcgttggcgacgatccagtcgcagcccttgcgcgcccgcttggcacgggcatggtccagcacctgctcggtctcggctgcaaagcccaccaccagggccgggcgcgatgggccgggtgccgagatggtgcgcaggatgtcgggattctcgatcagccggatgtcgggcggcagcgcgccgcccggctgcttcttcagcttctgcccggcttcgatcgccggccgccagtcggcgacggcggcggcgcagaccgcgatatcggcgggaagcgccgcttcgaccgccgccagcatctcgcgggcgctttcgatatggatggtgtcgacaccggccggatcggtcaggcgggtcgggccggtgaccagggtcacctggcagcccagcgcggcgagtgctgcagcgatcgcatgcccctgcttgccggacgagcgattggcgatgtagcgcaccgggtcgatcggctcgtgcgtcgggccgctggtgacgacggcatgccggcccgacagcgggccgggcgcatcgatcagtgccgtcccgggacccgtgagcgccgggcggctgttctcggccagggcggcacggatggcctccacgatcgtcgccggctctgccatgcggcccgggccgaactcgccacaggccatttcacccgcgtcgggaccgaccgtcagcacgccgtcgcggctaagctggtccagattgcgccgggttgccgggtggaaccacatccgcacattcatcgccggcgccacgagcacccgcttgtcggtggcaagcagcagggtggtcgccaggtcatcggaaatccccgcggccatcttcgccaggatgtcggcggtggcgggggccacgaccaccaggtcggcagcgcgggacagctggatatggccgatctcggtctcatccttcagcgaaaagaggtcggtgtggacctcctcgcccgagagcacggcgagagacatgggggtcacgaactcgccggccgcacgggtcatcacgaccttcaccccggcgcccgccttgcggagcagccggatgagttcgagggccttgtaggcggcgatgccgccggtgacgatcagcaggatgcgcttgccggtgagcaccggaccctccgcttgggatccgacggctggcgggggccgtcatgtggaacctgcgcaattgcgcaaggcgtggtgtggttaaactaggcgccctgaggtcgccgtgcaagagacaaggcgaaccggcattttaacctgacgatgttgcggatgggatgcgcccctgcccgctcagcccaggatgagccagagcagggccaccagcaggccgccgccgatcgcggccgaaagccggctgccgctcatgatcaccgggcgcggccgctcgggatcgctcagggtttccagccgatccatgatccggggcaggcgctgcgccagatgaagcatctcgcgcgcggtggtctcggcgcgggcgcgcgggcccagattggcggccatccattcgcggatcagcggctcggccagcacccacatattggcgccggggtccagcagtcgggccataccttccgcctggaccatagtcttctggagcagcagcagctggggctgcgtctccatctggaaggtggtcgtgacctggaacagctgggcgagcagccggccgatcgagatctcgttctggggcttgcccaggatcggctcgccgatcgagcgggcagcctgggcaaagagcggccgcgactggtcgggggggacgaaaccggccgcaaaatgcacgtcggccaccgcatcgtagtcgcgggtcaggaaggcgcgcagcatctctgccagatagagccgcgactgacggtccagccggcccatgatgccgaaatcgaccacggcgatgcgaccgtcgggcaggatgaacaggttgcccggatgcatgtcgccatggaagaagccgtcgcggaacacctgcaggaagaagacccgggcggcattcgccatgatttcgcgcccgtcgaggcctgcggcctcgagcgctgcggtgtcgtcggcacgcacgccgccggtgatccgctccagcgtcatgacccgggcggcggtgcgcatccagtcgatctctggcaccatgaagccgggatcgccctcgaaattctcgcgcagctcctggcctgccgccgcttccattcgcaggtcggtttcgatcgccaccacttccgacagggtgcggaccacctcgaccggtttcagccggcggctgccgggcagcaggcgctccagccagcgggcgatccaggcgaagagggcgaggtcggtggcgagcgcgcgttccacccccggacgcagtaccttgaccgcgacctcgcggccgtcggtggtctcggcgaaatggacctgggcgaccgaggctgccgccaccggcacgtcgtcgaactgcgcgaagagatcgctgaccggccgttcgaaagactgttcgatgatccgccgcgcatccgccccagggaagggcggcagtctatcctgcagccgggccagatcgcgcgccacggtttcgccgatcaggtcggcgcggatcgacagcacctggccgagcttcacgaaactggggccgagggcggtgagcgcccgggccagcctttcgccttccgccagctcgcgcaggtcgcgccgggtcaggcgccgggcggtccgtccggcaaaccccgctgccggatgctgggtcgccagctgttcgagcgggaagagcgcgccgtgacgggcgaggacatagccgatgcgcgaaagccgcagcaggtggcgcagggtcgagaacatgggggtccgatcgggagaggcgggcgctcagacgttccaggccgagtgcagggcggcgatgccgccggacagcagccgcaccttgacctggcggaagccggcgtccgcgatcatcccggcgaagcggtcggcgctcgggaatttgcggatgctttcggcgaggtaacgatagctcgcggcatcgcgcgcgaccacccggcccacctgcggcagcaccttgaaggaatagagatcgtaaagccggtcgagcaccggcgcctgcacctgagagaattccaggcacatgaaccggccgccgggcttcagcacccgccgcgcttcggcaagtgccgccgggatgtcggcgacgttccggatgccgaacgcgatggtgtagacatcgaccgaggccgaccggaccggcagcacctcggcattgcccgccacccagtcgatgccgtccaggatgccgcgatcgaccgcccggtcgcggccgacctcgagcatcgcaggtgtcaggtcgcagaccgtcacccgtgccggcggcagctgggcggcggcggaaccggcattgcgccgggcgcgatcgatgaagcggaaggcgatgtcgccggtgccgccggccacgtcgagcaggtgctggccgggccgcggcgccagccagtccatcatcgcgtccttccacagccggtggacgccgccgctcagcaggtcgttcatcaggtcgtagcgccgggcgacgctgtcgaacacgccgcgcaccatgcggcgcttttggccgaccgtggtgctggtgaacccgaaatcggcagggcgctcgtcgccggcgtgccggccggcgggctcgtcgatcactgacatcgctcgtcctcggaaccttcgggtgcgggtgcgcgagggaacatagcgcgggccggggcattgcgctaccctcgcccccatgccagagctgcccgaagtcgaaaccgtgctcaggggcatcgcccccaggatgatcggacgccgccttgccgaggtcgaggcgcggcgcccggatctgcgtcgcccgctgcccgccggtttcgtgcagcggctgacggggcgtgccgtgatcgcggcggatcgtcgcgccaaatatctgcgcctgcaccttgaggggggcgagacgctgatcgtccatctgggcatgtcgggccggctggtgatcgaggatgcgccgccgccggtcgccttccatcacggcccctcgatcgcggtggcggatgcgccccatacccatgtcgtgtttcgcctggacgatggcacccggatcctgttcgccgatccgcgccgcttcgggctgatggacatcgccgccaccgacgatctggacgcccatgacctcttcgcccatctgggaccggagccgctcggcaacggtttctcggggccctatctcgcccgggccttcgaggggcggcgtgccccggtgaaggcgctgctgctggatcagcgcgtggtggtgggggtcggcaacatctatgcgagcgaaagcctgttcgaggccggcatccacccggcccgtgccgccggcaccctgtcggccgaggattgcgaccggctggcggcggcggttcgggcgacgctcgaccgggcgatcaccgccggcggctccaccctcagggatttcgtcggcgcctcgggcgaactcggctacttccagcacagtttccgggtctatgaccgggccgacgccccctgttcgcgggagggctgcggcggtaccatagaacgcgtcgttcaatcgaaccgtgccacctatttctgttcccggtgtcaggcatgaccgttttccggaccatgatcgtccttgcggcgctcgcgatcgccggccccatgaccatcggtctcagcccggttgaggccgccgacaccgagttcctgggccaggtcgaagatctgccgctggccccggggctcgccgaggatgcggggggctttacgtttgacaagcccgacgggcgtatcgtagaggcttacgcagtcggtcgtgtgaccggtgcacaggtgatgcgcttctaccgcgacgccctgccccagctgggctggcgcgaggtcgggggtgccgccgccgcatccggtgccggcgccggtatcgccgccttcacccgcgggaccgagcgtctgacgatcgacacggccgagcaatcctccggccgtctggtcgtgcatttcgtgctggcacccgccgagggtgctgcgcgcccctgacagccaggctcccgcccctgccgggaggccgccgggcgtcgggacgtcagtcttcatcgaccggcttcgggaccaggcaggcggcgaaggatcccgcatccgccgccccggtgaagccgacgcgggatcgcggagggagcagacccacatgtcctacaagaacatcctggtcgacacgcgcggcgccgtcgggctgatccagctcaaccggcccaaggcgttgaacgcgctctgcgccgaactgatcgaggagctgaacgcggcgctcgacgcctatgaggcggatcccgagatcggcgcgatcgtgctgaccggcagcgagaaggcctttgcggccggcgccgacatcaaggagatgctgcccaagtccttccaggacgtctacatggaggacttcatctcgcgctgggagcgggtgacccgctgcaagaagccggtgatcgcggcggtgtcgggctatgcgctcggcggcggctgcgagctggcgatgatgtgcgatttcattctggcggccgagaatgcgaagttcggccagcccgagatcaatctcggcaccattccgggctcgggcggcacccagcgcctcacccgtttcgtcggcaagtccaaggccatggaaatgtgcctgaccggccggatgatggatgccgaggaagccgagcgtgcggggctggtcagcaggatcctgccggtggccgagctgctggacgaagcgctgaaggtcgcccaggcgatcgccgccaagtccctgccctcggtgatgatggccaaggaggcggtcaatgccgcctatgagaccacgctgacccagggcgtgcgcttcgaacgccggctgttccattcgagctttgcgctcgaggatcgccgcgagggcatgaccgccttctcggagaagcgcgagccccagttcaagaaccgctgaccacatcccgccgaccggtgccggcccggcgggaatcgcagtggttgcacgacaacggccggcggcgttccggccggagcgctttcggctttgccgataacgtcttgactcaatcgtggaccgcacctatcgtccgcggcctgagtttccccttatcccgaacgtatccgaagggccgaccctgatggccaatcatgtctccgccgagaagcgtatccgtcgcaacgcgcgccgggccgaaatcaacggcgctcgtatcagccgcatccgcaccttcgtgaagaaggtcgaaaaggcccttgccctgggcgacaaggatgccgccgtcgccgctttcgccgtcgccgagccggaactgcgtcgcggcgtgaacaagggcgtgctgcacggcaacaccgcctcgcgcaagatctcgcgcctcagcgcgcgcgtgaaggcgctgtcgcaggcctgagcccgcagcgatccggcgccggatcgtggctgaaactccggaaacccggaggtgacagtcagggtcttcggcatatggtcgcaggcagcccgacatccttcgacgcacggcatgcgatctccgcatgccgtgcgtcgtcgtgtcgggattaatgcagcgcatcaaaagatcgcgttcgcatttcggacccgttgccagccgcccgggccggggctagtctaggccccatcgaatgcaggtccgtccccacagcggccgagcgtaccggaggttccggaccggatgccttgtcaggcatccgatctatcgaatccgaggcatgttcgccgatggtttcgaccgacctgtttccccaagcctttcgaagagcggatgtggacggcgcgtcattcggtgcatggacatcgaatgatgacgcagaggctttgtccgcaggcggccccgagggcctgaccatgcggatcccgtggccccgggccatgcgcgtgtcctttgcctgccgcgtccctcatcccttcgtcctgatctgccagaggagccacgaggcgacgccatggccagcaccgacgacatccgccgcaacgcatcggcccgtacgggcgcccaggccggctatgccggcgacgtcacgcccgaggaggcgtgggcctttctggagcagcagcccgacgcggttctggtcgacgtgcgcacccgcgaggaatggatgttcgtgggcctgccgctgctccagcccctgggcaaggagccgcagctgatttcgtggcaggtctggccgcagatggcgcccaaccgcgacttcaccaatgcgctggccgaggccggcgtcggccgcgagcagccggtgctgttcctgtgccgcagcggcgcccggtcgcgggctgctgccatcgcggccacggctgcgggctatgagacggcgttcaacattgcaggcgggttcgagggggatgtcggccccgacggacatcgcggtacggtcaacggctggaaggcggcggggctgccctggttccagaactgatccgaccgtccgtcaccgccgtgtcgtggcccgagagggggcggcgcggttgccgttcgtccgc

SEQ ID NO: 63 - DNA, 692874 bp, Tistrella mobilis
atgaagatcggcgatctgctgctcgacgacatcgcccagaagccccgcctggccgaggcggcagcccctgccgtcgatggcacggtgctggatgccatcctgcgccgggccgctgcccatcccgaccggatggcggtgcaggatgaagatggcgcggtcagctatgccgggctggtggccgaggcccgcgccattgccggcgtgatcgccgcggcgggccttggcgacgaggcccgggtgggggtgatgaccggccgcagccggcagtatatcgccgccgtgctgggggtgatgatggcgcgggcagcgttcgtgccgctcgatcccgctatgcccctgccccgccggcagatgatcgcgcgggccgccgggcttgccatgatcatcgccgatcgcgaccgcatgggcgatgcccgccgcctggcctggagctgccccgatatcgcccatctcgtctgcccggatctcgacgatccggacagcccgaccgaggcccatggcgcgcggatgagcgccgagctctgggatcatctggccggcagtgccgccgacgacgtcgccgccgccggctggcgcagccccttcaccggccagccgatcgcggaggcggtgatggcggagttcggccaggctgcggcgggcaagctgtccggtctggtcacgcccgccagccgggtgctggaaatcggctgcgcctcgggcttcacgctccgtgccctggcgccgctcgccggcccctatctcgccaccgacatctcgcgccgggcggtggagcgggcgggcggggtggcgcgccggctgggcctcgaccgggtcgacctgaagccgatggccgcccatgacctggacctgctggcggggcgcagcttcgacctgatcgtgctcaacagcgtgatcgaaagcttcccgggcttcggttatctggccgatgtgctgacccgggcggccgggctgctggcgccgggtggcgccatctttctgggcaatatccgcgatctggaccgccgcgacgctttcctggacgatctggtcggctttgcccgcagccatgcgggcgaccccgagatcggcacgcggctcgatgccgccgacgacctcttcgtgccgcgccgcttcttcgaagactgggccgcccgccatggcggcttccgggccgaggcgagcgcgctcgacgtgccgggcttcgaccttgccccttatgtctatgatctggtgctccggcgcgacgaggctgcgcccgcccacccgccccgccacagccatcacgggcgcgcggcgctggccaaagcggcatccggccccctgccggcggcccccacgcccgacatgctcgcttatgtcgtcttcaccagcggcaccaccggcacgcccaagggcgcgatgatcgaacacgcatcgctcgccaatctggccatggcgaccgcccaggtgttctatgcgccgctccacccctccgacacgcggccgctcgatctctgctgcatcgcgcctttcgcctttgacgcctcgatcatccagaccctgccggtgctggcgaacggccaccggctgcatctgcccgacgacgacacccgccgcgatccggccctgcttgatgccttcctgcgggcgcgcaacatcgccatgatcgacctcacccccagccagttcaccctgctgctggaccactggaagacgagcggtacccacgcgcccgtccttcaggttgttctgggtggcgagccggtgaccacggcgctggtagagcggatctacgccgaccctgcccatgccgggttgaggctgatcaacgcctatggccccaccgaatgctgtgtcggcgccgccgcccatgcgatgaccgcccatggctggcgcgagatcctgccgccgccgatcggccgacccttccccggggtggtgatcgagatccgcgatgccgccggccgaccggtgccgccgggtgtggcgggcgaaatcgtgatcggcggccgcggtgtcggtcgcggctatctgggggcggcaggcgccgccacccgtttcgaaaccgatgccgcgggccggcgctggtaccgcaccggcgatatgggccgcagccttgcaggcggggccatcgccttcatcggccgcgaggacggccaggtgaagatccgcggcaaccgcatcgagcttggcgaggtggaaagcgcgctgctcgcccatcccttcatccgcgccgcggtcgcgacgctcgccgatggcgcgctcctcgcccatatcgtgccgcgaccgggcttcgacgaggcccgctgccgcgccgatctggaggcgcggctgccggcggtgatgatcccgtcgcggatcctggtcatcgacgagatcccgctcaccgtcaacggcaaggtcgataccgcccggctgccccggccggccccggccggcaccaaccgccccaccgccgccgccccccttcgcccgctcgccgacgagaccgagcgccgcgtcgcccggatcatgggcgaggtgctggaggtggccgtcgacgatgccgcggccgatttcttccgcctgggcgggcacagcgtgctggcggtgcaactggtcgaccggctgcgccgggcgttcggcgtgaagctgccgctctcggacctcttcgcccatgcgaccgtggaaggcctggcccggcgcctcgcccgccaggcccggacccggcgcgaccggctggtggtggtgaatgccgcgggccatctgccaccgatcgtctgtttccatcccgtcggcggcaatgtgctctgctatcaggcgctggccgccgggctcggccccgaccagccggtggcgatggtcgaagcggcggggctggaggccgacgacacgcccgagccttcagtcgaggacatggtggccgccaccctcgacgacatcacccgcttcgccgccggccggccgctgcacctcgccggctggagcttcggcggcctgctggcgacagaggctgcccgccggctggatcaggcgggtagccccacgggccgggtgctgctgttcgacgccgtcgcctcgcccgatccgatccgcgacatgctggccaaagacgatgccgactacctggcgacacttttcgccggcatgggcatcgccgacgccgccaccttccgcgcgctcgaccccgaaggccggctcgacctgctgatcgaccgcggcaagacggccctcggcctgccggacggcgtcgaccgcgacgccatgcgccgcctgctggcggtgttccagaacaacgccgtcgccgccatccgctaccgcgtcccccgcctcgaccgcctcagcgcccttctggtccgcccgaaaaccgcctccgcccaggccccgggcctccccggcgacccctggaacggctggcgcgaccgcttcggtgccggggtgacgctggcctggatggacggcgaccacgcctcgatgatgatgccgccgcatgtggaggtgctggcgggggtggtgcggacgtatctgggtggggcgccggaggctggcagtgccgcatgacgggacggatccgccggggaaatgggactggccagagcccggatggtgccggaagctgcgcagcgtggaggatcatatcctctggtcatactcggtgctcagcatctcccgcaaggtcatgaaacagctcaaaaccggcgagaccggcgactatccgggaggacggaccaaggccgccaacatcctgatgtccggctatcagcgccggcagaagaacatcacgagcctggaccgcgacgacgccctggcccaggacggcgcccatgtctgcatgcattgcggatgcatctcaccgcgatatcattgggaccatctgatcccgcgcagccggctgcggggagagaccatcccgctcaatcaggtcaggtcctgtcccggctgtaatctgagccgcggcgacagggatctgatgacatggcatcgccagcgacaaaccttcccgaccctgggcgtcctccgtcgctacatcaagctctgctacttctacgccaaagaacgcggcctgctggatgagacggcagatgacgccgtcgccaacgggctgccgttcgacccgagggaattgccgcggcgatatccgcccatcgatcagttggtctgggaccatgcgcatccgacggtcggacgtggatgagaacggcaggtgcgtcgggccgggtccaactataaagcttggcgcccacaagacaccaacgacacgcgcctcagctgtccacaggcacacgatgaaaatgagccggcggccgtagagcatgggcatatactggatatagcctttgatagcggaggcccgccatgtccgcaaaagtcgtgttgacgatagagctggaaccgcaactgcgtgacatgttcatggccgaagcggcggcagacggccgcccgcccgcgcagcttctgcacgatctgatgcccgactatgtcgaccgccgccggcaggcacgggactatgacgacttcctccgccgcaaggtcgagattgcccgccggcaatgggatgccggccgtcacgtctccaatgaggaggcggaggccgatgcggcggcggggcgtgaaaggctgcttcagcgtaccgccgcggccattgttgatgaactcgccccgaccactggtacaccgtcagacctgtgctaatatgtcgtacaatatagcacactcctgagcggacacccgatcatggcgcgaaccacctcaatcaccctcggcgatcactttgccgatttcgtccaaacgcaggtggcgaccggccgctatggctcgaccagtgacgtcgtccgcgccggactgcgtcttcttgaagagcacgaggcgcgcgtccgcgcgcttcatgatgccctgcaggcgggtgaagactcgggtgaaccgcgcctctgggatgacgaagccttcctggcgcggatgatggcccgacatggcggctgaacggccggtccgggtcagcccccgggccgaagccgatctggagaacatttttgcccacaccaccgcccgctggggcatccaacaagcgcagacataccacgccggtttcatcgcagcgttccggaacctggcagccgggcgcgccggcgtgatgccggccgtgcgcaccggctatctgaagctgcgggtgggcatgcacgtgatctatctgaaagaggggccggcaacgatcgatgtcatccgcattctgcatgctgcaatggatgtcgatcggcatttgtgatggccccgctggtgacgctcggatcaaatggcatgctatgtctcggcattgatttagtcgaagcagtcatctaaacttatttcctcgaaataaggggaaataccgatgcgtatctcaaaaaacttggaagaaattcttgataaaactcccaaaattttgacttatatgctgtttttcggattggtctgcgcttcttggtccttagaaaacaccttggatgcagcattttctaggtacattgaagcgctcatgaacgtgcgtgagtggaatgattttggtccgtcaggagtctttacctcaatattgatgattttgatgttttcacacctgaggatgctgagaaaaacatacaaagaaatcagcctgtatttgatcaagcgtacaatataacttctgataccagcaggatacgaagtggatggcaccgccgatccccgatcaggactttccttcccctgcccgcccggccatcatcgcccggtctcaacagcctgagcccgggggccccatgaccgatccgattgccctgtcaccggccgagttggcccggcgcggcgaggcgttcagccgggcctggcggatgaaggaggcctatgccgatctgacggcggcgctgcggctggcgcccgatgatcccgaggcgcggtatcagatgggccggcaccatatgcgcaacggccatgtcgagatggcgttgatcgcctttcacgagctgcggcggcgcacgcccggctacagggatgtggcggcgcggttcgaaatctgccttggccggctgcgcttcccgccacccttcgacatcaccgccgatctgatcgcggcgctggatacagggcagatcgatgatctgcaggcggcccggatcatcgcccgggtgctgacccgccgccacgggatcgccgccgacatggcgctggatgacacgcggatcgcgaccattacgagtaatcggctattccgcctgtatctgcgaatgtgccgcaacatcgacccggcgatcgaggcggtgctgtgccgcctgcgccgccgggccgccgggcttgaaccgggccccgccctgccggcgggattgctggccgatcttgccatcggcttcgccaatggcgattacgttgtcgactggccggccgacgaggcggcggtggcagaccggctgcggaccgctctgacgggggcggaggccgtggtgccgggggctgcccccagcctggtgatgaccctcgcgctttacgaggcaccgcccgtcgcagcggtcgtgcagatccgatccgcggctgcggatgacgacggtatcgccgccttcatcacccggttccacgacgagcctctggcgctggcagccgagccggtggcgacgctcgggcgcgccgagccggcgaccacggatgccgtgtcgacgcgcgtccgccgccagtatgaaatggcgccctatccgcgatggcgcgggctgtcgccacgggcgggcctggattttcgggaaacgctggcgcgctccctgcccctggccgagctaccggcgagcgtgaccgggcacctgcccgcccggcccgatatcctcatcgccggctgcggcaccggccgccatccggcccgccgggccagggcgaccacctgcgggtcgctgctcgccatcgatctcagccacgccagcctggcctatgcctccctgaaagcgcgtgagctgggccttgccgacgagatccgctttgcccgcgccgacatcctcgacctgccggcactgttgccgtccgcgagcttcgatctggtcgaggcggcgggcgtgctgcaccacatggacgacccgttccgcggctggcaggtgctgcgcgatctgctccgccccggcggctggatgcggatcgggctctacagccgcaccgcccgccgccacatcacccgggcgcgggcctggctggccgaccggaactggggcaaaacccctgaagatatccggcgcttccggcgggagctgatcgccggccggctggatccggcgctggagccactcgcggccttcgccgacctccacaatctgcaccacctgcgcgacctgctgtttcacgaacaggaactcaccttcacgccagagatgatccgcgaccacctggaccgcctcggcctgacatttgcaggcttcagccccagccagcccgaaatcctgtacgcttatcgccagcgtttccccgaagatcccaccgccaccgatctcgaccgctgggctgccttcgaagccgatcatccggatgcgtttctcgggatgtatcagttctggtgttatgacccgcattaaggcgacgtgatccctggcgggaatgccatccggcgtcaaagcagcggccgcagatcggcacatcttccggagtgatgagcgaactttcagagttccatttggtttagaaatgctatctatgatatctaatatctataatatgtttcttattggttagatatcctcctgccggctcgtcatactatgggattggctcattcaaaccgatggagatgccgatgtccctgtaccgccacgagagcacccccacccccgtcaaggccgatgcgcttcgccctgcacgcaagacctggcagcagccggtgctgagtatcgaagccctgagtgacaccgccgccgccccgtacaccgtgagcgacggcaccatcgcctcctgagacctgcccgcagtctttccgatccgcccgggattgcgggtgcaacggccgggtccgcgccccgctcgcgggcttgccgctgccggcgattgtctgcgcccttgccgatcacggcagctttaccgcggcggtgaatgccgtgcagtcaaccctgaccatgcgggtgacggagctggaggccgagccggggtaacccctcatccgccgcagcaacggcgtcatgaggcgccgacatcccagccggaaccgtcgtccggatttctgcctatagtagatttcattatcgatataatcgtcataagttattttcttcacgcccaacccgtgataccacatgcctgatgaattcaacgaatggagatggagatggagatgtcccccgactgccacgacaacagcacccctaccaggaccggtcccctcctcgcggcacgcacgccctggcagcggccggtactgaacgtcgaaaacgtggaaagtactgcaggcacttttagcggttcgatcttcgacggcagcttcacctcctgatctttgcccgactatacgcccccgtcccgatgctatagactgatgcatcgccctccgatgcatcacttatggtgattcattccccatggacctgcgccagctgaagatcttctgtgccgtcgtcgatcacggcagtttcaccgcggcggcagaggccgtgcacaccgtgcagtccaacgtgaccatgcgggtgaaggagctggaggccgagttggggcagcctttgttcatccgccgcaggagcggggtgatgccgacggcggcgggggagatttttctcggctatgcgcggcgcatcctgcagttgaccgaagagagccgggccgccctgcaggatgacggcagaccgatcggccccttgcggctgggggcgatggagaccaccgccgcgatccgcctgccccggctgctcggctcatatcgcgcgcgccatcccgaggtgcggatgtcgctcaccaccggcaccacggccgagctgatccgggcggtggaaagctgccagctggacggcgccttcatcggcggccggcatcagcacccggccctggttcaggaggcgctgttcgacgaagagctggcgctgatcagcaccagcgatatcacatcgcgcgacgccctgctcgacaccctccccgatcagacggtgttcgtcttccgggccggctgcttctaccgctcgacgctggaaagctggttccatcaggccgggctggtgccggggcagattatggaaatgggcacgctggacggcattctgtcctgcgtcgccgcgggcatgggcatcaccctgctgccggcatcggttgcccgccaatccagtctggccgatgcgctgcactgccatgccctgccggcaggcgtggccaccgtcaccaccgttttcatccgtcggcgcgacaccctgccgggcgcggcgctgacggcgttcatggcactcgcccgggcgacgttccagccatcgccgcttcggccgccgcagccggcagaccctgaatgagttccgccatgcggtctgcggcgggaacgatatcgtggatacggcccaccccctgcccggcatagagcgacagcttgcgcgccagggccggccggtcgatcgcacgtgcgccaccacccacaaggcgcagcaggttccagcggtcgcgattggggatcacgcgatgcggcgtgccgtagcgccatccgaaggaatagccggtgcgatattcggtatcgtcggtggtggcctcgacgatcttgcgcttatagagcgggtgcgcctcggattccgcgctcgccacgaaggccgtgccgaccagcacccccgcggcacccagccccatggcggccctcacatcctcgcgcgtggtgatcccgcccgccgccagcaccggccgcccctcggcagcggcgatgatcgccggcagcagcgccatcaacccgatggtgccgcgattgagatgcccgcccgcctccgccccctgggcggcgatgatgtcggcgcccgccgcgatcgcccggcgggccagcgccaccgtgcccacctgcaccatgaccaccagccccgccgccttggcccgcggaatcatctcggcgccgtaatcctcggcatagaacagcgacagcagccgcggccgttcctgaagcaccacctgaaactgcgcctcgaagacctcgggcccgccgaattgcggcaccagattgacgccgaagggccggtcggtcagcgaccgggtctcgcggatccatcctctgagcgtccgcggcggcagacgcagcccgccgagcacgcccatgcccccggcattcgccaccgcggccaccagccgcggccccgaaatcgccgccatgcccgccagaaacaccggatggcgcacaccgcagagccctgcgacggcctggttcttcgcctcgaccatctctcacagctccacatgcttgccgagcatccgctgcacggccggggtcttgagcacgacgtggcttttccaggcgccgaacagatgcagcgccagcccggccagaaatgccgtgccgccgatcgcgaacagcgtgtcgaccagggctttcagcccgggggcgggatcgatcagccgcggcagggcgtggccgcccggcagaacgaccgccgcgccgcccgccgccctcgacagccacaccgccgccggcagcagaaccatggccagggccagcgccgccgcgaccgagcggctgacgatcacctccaccggattgggcgtgcccaccggcagcggatgaaccgaggtgatccgtgcataaaaccggtagatcgagaccagaaacagcaccaggcccagcaggttctgcacctccgccagcccagtgtccgccgccatgtccgccgccctctccggccccgcggccatcgcgatctccagccccaggatcgccaccagcaacgccgccaccatccagtgcagcacgatggtgaccggcgaaaagccgagtccgttatcccgccattgcatgatgtcctcccgccgtcacggccctgttgccctgtgcccgatcggcccccgtgccccaccctagcggcggcaatacatcatgcataatgctgaatattgatcttttccatcatttaaaatgatgtctaagtgcgtcatcacgtctgttgaaggcggtgtcgccgggcatatgatgggttggtgaacgcatttgcgcgacgggggcccggccggcatcccccttcgcgcggcagggagatgacgctgatggacaccgtcgcggccacagccattgcgcgacgcctctgctggaccacgcgcccgacggcagcggcactctcgcccaaggccaaagctgcggcctgccgcgccgctttcgcgcggggccgggccacaccggccactggcctgttcctgctggacgccctgttcaaggccggcgcgttcgacgaggctctcgcctttgccggcgacaatccacgtccggaggggacggatccggcctgggatatcagcctcatccatatcctgctggcgacggggcaaaaggcgcgcgcgctggcacaggcagaagccgcgctcagggtcgtgcccgatcacatcgggctgctgcgcgaacgcgccgagatgctgatccggctgaaccggggtgccgaggccgtggcggatgtcgtgcagctgctggaacggggcgatcaggcgctgagcccgctgatgaccaggcttctgatggaacacaaggatccggcctggttgctggcgatgctggaccgccggcccgcgcttttcctgcccggcgaggcaccgctcacccgggtgcagtgcctgctggccctggggcggacggcagaggccctggactggatggatgtcgacaggctgctgttgcaggcgccgctgcccctgcccgttatcggcgatgccgatctgtttcgccgggcggtcgtcgacgagatcaccggggctgccgccacgggccccaaaccctccgatgtctcgactttgggcggggtgcagaccagcgtgccgctggacggcatgacccatatgccggttctgctggcggcgatcagggcccggatcgaccgctatgcggacgacctgccggccgatcacccgttcacggccatgatgccgcgggcggcaacacttcaggcctggtcggtctgccttggcccgggcgggcggcaggcaccgcacacccacccgtcaggctggctcagcggcgtcttctatcttgccgcacccgaggtggatgaaactgccggagcactggtcattcccacaacggccgatctgccccggaccctggtgccggaagccggaaagctggtgctgttcccgtcctatttcatgcacaccaccctgccccaccgcagcggacagccgcggatctgtgtcgccttcgacgtggtgcccgaccatgccaccgccggcgccggggtgccgtgatccggccaggtcaccccgcgcgcatcaccatcccatacagatcccgcggatcgtccggatcggccagcaggtccagatcctgggcgaagggcgtctccgccacccggtcgcggatatagcgcagcgccgaaaagtcttcgatcgcgaagccgacgctgtcgaagagggtgacggcatcggcggcacggcggcccggggcgtcgccggtcaggacctgccagaattcggtgaccggatggtcgggggccagctgctggatttcgccctcgatgcgggtctggggggcgtattcgacgaagatgtcggcgcgggtcaggatgccggccgcaagctcggtcttgcccgggcagtcgccgccgaccgcattcagatgcacgcccgcacccaccatgttgtcggacagaatggtggcgcggcgcttgtcggcggtgacggtggtgatgatctccgccccctccaccgcggcctcggccgagcggcaggtggtgatggtgaagccggccccgtccagattgcggcggaatttggcggtcgccgccgggtcggtgtcccagagccgcagccggtcgatgccgagcagggcgcggaaggccagcgcctggaattccgactgcgcgccattgccgatgatcgccatggtcgcggcaccttcaggcgccagatgccgggcggccagcgccgacatggcggcggtgcgcagcgccgtcagaatggtcatttcggtcagcagcacgggatagccggtcgccacatccgccagcatgccgaaggcggtgacggtctggcggccgctggcggtgttcttcgggtggccgttgacgtatttgaagccataggcgcgccggtcggccgcgggcatcagctcgatcaccccatcggggctgtgggcggcgatgcgcggggtcttgtcgaattccggccagcggcggaagtcgtcggcgatatagccggccagatcggccagcacccgttccacccccagatgcagcaccagcttcatcatgtggtcgaccgagacgaagggcaccagattgagcgtggcgggggtgtgcaaagcggtcatgaccggtcactccgtgtcggatagtccatgacccggcggcccagcaggctggccagcaggtcgaccatcagcagcgcggtgcggccgcgctcgtccaggaaggggttcagttccaccagatcgacgctgtcgaccagccccgcctcgtgcagcatctccatcaccagatgcgcctcgcggaaactggcgccgccgggcacggtggtgcccacaccgggcgcgatggcagggtccaggaagtccacatccaggctgagatgcagccgcccgccggccgcctgaacccggtccagaaacgggcggagcagggcgaccatgccgtgttcgtcgatgcggcgcatgtcgtgcacggtgatgcccgaagccgccagcggcccgcgttcggccgcatccacgctgcggatgccgatcatgcagatatgggcggggtcgaccagcgccgcgggttccgggaaatgcccggcaaagcccgaccggccggtggcataggccatcggcacgccgtgcagattgccgctgacggtggtctccagcgtgtggaaatcgggatgggcatccagccagagcacgaaaaacggccgcccttcggccgcggcccggcgggccagcccggtcagcgtgcccgccgccagcgcatggtcgccgcccagaaacaccggcagatcgtcgggcccggcgctggcggcaaaggccgcatcggcgatcgccgcagtccagccggcgatgcgggccaggtgtttcagcgccggattgtcatggggtccggacagacgatccgtgcgggctgtcgggtcggcgcggggcgccagatcgccctcgtcggtgacgcgatggcccagcgccgccagcgcctcgacgatgccggcggtgcgaaaggcggccggccccatggcgcagccacgccgcccggccccctcttccagcggcacgccgatcagccggcaatggcgcggccgctccccctggtcgttctccgtcatcgggcagttcccttcctgtccggtgatcacccgacaggaatcgaaacatggccgcgcggcggagtggagacggcagatcggcgaaaagcgctgccggatttaccggatcggcagccccttccgccgaaatggcagacctcttgtaaattacgccgcgccgaaggcccaggacatgtagccaaccacccgccgccggtcgggttcggggaaggcggccagcgccgacatcaccgccgcaccgaccacgccgcccaggatgcacagcccggcgcggctttcgcagaagccgcgggatgccgccgcctcggtctgcggcggctcgatcgcccgcacgcggatcaccggctggctgcgatgggtcacggccggcgtggtggtgtgggcagtggcggcgggggcgacaggtgccggtgtcggggccggcgtcaccacggccgccagcgccgtgccggccgcccggccattggccagagcatcgatcgaggcggtgcgcaccggcaccgatttggggctcagcgcatcgtcgcggtcgaggaaatagaccgtgacgttctcccccggccgatgcgccgcaattgcggtgaacacatcgtgggtgcgctgcaattcggtatcgtcgatccggaagaggtaatctcccggcgccaccgtgcccgccagcggcgagccggcatcgacctcggcgacgcgaacgaagatccggccgtccttgcgatagggcaccgcttccagcgtgatgcccagccgggcgccctgatccgccgccagccggccggcggaccagtcatgcgcgaagggtgccctcccctcgccaaaaccgcccgcgccgaaaccgcctctaccggaaccgccgatatcttgggaagcttccgcggcgagcgcgggtccggacatccacgacaggctaaagatcaacgacgcgacaagcgccttcttcatctgtcctccccggccgatgtttcggcctgtctcttatatttatgagaaggatggtaaaggagggtagtcccaagtcaacgcacaaaaacaccgactcggaaatgctgcagagcaatatttgtctcggattggttgaaaatccgatccggatcgaccccaggagcccccgatgtccccgccagagctcgacccgctggaccagcgcctgatcaccctgctgcgccatgacggccggcgcagcatttccgacctcgccatcgatctggaggtctcgcgcgccacggtgcggacgcggatggcgcggctggaaaaggccggggtgatcctgggctataccgtcatcctgcgcgccgatgcggtggaagatcccgtccgcggcattatgctgatcgaggtggagggccacgccgccgaccgggtgatcaaggcgttgagcggcatgcccgccgtccaggaaatccacaccaccaacggccgctgggacctgatcaccaccctctcggccaccagcctgcccgatctggaccaggtgctgcgccgcatccgcctgatccccggcatcaccgccagcgaaaccaacctgctgctggcgacgccgcggacgacgcgggccagattgtgagacgctgtggacagccccgctctggacagaccggggtacgctctgtcatggtggactcactggcattgtaaagggcattgcctcttataagggacacgagatatggccgacgccgcagtgttcgatctggtcattcgtggggggcgggtcgtcgacccggaaaccgggcatgacgccgtggccgatgtcgggatcacgggcgaccggatcgcggccatcgggccggcgctcgcggccgggcggcgcgagatcgatgcggcggggctggtggtggcgccggggttcatcgatctgcatgcccatggccagtcgatcccggccgaccggatgcaggccttcgacggtgtgaccacggcgctggagctggaggtgggcgccctgcccgtgggcgcctggtacgatcatcagcaggcggccggccgggtgctgaattacggcgcggccgccgcctggctgttcgcgcgcaaggcggcgatgatcgggctggacctgaacagcggcctgccgccgatcgcgatgatgggcgcgggcgccggtgacatgcgctggtcggtcgatgccgccacgcccgcccagaccgagaccatcgtcgacctcacccgccgggggctggacgagggcgcgctcggcatcggcattccccatggctatgcctcgggcgccgggctgaaggagatgagccggatctgcgcgctcgccgccgcctatgatcgcccgacctatacccatatcgcctatatgtcgaacatcgaccccagaagctcggtccaggcctatgtccagctgatcggcctggcgggtgccaccggcgcgcatatgcatatctgccatctgaacagcaccagcctgcgcgacatcgaagaggccgccgggctgatccgtaccgcccaggcccagggcctgccggtcacgaccgaagcctatccctatggcaccggctccaccgtgctcagtgccggctttttcatggaaagcgatttcgccgagcgcaccggcaccggctatggcgcgatcgaggtggtgagcaccggccggcgtttcggcaaccgcgacgaactggccgcggcccgcgccgaggcgccggaagccctggtgctctggcatttcctcgacaccgacgacccgcacgacacgaagctgctcgacatctcggtcaccttccccggcggcgccatcgcctccgacgccgtgccgtggagcaaccccgacggctcgctctatgacggcgacgcgtggccgctgccggcggacaaatcctcgcatccgcgctcatcgggcaccttcacccgtttcctggcccaatgggtgcgggagcgcgaggtggtgccgctggtcgaagccatggccaaatgctcgctgatcccggcgcagatcgtggaaagctgcagcagcgccttccgccgcaagggccggcttcagccgggctgcgatgccgatatcgtggtcttcgatctggcccgggtgcaggaccgcgcgaccttcgaggccatgcatctgccggccgagggcatggtccatgtgctggtcaatggcgaggcagtcatcgccgacggcgccctcgtcaccgaggcccgccccggccggccgatccggagcgatcccagatgaccaccgcgcctgcaaccgcgcctgtccccgtcctcgtcgtcaccgggtatctgggggcgggcaagaccacgctgatcaaccgccttctggccgatgccggcggccggcgcatcgccgcgatcgtgaatgatttcggcgcgatcaacatcgacgaagagctgatccgcgcccgcaccgataccgtcgtcggcctggcgaatggctgcgtctgctgcaccttgcagggcgatctgttgcgcacgctgaaactgctgctcgccgacggtccgtctccggatcacatcatcgtcgaggcgagcggcgtggccgacccggcgggcatcatccaggcgctgtcagacccggtgctgtggaagagcacgcggctggatgccgtgctctgcgtggtcgatgccgaggatctggtggcaagccccgcccggcgcgccgacccgctctggcaggcgcagctggcggcggcgagcttcgtggttctcaccaaggccggcgggctcgacgccgcggcggcggcggatctggcccgcagcctctcgccccggggcaagccgccggtgatcgacaccgcgcgcgaacccctgcctgtggcgctgctgctggatggcggccccgacctccccgccctgcccggccgacgcttcaccgccaccgccgcaaccggcgagagtcatgccggcagccgcttcgccaccaccacctggcagagcgccggcccggtcagcctggtggcgcttcaggcgctgatcggcgcgctggcgccggtgctggtccgcgccaaggggattttccggtttgccgaaaggcccggccagacctggctgctgcagatggtcggacagcgggtgacgctggaaccgctttcaggagactatccggaaggctgccgtctggtcatgattgccgaggccgggcggctggatggcgatgccatcgcggcacatctcggaccacagacccatcgataaccggaagaagaaccgcattcatgcagcgtgcgaagggcaccgaccgcattctcgacattctggaacatctggaaacggagaccagaccggtcagccgcaatgcgctggccaaggcgctgaactgcccgcggtcgacgatctattccctggtcgaccagctggtcgcccgcgactggctgacccaggacgacagcggcaccatcagccttggccatcgggtggggctgctgggcctcgcctattcacgcaatgcacggttcgagccggtggcgcgcgaggtggtgcagcgggtggcgagcgaggccggcgtggtcaccgaaatcaacatcgccgacagctggcaacagctggtgctgatttcggccaccggccgcagccgcaactatctgcgcacggtggaaggctcgcgctaccccctgccgatcaccggctcggcgcggctgcagctggccgacatcccgcgcgacgtgatccgccgcaacatccccgacgaagacttccgcctgggctcgggtgagattctgcctttcgagaccttctgcgccgaaatcgaccaggcccgccgcgacggccatttcatcgcccgcgggctgatcgaccgctatgtcggcacggccggggtgccgatcctgaaccgccacggccactgcgtcgccaccctcagcatcatcctgccccaggccgatctggacgcgcgccagaacgacctcctcgacctcctgcgccgcggcgccgacgaattgtcgggctacctccgcgccgccgtctggccgatgggggatcgggcttatgggcatctgtttcatgatcgggtggggggtgcggtgggcgtgccctgagaggggggcttgaggctgggacggaggcagagggggcgcagatcgccgggttccgtggttttgacgctttcgctgtcgatgaacgcacccgagggccggcttcacatccgacccgttcgtccgggtgtaagagcccgtccggaatgttattgaatccggtgaatctgttgtgattcgatgccgccccaaaggaaatgggagcggacagaatggggaccggaaacccgccgtgtttatgagcggccggggctgagatacccgagcgacctgacggatgaagaataggcgctggtcgaaccgctgatcccgcccgcgaagcgcggcggtcgacagcgcacggtcgatgtccgcgacgttctgaatggcgtggtctatgtgctgatgaccagctgccaatggcgggccctgcccaaggatctgccgccgcggagcacggtgcatgaatatctgggtctgtgggaacgggatggcacgctggcgcggatccaccatgccctgttcgtggatgtccgcgaactggccaggaaagagaccggcccgactgcggcaatcatcgacagccagagcgtcaaaagcgcggaaaaaggggggcgcggatcgatccgtcgggctacgacgcgggcaaaaaggtcaaaggcaagaagcggcacatcgtcgtcgacacgctcggcatgatgctggaagcgcagatccagcctgccgacatccaggatcgggacggcgcgttgccggtgctgaaagaggtccgccgcctgtttccgttcatcgagcgcatcttcgccgatggtggctatcaggacgccgcacggctgccgccgtgcgtgaactcggcgtctggcacctggaaatcgtcaagcgttcggataccgccaagggcttccaggtcctgcccaaacgctggatcgtcgaacggaccttcggatggctcggccgctgccgcaggctggccaaagacttcgagaacctctcacggatggctttggcattcctccgcctcgccatgatccggatcatgatgcggagaatcgcaaggagctggaaatcatagataacttctcggacggactcttggaggcggcgcatagagttccgttcacgcctcaaccctcctgctcctcgtcaggaagatcgcccgggtagcaggcgtttttagtcgggctctgagtggatcacggtagaaccaggtgccgggatccatcgtgtagagcggaggactctccttttagatgctactcctctctatactgcgattcccaagctctgctaccaatagtgggggcggaccttcaagagggaggaacggatgaagatcgccaaactaaagatcaccaacttcaagcgctacgaagagactttcacattcgccatgaacgatggcctgaacgtaatcgttggcggaaacgagtccggaaagacaacaatactggaagccatacatttagccctgacagggatgttacacggtcgcacactcaataatgacatcacgagctatctttttaatttaaatacacaaagcaaatacctaaacagcctcaagacctcatcgcctctcccgccgccaacaatcaccatcgaactgtttttttccggaacatcgagcgaactggccgaactggagggcgatgggaactccgaaaaaatcaaagccagcggcgtcgtctatcggatcgaatttgatgaagaaaactacaggggtccgtatgaggcgctattgaaggccggagaactaaattctattcccgttgaatattataccgtgaccatgcggtcgttcgcacgtaggggcatcactgcgcggaatatcccgatcaagtccgctttgatcgactcgtcgagtacgcgcctgcagaacggttctgatgtgtatgtttcccggattattcgagatatacttgacgaatccgatcgtgcatctatttcacaagcacataggaaattgagagacgcctttgtcaaagatagcaacctccagctgattaacgagagaatcacgagaactgcaaagatcagtcagaagtcagtcagcgtctcagttgatctatcatcccagactgcttgggaaagtagcctgatgacatacatcgatctcatcccgttccagtatattggtaagggagaacaatgtatcatcaagaccaagctcgctcttagcgccagaaagacgacagaagcgaccgtcatcctcttggaggagccggaaaaccatctgtcgcatgcgcggctgaacgaacttatggcagacctcaccgatgaacacgggcagaagcagatcatcatttctacacacagcagctttgttgccaacaaactgggacttgatcatcttatcgtgctgcgcgatggggaggtcgcgcggatatccgaattgacggcgagcgacttcttcaagaaattggcgggctacgatactctgcgcttggtgcttgctcgcaaagttatcttggtggagggcgattccgacgaactcatcatccagcgagcctatatggatagaaatgacggcaaactgccaatccaggacggtatagatgttatttcagtcggtacggcgtttctcaggttcttagaactcgctgacaagctcaagattccggtcgccgtagtgactgacaatgatggcgacgcaggtgccgtcgagaaaaaatactccgaatacaaagaatcacaaaatataaaaatttgctttgacaaagtcgtagatgccggtgaattaagaataaaagataaaccatataattataatactctggaaccaaaaatccttaaatcaaataatttgtctatattaaatggcatatttaataaaaaattaaaaacagaagacgatcttcgaaagtacatgaagaataacaagacagaagttgcactggcgatcttcagttcggagaccgccattgactatccagactacattatcaaggccatcacgctatgatcgacaacaacaagattattgtcgccgccgccggttcaggcaagaccacctatctcgtccatgaggcgatgaagatcaagggggaacgggtgctgatcacgacctacacagagtcgaacgaggcagagatccgccaaaaattcttcgagatcattggacatgtcccggcccatgtcgtgatcatgacgtggttcagtttcttgatcactcatggcgtcaaaccattccaaggtggtttatttgatttccaggttgttggcatgcagctagtctcgaagcagtcggggctgaaggtcaatagatcaggaagccatccgatttactggggcgaaagagatttcgagaagcactattttgattcaacccggcgcatatattctgataaactttctaaattagtgattcgctgcaataaaaatagtaatgaatctgtgatagaccgaatttctcgcgtattcccacacatattcgtcgacgaggtccaagacttagccggatacgatttagacatactcaaagccctagcgggaagccctgcacgcttacttatggtcggcgacccgcggcaggttacatatttaacacataatgaaaagcgttacgcgaaatatactgatggcggtatcgtggatttcctacgccataaatttcccagaaaagtcgctgttgagatcgatgaaactactctaaatcgctcgcatcgcaacagcgttgatatctgtgcgatttcgtcccgtctatttccgaggttatccgccagcgaagcctgcgaatgcacgtgttgccggtcaggcactccacaccatgcaggcctcttcattcttagaaccgctgactatactcattatctcgaaatgttccggccaatgcagttacgcgataaagtcagcagtactggggttgacaaccgattttcggcgatgaactttggagaagcaaagggtagagggtttgatcacgtcgtcatcgtcccaactagccccatgaagcaatggctcatcaatcatgagttcgatttaaaaccccagagcagagctaaattttacgtagcccttacccgtggccgatatagcgtggcgatcgtcatggactggggttcagaacctctgccggcaggcttttcactctacgaggccgcacagtccgcttaagaaccatcaccagcaaaacacacctgagatatgtgagcaaccggaaagacgggtaacacttcagaccggagacataggtaacagctcaccccggttccggccttggtttggtgcgggatcgcgatcccgcaccaaacttttcaaagcccgctttccccctgatcgagcccagcgcaacaggcccgtatttcaccagccaggtctcggggccgatcaagaacagcccgaccggctcgcctgagagcacctcggtcagaaacaggcttcggtttcgccatttgatctctcccgtcctgcgcactctccggatctcggcgtcatgcggatagtctggcgatcgcagccggccgtcaaaacgccgtggcgagggctggtagcgcgcggcgggtacctcataatccagcgcttcatgcgggcgctcgtggttgaagctctggcggaagtcccggaaccgctgcatctgctccttcaggctccgcgccggcggcgaggccgtttcttcctgaagcgtcaggtgcatccgctcatgtcgcccgttctgttgcggcttgccgggctcgatccgctccggccggatgccagccttgatcagtcgtaccgccagacgggacaggcctcccgcaccccgcccggcaaacggcgctccattgtccgagcgcatcgccgtcggcagaccaaactcgtaaaacgcgctttccagaaccggccacacatgtgccagatccggacggccgaccgcctcacaccggatcaggtatcggctctccgcatccgtcaccgtcagagaatccacctggatcccgtcgccggtcagaaaccagcctttgaagtccatgcaccagacgtcgttcggcgcccggcagctctggaacgggtgggattgcggcccgatgcgccgacatctcttgcgcgcccggctcaacccggcctcgacaagcatgtccccgatcgtgctcgccgccggccagcacagatccggagaccgtgcctcaagccaggcatttaccttgcgaggcccccagcgaggaggtgcacgacgcacatccagaaccgcctcgcggatctccgcgccaaccgctcgcggattgccatgcggcgcacgcgaccgatcctccagcccgcgaacctcgtcacggcgatagcgacccagccatttatgccccgtcttacggctgatgccgaacacacggcacaactccgagatgctgtcgccgccctcaaggcacgccgacacaaaacacaaccgctcatccatcacacaggtctcttgtcacgccatggtcgcacctccgcgaccatcttgcacacctgttacccatgtcggcgggctgaactgttacctatctacgcggtctggaccacccctcacccccccaaccccaactcccccggcagcttctcattccccgccaactcccccgccagcatccggccggtggtcgggcccagggtgaagccctggtggccgtggccgaaattcagccacagtcccttgtggcggggggcccggcccacgatcggcagcatgccgggcaggcaggggcggttgccgaaccaggcttccgattcgaccggggtgcccaggtcgaacagttcgccggcggccatgcgggcgcggtcgatctggtggcgggtggcgccggcggtcaggtcggtgagttccgcgccggtcagcacccgcagccccttgcgcatcggtgccaccacgatgccgcgatcggcgtcgatcagcggcaggtcggggccgcggccgccggtgaaatgctggtgatagccgcgcttgaagaacatcgggatgcgatagcccagtggccggagcaggtcagcactccacggccccagcgccaccaccacatgttcggcctcgatcggcccgtcggggccgtcgatccgccagccgccggcggtctggcggagcgtggtggcatcggccgtgacggtggcaccgccgcgcgcgctgaacagccgggcataggcggcggtcagggcgcccggatcggcgcagctccaggcatccgtccagtggaccgcgccggcaagcccgatgcggagcgtgggctccgcgcgggcgatgtcctggccggtttcgatccgcgccgccacgccgaactcccgccgcagcctttcggcctcgtgcaccgcctgatcgaagctcctgggcctgcgatagacgtcgcgaaacccgtcgcggcggatcagatccccggcgccggccgcctcgatcagcggcgcgtgatcctctccggcctggcggatcatcgcgctgtagaccgcggcgatgcggcgatggctggcgggggcggaggcgaggaaatagcgcagcaccggccccgcccagcgatgcagcgatcccgcccgccagcggaccttgtcgttgaagcccagcgccgccgacaggatctcgcccgcctggcgcgggaagggatagggctccaccgcctccatctggatgatgccggcattgccgtagctggtttcctcccccgccggacgacggtcggccagcgtcaccgccacgcccagccgctggagtgccagggccgtgccgacgccgaccatgccggcgccaagaacgatgcaatccttcataaaaatcagatccccgatgacagaagacaatgagaggaaaggttatgcgcccgtctgaaggttatgcacccggccggaggggcgcaatctcgcggcaggcggcgaaatcccagccgcggccgggggcggcgtcgatcagcgcatgggtataggcatggcgcggcgccaccagcacccggccggcggggccctgttccaccacccggccctgctgcatgacgatcacctcgtcgcagatctgggccgccacccgcagatcatgggtgatgaacaggatggcgatgcccagctcgtcctgcagccgttccagcagtttcagcacctggtcctgcaccgagacgtcgagggcggagacggcctcgtcggcgacgatcacctcgggttccatggcgaccgcccgggcaatggcgatgcgctggcgctgcccgcccgagaactgatggggatagcggtccagggcatcggcggtcaaccccacggtttccagcaggtcacgggcgcgggccagcgcctgatcgcgcgtccggccgaaattcatcggcccctcgatcaggctgtcggcgatccgccgcctggggttgagcgagcgatacgggtcctgaaacacgatctggatcttcgcgcggtgccggcgcatggccccgggtttcagatgggtgatgtcggtgcccgccaggctgatccggccctggccgggatcgatcagccgcatcacgcagcgcgccaccgtcgacttgccggagccgctttcgcccacgatgccgatggtccggccgggcctgagggcgaagctcacatcctcggccgcccgcttcgccagggtcggtttcaggaagccgccgctccgataggtcttgcccagccccgccacgtccagcaccggcgggcgggattgcggctcccggggcgcgcgcggccgcaggctcggcaccgccgccagcagggcgcgggtgtagtcgtgttcgggggcccggaacagccgttcggcaggcgccgtctcgaccagccggccctggcgcatcacatgcaccgtatcggcgatttccgataccacgcccatatcatgggtgatgaacagcaccgccgtgccgtgcacccgctgcatctcggcgatcagcgacaggatctgcttctgggtggtgacatccagcgccgtggtcggctcgtcggcgatcagcagggccggttccaggatcagcgccatggcgatcatcacccgctggcgctggccgcccgacagctgatgcggataggcccgaaagatccgcgcgatatcgggcagatgcacctgttccatcgcttccagcacccgggcgcggcggtcgggtcccttcagtctggcatgggtgtccagcacctcggcgatctggtcgccgacccgcatcaccgggttgagcgcggtcatcggctcctgaaagatcatcgccatccggtcgccgcggaggtttcgcagctggcggggcgtgcggctcagaagatccgtgccctcaagcatgatcccgccggaccgcaccttcagaacgccgggcggcagcagccccatgatcgcgagcgaggtgagcgacttgcccgacccgctctcgcccaccaggcaggcggtctcgccctgtctgatcttcaggctgacgtcgtcgagcaccggccgggggccggcggcggtctcaagatcgatgcacagccggtcgatggcgagcacgtcttcggccgtctcgaaaccggtggtcttgaacctggtcgtcatcggctcagccctcccgccggcgcatgcgcgggtccagcaggtcgcgcgcggcatcgcccagaatgttgatcgcgagcacgcagagcgacagcagcagccccggccagaagatcagcgacggcttcagcaggaaatagctgcgaccctcggccatgatattgccccagctgggcgtttcggtgccgatgcccagccccaggaaggacaggatcgattcgatcaggatcgccgaggcgcagatataggtgccctgcacgatcagcggcgccagcgtgttcggcatcagatgccgccacaggatcaccggcatgcgcgtgcccagcgtcatcgccgcctcgacatagggttcctcgcgcgccgacagcaccaccgagcgcaccagccgcaccacccgcgggatctcggaaaaggtgatcgccaggaccaccgacaggatgctggcgccgtggatcgcgaccagcgccaccgccagcagcaccggcgggatcgccatgaaggcgtccatcacccgcatgatcaccgcatcggcggtgcggaagaagcccgcgaccagtccgatgaccagaccggccatgatgctgaccgccgcggtgccgatgccgatcagcagcgacacccgcccgccatgaagcacgcgcgacagaagatcgcggcccagcgcatcggtgccgagcgggaaatcaccccccggcggtttcagccggttcagcggcgacagcgccagcggatcatgcggcgccagcagcggcgccagaagcgtggcgagcacgatcgccgccagcaccagcacggccaggccggggacgatcagcgccggcatctgacggatcgaacggaacatctctgccatcagtagcggatccgcgggtcgaagagggtataggcaaggtcgatcaaaaggttgaccagtacgtagaggccgctggtcagcaggatcatgccctggatgaccgggtagtcgcgggccatcaccgcatcgatggtcagccggccgatgccggggatgttgaacacgctttcgaccaccaccacgcccgacagcagcatggcgaagccggtgccgaccaccgtcagcaccggcaccgcggcattgcgcaggccgtggcgcagcagaacccgggtctcgcccacgcccttggcccgggcggtgcggatgaaatcctccccagcacgttcagcaggctggcgcgggtcatgcgcgcggtcagcgcgacataggccgcggtcagcgtcagggcgggcaggatcgcatggcgcaggaactccccgaacccggccgagggcgcacgatagccctggaccggcagccagcgcagatcggcggcgaagatcttgatcagcacatagccgaccacgaaggccggcaccgagaagccggcgaccgagacgatcatcaccacccggtcgccgatgcggccatggcgccaggcggcgaaggtaccgagcggcacggcgatcgccaccgacaggatgatggtcagcaccgcgatgttgagcgtgggccagatccggtcggcgatcagcgcattgaccgacgtgcccgacagaagcgaggtgccgagattgccctgcagcagctgccccacccagtggatgaactgcataaggatcggctcgttcaggcccatgctctgccgcagccgttcgatctggtcgggggttgcggcatcgccggcgatgatcgcggccgggtcgccgggcgtcaggcgcaggatcaggaagacgatcagcgccacgatcgccatcaccgggatgaccgcgaggacgcgtttgacgatatagcctggcatgggcttgggctccgggcgggcagctgcccggccggcccgccgcagagcggcagggccgggccggcggatggatcagtcggcgagcgtcaggttccagaacaccggaaccgccgtcggcagcatgtcggtcagccggttgctgcgcgcctgcacgaagggataattgccgagcggcacgaagatcacctggtccagcacatgttcctggatgcggtgggccaccgccttctgcgcctccagcccgtcggccttgagataggcggcgcgcagggcttcgagttcgggatcattcgcccagccgaaccagccggtatcgccggtggacggcaggatcgggttgatcagcggcgtgttggactcgatcccgctgatgaagctggtgaagatgttccagccgccctctgccggcggcttctggctggcgcggcgcgacaccagggtctgccaatccatggcctgaagatcgaccttgaacccggcctcgcgcagggcggcggcgatcaccacaggcgcggtgccgacggtgccgagatcggtcgcctgcatgatcaccaccggcgtgccgtcatagccggcctcggtcagcatctgccgcgcccgggccgggtcgccgccggccttcaggctttcagaccccgcctcgctgccgagcggcgtcccacaaccaaagatcgcaccacacagcttatagtagtcggggttgccgatcagcgtggccatgacctgttcctggccaagcgccgccagcgccgcccgccgcaggcggacatcgttgaagggcggatgcttgaaattcatccgcgcgaaaacctgatagcccagcggatcgcgggtctccaccgtcacgtcggggctcgatttcaggatgtcgagcagatcgatctggacgttctcgatcaggtcgacctcgccgcccatcagcgcgctgatcgcggtctggttgtcgggcatggtcacccattcgacgcggtcgacattgacgaccttgccgcccgccaggccagaggccggctcgctccgcggcttgtaaccgtcgaagcggttgtagacgaccttcacccccggctggaaatccgcgctcgaaaacacgaaggggccggagccgacataatcggtgatcgtctgatcggcgggggtcgccgccacccgcgccggcatgatgaaggccggcaccgaagacggcttggccagaacctccagcagcagcgggaagggtgtcgtcagggtccagacgaccttgtcgtcaccctcggccgcgatgccggccgtggcggccatcagaaaggcggcggcgccgtcgcgcgcaccccagcgcttcagcgaggccacgacatcggcggccgtcaccggcgcaccgtcgtggaagcgcagcccgtcgcggagcgtgaaggtatagaccagcttgtcgtccgagatgctccagtccgccatctgcggccggaccacaccctcgccatcgcccgcgaccagcacgtcatagaccatatagccgtgatcgcgggtgatatgcgcggtgctgacgatggggtcgagcatgcgcagccccgaatgcatcaccgccgtcagggtttcggcctgcaccggccccgccatggccgccagcacgacggcggcggcggcaagtttgcgccctgcccccgtcccggtcgcccctctgtcgaccctgcggaaacgcctgttgaaccgcatgtccaatgcctcctctgtgcaccgccgcatcgggcggccatgcagcacccacgaccggaccgccgacgagcctgctccccagcctcgccatcccgcctcttcaggcccgcatgtcttttataatggacttatgttccccgtaatgatcagcttattttattgaggactgatgtcaacgccaattcggcacgcgcgccgatgcggcaggcatgtggggcagaggctgcacggaagagaagtaccggtgccggtaccggtagcggggcgctatgccgggcggagatggatcgcgaccacggccccgccctcagggcggttggcgagcgtcagatgtccgccatgggcaaccgcgatggcctggacgaccgaaagccccagccccgtgccgcccgtggcgcgcgaccgcgaggcatcgccccgccagaacgggttgatcgcgaccgcatccatgtcctcggggaaaccggggccgcggtcgagcaggcggacgaccgcgccgccatcgggcagccgggcggtttcgacgcgcagccagccgccgccggctgcatagcggcgggcattgtcgaccagcgccagcacggcctggcgaagcctcgacggatcggcggagacggaggccggctgaagatgggtttcgaccgtcaggccctccgcctccagcatcggctgcgcggccgacagaaccgccgccaccaccccggccgcatccagcctctggcgctgcatcaccagctgctggccgatcgccagcgacagggtgcgcagatcctcgacgatccggcccagaccttcgacctgaagcagaagatccgccagcatcctgcggtccatcgggaaaacgccgtcgagtatgccctgcaacccgccctgcagaaccgtcagcggcgtgcgcagttcatgggcgaccgccatgttgttgaagcgcagccgcgtctccatccgctcaagattggcggccagcgtgttgaaggtgcggaccaggctttccacctcgcgcgtgctgcccgccgaggcggcgacgcgggcggaaaaatcaccggatccgaggacatcggccgccgcggtcaggtcttccagcggccgggcgatccgccgcgccagatagaccccgatgatggccgaggccactgccgacagcaggctgtaggccagggtggcgatctgcaccttcagatccgccgcggccgatgccgtctccagatgatcgatgagcgtcttaagcccggcctcgtcgggcagcagcccctcgtagacgcgggtataggcaagcgccgcctcgggcggcaggctgcgattgatgctctcttccagataggccgaataccaggtgacgccgatataggcgagacccacgctcagcatcagcatggtcgcgatggcgatcgcggtcagggtggcgagcggcagggcgcgggctctgcgccagcgcgtcggccggctcattgcgggtccgccagacgatagccgacgccgcgcacggcgggaaagaagccggtctcgcccatgtcttccagcttgcggcgcagattggagacatgggtgtcgacggtgcggaccagcgcatcgctttccggcaggcaggcatccagaatgtcggcgcgcgcaaagacctgggtcgggtggcggatcatatgcgccaggatccggaattcgctcagcgtcagcgacagcagccggcgctcgccgtcgcggttcacgaaggccgcatggctgccgaaatccacctcgatcgccccgaagcggcgcagcacggtatcgggccgctccagggtccggcgcaggacggccctgacccgcgccaccacttcctgcgggttgaacggcttcacgacatagtcgtcggcccccagatgcaggccgctcaaccggtcgatatcgtcggcaagcgcggtcaccatgatcaccggggtcgaactggtctgccgcatccgggccagcaccgcgaagccgtcgatcttcgggatccgcacatccagcagcacgatgtcgggcttcagaagcgcgtgatgctgaagggcggtttcgccatcggcggcttgaacggtccgaaagccctcgcgcagcagatagccgtccagaattcgcgcaatcgccggctcgtcctcgaccagaaggacaagattattgttcatattgaatgccttgccgccgttgaccgggtcgtcgtcgccagcggcgacgccggaccatacggcttccaccgacgccggacaatcccggggcgcggcgccttggccggatcccgacaggatcttgatccggtcttcgccgtttcttgacaatcgcattccagcctgcggccgttccaccccaaggagaggccggcatgcgacgcgccgtaacgggctacgcgcccccgatttccacccccctgacggtgcccaccccgctgacggtacccggccgccggaccggcatcgaccgggcgccggcggtgatcgcgagatcaatcatcgtcgtcagcttcgccttcatgatctttccggcgatcgatctggcggtcgcgcaccgggtcgccgacggatcggtcttcgttctggcgcaggatccgtttctgaaagggctgcgggccttcggcctcggcagcccggcctggattctggggctgatgctgctgctgatcctggcgcaccggtttctgccccggcgccatgcgatctgccggccgcacaagccgctcttcgtgctgatgagctttgcggcaggcccgctgctgatcgtggaggccctgaaacccctgatcggccgcgcccggccgcgccagctgctcgatttcggcggaacggcggatttcaccccggtctggcagttctccgaagcctgcgcgcgcaactgttccttcccttcgggagaggccgccggggcggcggcggcgctgtcgcttctgattttcgtgcccgaacggctgcgatgggtcgcggccctgatcctcgcccccgtgctgatgatgatcgcgggcaaccgcgtgctgttcggcgcccatttcctgtcggatgtggtgctggcctggttgttcaccatgctggccatggcctggatctggcgatggatgcagccgcgcgcggtgcgcatcgaccgcgccctctcaagcgcccggccataggctgcacctccgtcaatccgctggacggccgccatggccggtgtgaccatcgtcgtcacgcgcccagccagagatcccgcccatgcccgatccccagccagacccgctcacccccgttctcgacgacatcgccgatctgggggcgctgacccgcagcctgtcggggcgatacgaggcgatcttccggggcttccgcgccgcactcgcccggcggctcgatcaggcggagacgatggccgacgcggcgcttcaggcgatggagatggccgaggcgaccgcggcggccttccggtcggcctttcccaaccagccggcgctcgcctgcacgggcggctgtgccgcctgctgtcacctgttcgtggcggtgccgccgggggtggcccgggcgatggccgcccatatcgccgccacgcatccgcccgcggcgcgggaccggctgatcgccgatctgcgcgcggcggccgccgccgcggcctccatggccgatccggcgcggctcaggcggcgctgcccgcttctgggcgcggatgatcgctgcaccgtctatgacgtgcggccaccggcctgccgggccttcacctcgacatcggcggcgcgctgccgccagctgctcgatgatccctcgcgcgacgtgccgcagaatgccgggcagtatcgcctgttcatcgaggcgaccgccgccctccaggatgccgcgcggcaccgcgccctgcccgcagagcagcagggcctggcggctgccctgcttgccgcgctcgacaacgcggatccggacggctgaccagacgaagacaccccggcaagagacctgccggggtgtccgtcgttatccgtgccgggggacggcacggacgtcctgggcctggggtcagccgcgcgtaccgagggcggcgcgcagctcgccgccatgctcgttgttggcggggccgtccagcacctgatcggggcggctggcggcgccgtaataggcggccgtgcggtcctcgtcatacgagatgtcgcccaccgacaccgccgcaccggcgaaggcgccctcggtgcccgaccacaccaccacatccttggcggtgttgtcggtggtggcggcggcaccgtccttggcctcgccgaaggtgtagccggcctcggcactcagcgtgaaatcatcgtcgttgcggaagccctgaacggccttgtcggtcatcagcatgaaggccatcgggcccgactcgccgccggcctgggcgccgaagctcaacccgcccatctcgtaaaaggccggattgccccagccctcgtcggtgcgggccaggaacacgccggcaccgccgccggcgccgatgatcagggcgccctgggcgaaatcgggcacgatgaacacgccacgggccttgtcgagcgcggcacgcgcctggccgtccgaagccatctggttggcgaccttggtggccgcggcgatgatctcctgcgcttcctgccggtcctcggcgatgtcttccgcatcctcgcggtcgtcgctacgcgcggccggaacctggccggcgtttgtgccggctgcggccgccggggcctgattcgcaggggcctgattcgccggggcctgtgccacgttgcgcgtctcgtcggtcgtggtggccgccgcagagaaggcgggggcggcaaggccgccggtcacgagcatggtggccgtcagcagggcgaacttacgcatggagcggtctccttgggggtaagagaactgaagagtgtttgacaggcggccggccggagggcaggtcgccggctcaataccagtgccgccggccgtcgcccgggtcggagccgtcctcgctatggcggcaggccaggcaataggcggcaagcccgatcaccccggccacgatcagcccggtggtcatcggatgctcccgcgtggcccgccgggcatcggcgccgagcgccgcggcgcggtggcgggcggcacgcagcgtttcgggcgccgaggtctcgtgggcggcatggctcaggcggtcggccagctggtggacctggcgcttcagcgcggccagatcctcctgaagacggctggtggccgtgcggtcgtcggtcatgaaggcctccggtcgatagggtcctgatcgcaccccgcaaggtgcggttcgccctctcaacggcggccaggcgatttgggttccatgcaccggacgcttcttccggaaccgcagccggccgcgcgcggttgacgtcccggaccatcagaccgggagaccgccctccatgtatgccccgatgtatgacggcaccgttccgccgaccgacgacgatctcgccgccacccccggccggcttgccgcccgcttcgccgccgtccggcaccagaccgaagccctggcggcgccgctcgatcccgaggatcaggtcgtgcagtcgatgcccgattgcagcccgaccaaatggcatctgggccacaccacctggttcttcgaacgcctggtgctgctgccctggctgccgggctgggccccggtcgacccgatctacgaccatctgttcaattcctattatgtcggcctgggcagccgccatccccgcgccgcccgcggtctgctgacccgcccgccgctggcgcgggtgctggactggcgggccagcgttacgcagggcgtgctcgacctcatggcctccgccgggccggatgccctcgcccgggtgatgccgctggtcgaactcggcatccatcacgagcagcagcaccaggaattgctccttatggatgtgctgcacctgttcgcgcagaacccgttgcagcccgcctatctgcccggcgacagcggcacggcaccggttgcggccatcaccgacaccccccgccccgtcacctggaccgatcatccgggcggcattcatcagatcggccacgacccggccgcgggtttcggtttcgacaatgaaggcccgcgtcaccaggtgctgttgcagccctatcgcctggccgaccggccggtgaccaatgccgactggctggagttcatggccgaagacggctatgcgcgcgcggaattctggctgtccgacggcatcgcacgggccgaggccgaagcctggcaggcgccgctgcactggttccggcccgagcccgacggcccctggtggcagatgaccctgcgcggcccgatgccgatcgatccggcggcgcctgtggtccatgtcagccattacgaagccgatgccttcgcccggttctcgggcgcgcgcctgcccaccgaagccgaatgggaggtggcggccgccgggcacaaggtcgagggcaatctgctgccccgcggcgtgctgcacccgcagccggccgacccccgacagagcggcgggccggttcagctctatggcgacgtctgggaatggaccgccagcgcctatggcccctatccgggcttccgccccgcggccggggcgatcggcgaatacaacggcaagttcatggccaatcagatggtgctgcgcggcggaagctgcgtcacccccggcggccatgtccggcccggctatcggaacttcttctacccgcatcagcgctgggcctttgccggcctgcggcttgccgccgacgcctgatcttccccttaaaggaggcttcttcccatgtcagccagccccaccggcggcatcaccgccgccggcccgcgcgcccgggccgcggccgccgccaccgacccgtcggatatcgaaacccaggcgctgcgcggcctgacccggactcccaaatgcctgccgccggcgctgttctacgacgatcgcggctcggtgctcttcgaccgcatcacccggctcgacgcctattaccccacccgggccgaaaccgcgatcctgcgccgccgggcgcccgagatcgcgacccatgcgggatcgggggcggtgctggtcgattacggcgccggatcctcggtcaagacccgcctggtgctggatgcgctggaccgcccggcggcctgggtgccgatcgatgtctcggccggccatctggaacgggcggcggccgcgatcgcccgcgaccatccgggccttctggtcgccccggtggtcgccgatttcaccgccgccctggatctgcccgatgccgtcaccgccctgcccggccctcggctcggcttcttccccggctcgaccatcggcaatctggcgcccgaagaggcggtggccttcctgcgccgcgccgcctgcctgctggggcgcgacggccggctgatcgtcggcgtggacctcgtcaaggacgaagaccgcctgatcgccgcctatgacgaccccgagggcgtgaccgccgccttcaacctgaacctgttggcccgcctgaaccgcgaggcccgcgccgatttcgaccccaccgccttcgcccaccgggtccgctggaatgccggcctctgccggatcgagatgcatctcgaaagcctgaccgaccaggtggtcagcgtcgccggccgcccgatccgcttccgggcgggcgagaccatccacaccgaaaacagccacaaatacacgcccgaaaccttcgcccgcctcgcccgccgcgccggctggcgcagccaggcctgctggaccgatgcagcgcgggatttcagcgtgcatgagctggtgcagagtcattaggccggcaggatcgaagacccgacgcgctacgacatcggacacttgacatcaagcacttgatggtcggccgcatcgctatgacatttgagagctgtggagcgatggaggtcgtgatggcatcactaggggtcacagctgaaggtcaggtcacgctgaagcaggatctgttgcagcatctgggggtcaaaccgggggaacgggttgacgtcgaaaagctccccaatggcgaggtccggctgcgggcggcgcgcccggccggcaacattgagggcttctttcatgccctggacggcaaggtgtcgctgcagaagccgctgaccattgatgagatgaacgacatcgcggcggccggctgggccggcacgtctggcggcgcatgaaggtcatcgctgataccaatgtgctggcgcgtgcgatcctgcaggacgacgaagcacaatgccgcatggcacgtgacctgctgaagcaggcgacgttgatcgccgtcccactgccgtgcctgtgcgaactggtgtggatcctgcggcagggcgccaaactgccgaaagaagatgtggccgtcgccattcgggcgctgctgaataccgacactgtcgttgtgaacaggccggcggtagaggcgggacttgcgctgctggacgcgggcggcgatttcgcagacggcatcatcgcccatgaaggcaaatggctgggcggcgagacctttgtctctttcgatcgaaaagcagcggccctgctgtcgaagcagggggaatccgtacggttgctcagccagcgcgacccccctcacggatccgcatagccaaccgcccgcatccgcagtgccgcccccgtcggatcgcggtcgaacaggatgccgcccttgcgggtggagcgggcgggcagataatcgatgcgggtgcgaccgcgggccaggacgtggccatcggccaggatctcggcctcgatctcgacctcggatgccgtgcgcgggccggtgttgctggcctcgaaggtgacgacccagcccgccccggcctgctgcaccgccgtggggcggacggccagggccggcgtgcctgcgggttcggtcagggccagatagcccagccatgcggccagcgcgaccagggccgccgctgcgaccgaggcgatgatccattccagcgggtcggtcctgtcgccgccacccgcgtcgtccatccgcgtccccatcacacgaatatcctcatcacacgatgattctggcagctgcggcgcccacggcgcccgggaaagacagcacgatcacgacgcccgcgacgtccaccgggccggtgccgtccagccggccgatggtccagagcacgtaaagactgaccagggcgaccagcacataaccggtgaccgtgaagcgcaggaacaggctccagaagccgtcttccgtgcgggggccatggccgccgatgaattccagctggtagaccagggcatgcatcacgatcaggctggccgccagaagccccagctgctgccagagcgacatgcgccaggcgatcaacaccacctcttcggtcggcgcgatgttgagcgacaggaagagcgcgcccgcgaccatcacgaacagctctccggcatagctttcctccacctcttcccgcccggcatcctcctggttcgaggccccgagctgggcgcggccgaaaagcgcgcccaccgccccgggggtgatctggatcgcgagcttgcccagcacttccgaggccggcatcgcgtccgagatcacgccgaagatgccgagcaccccggccgcgaccacgccggcgatgccgatcgcgatcgcggcatcggccgtgtcctgggccaggctggaggtccggcggaagccaccgatccgcgacagcccgaccagcagcggcagggtgagcgccagcagcagaagcagccgggatgccggcaccgtgacgcccagttgccaggtttccatggtcatcaggatcggcagggtgaacagcagggccccggccgcggcgcggcccagcccgatgatcagatcccgccgcggcgatcgtcgccgctcatgctgcccggacatgacgtctccggatgatgctgccccggtggaaatcgatcggcgccggttccggttccgcggacgtctgcggatctgcctgcggaacatagcgcccgggccgggattgcagctccataccgtgcagcccgagaggagacgccccgatgatcccccggccgatccggaccacgaccatcaatgccgtgctcgccgcccggctgttcgccatggcagccggcgccgtgctgatcggcagcggcatcgccgccggcgccaacatgacggccccggccagctccaccgccgcctataccgaagaggcggcgctgtccgacatcttcgagatcgaagcggcgaagcttgcccgcaacaagacgcagaacgacgacatccgcgcctttgccggccgcatggtgctggaccacaccgccgcgaccgaaaagatgaaggaaacgctggccgatatgggcctgtcggtgcagctgccggcgcggctcgacgaccggcggatgaagatcctggaagatctgaacgaacagcaggtcccgggcttcgaccggatgtatgtcgcaacccagatcgaggcgcatgaagcggcgctacagctgcatcggggctatgccgaagcgggcgagaacgaggaactccgcgagaccgcggcggagatcgccgacaccgtggaacggcatctggagcatatccgcgacattgccgacgagatgggctcctgaccgcatgcccgccatccgacacgcgaaggatgaagccgatgaccttcaatcccctgcaggaaaaaggcattccgctcgaaaagcagtgccgcacctggtcggagctgaacatccggccctatgacaaggcgagcgtgcacccctatagtcgctgccgcggcatcgtgatgaacggcatcgaggtcgaggcggtgatgttctcgcaccagatggcccgcaacacgctcgaccccgaaatccgcaagcagctgtcgctgatgcgccggatcgaggcccagcagcagaaggtgatgaactggctgatccccggcgacgagaccacgctggaggtgacgctgggctatgaacaggtggcggtggatctgacggcctggatcgcccagcacgagcccgacccctatctgcgccaggtttacgaattcggcctgctggaggatttcgaccacctctaccgctatgccaacctctaccagatgctggagggccacaaggcggacgagatcacggatcggctgaccgaaatcatgcccggccgtccgacgctgttcgaacatcgcgatccgcgcgacgagatccgccgcccgatgaccgcgctcgccgccgatccgcaatcggtgatgaatgcgctgaccgtgatgtcggccgagcagcagacgatgaatttctacatgaacatcggcaaccggccgcaggaaccgctggcgcgcgccacctatctggaaatcgcccagatcgaggaacagcatgtcagccattacgaaagcatcctggacccgacggtcggctggttcgaaaacctggtgctgcaccagtatcacgaatgctggatgtaccattccttcatgcaggacgaagtcgacccccgggtgaaggcggtctacgagctgcacctggcgatggagatcgaacacctgcacgtcgcctgcgagatgatgcgcaaggtggagaagcgcgaccccgaagccttcctgccgcgcgagatgggcgagagcatcgtcttccgtgagaacaaggccttcatccgcgacgtgctggcccggcaggtggacctcacctccaaagacagcgatttcgtgccggtggacgaactgccggcggatgaccgctatttcgcctggaaccgcgccgtcaatgacggctggaacccgaccgaagagatcatcgcccgggcgcgcgccgatggcggcgactaccggctggagaccgaaggcccccatccggtgcccgggctcaggcgcgaagacgcgcgcgacgacgccaccaccgcctatgcccgccgccgggccagctgaagagggcacgcccccccatgtccatcaccgtcagccacgtccccccggcgaaagactgtgcgcgttcaccccgcaccggcgaccccgtcccgggggatctgcatctgggcgacccggtctcgctgggtgccgccctgatcaccggccgcaaggtggcgcccgacgcgaccctgctgctgatccaggaccatcgcgaagcgatggccatgttcgacgcccatgacgaacagaccgatccggtggagcgcgccgccatcatccgccgactgctccgggcgctgcggcggcatatggagatcgaggagcagatcttctatcccgaggccgcccgcgccaccggccgcgacgacctgaccggccatggccgccatgaacacgacgaggcgcgcggcatcatggcccggatcgacaccgtgctcgcccgcggcgaggcggcggatcaggcgatgggagagctgcgccgggccatcgaccaccatgtgaaggacgaggaggaggagctgttccccatcgtccgcaacagcgggctggacctctacgcgctgggccgcaggcttgcggcccgcaaggtggccctgctctaccgcacgaccgatggccgggtgccgggcatcgcttacgaagacctggagaggcgcatgaccgaccggatgaacgaggcccgcaggctgctggtgatcggtctgcgcgacatgcatgccgccacccggctgggcgacgagatgctgaaggtgcagctgccgcggctgaacaccctgccgcagatgacggcccggctggaggcccaccgcaaggacaaggccgcccagcagagccgcatcgaacacatcctggatgcgctgggcgaagaccggccggcgctgaaggacatgatgatggccgcaaccggcgacctcgccacccggctgaacgcagcgaggggcgacgaggtggtgcgcaacggcgtcaccatgttcggcatggcccattacgaggtggcctggtacgaaagcctggtcgtgctggcagccgaagccggcgagaccgaggccgcccgcctgctggccgaatgcctggccgaggaacgcgccatggccgcctgggtgggggaaaacctccgcggcctgctgctctcgcatctggatgcgcttgtatcgggcgtgaaggatgcgggctgagagatcggccgccctcagtgcgaatgcccggcctggccgggcggggccggatgcagttcaaaggccacacagatccgccgctgatcacagccgagcggtacggtctcatgcgtgaaatggctgggcatcagcaccacgaggccgggttcaggacggatccagcgctcctcccaacctccagccccgcaaccggcggccggaaagccgcgcccggcagccgggccgacgcgcagccagccgggccggcccgctacatccgccaccaccggcggcacctcggcgtaatagaccccgttcacccagctggtggcatgcagatggggaagatggcgggtttccgcccccgacaccacgctccaggccttgaggacaagcccggccggccgggcgcgcaggaacggattggccgggtccgccggcaggcggtcgacatagtcgcaagccacccgccacagccggtcgagcagacggcgcagcaccgggctgtccgaccgttccagatggttgcggcgcgatcccatgcggatggagcggtcgccgggccggtcataatgctccagcccgctcgccaactcggccaccagcggcgccagatcgggatcatccggcccgtgcagacgggtgatcgacaggaaccgctcggggctggtcagctcccgggcggccgggatatcgcccgcccagatcgccgtggcggccagcaggtcgaagctgcgcggattggcgaagccggcatcgaccagcgcccggaccagggggtaaagccgctctcgcgggcgggcccagatcaacaggtcgacaaaggcgccgaaggtttcgagattggggtcgatcgcctggatgtggccgcagagcgccgcagccgcatcggcccggccctgcacaagcaggaaggccgcctgacgggccatggaggccagatccggcgcggcggtgacgtccggggcgtcgttcacgttgcctcctttcgcaccagcccgtgggtcagcatgtctgcgagcagcgccgcgacatcgcgccggatgatgtcgagcggcgcgtcataacgggcatgcagctcgccacacagatcctcgaaccgcgtcggggtctccagccgcgcccagatggcggcgccgatgctgtccaggttgaaataggcgctgctcgccagatccatcatcaccacatcgccatcgatctcggtggtgagcgggtcgggagaacgggtgaagacggtctcaggggggaagatcatgacgcggactgccttgctgcctgatcgaggttgagcattccggaaccgccatgggcgacggccgccagccgctgccagggcgcgcgcaggaaacggtcgcagaggtcgtgcatctccggggtggcggccgcctgcttctgcgcccggtcgtcgctgaagggccggcggccccggcggctccaggcctgaagccgggtcgcatcggccatcgccgccgcctcgaccggtgtcggcgtgatgcccaggcgcggcagcaggcgggtgatcaccgcatccggcagttccgcataatccaggatcagccagcccgccggatccgcctccaccgtcgccgccatggcggtgaaggcgcggcccaggcagcggacgatgaattcggcatcgctcaactcccgctgccgggcgagcgccacccccgacagcagcggcgaccacaccgcatcacgcagcttcagccagcccggtggcccggtcaggttcgacaccaggatttccagcggatcgcgaatgatcagcacccggtgcatatccggatggagctgcgcgaacagatcctgatcccgccagctgcgcagcgactgcttcacgaccagatgccgtgccccgggcctgacccgctggcccagcgaccgcagcgccgcatccagcgccgccagccggtcggcgatgggcaccagcgcccagaaggcgccgcagatatcgaccacggcccccggctcgtccatcacctgcagggcatcgatgcaggacagcatgcgggcggtgagcgtggagccgcagcgggtcagatgccagatcgcaagcagcggcggcaacaccggcgccgtcggcgcatggtcacggatcagcgcagagtgcagccccgccgcggccggatgatcggcgggcgggcggccatgcagaccgaacaacacctcctcgaccggggcatcggccgccatcggccgcagcaggaagctgccaccgccggccgagggcacggcgcggacgggcatgcagatcgggccggttccggcgagaccttcagccattgcggccttcctgcatcaggatgaactgccccacccgcagcgcctcgcccagccccttgcgcagacggtgagaggtggggaagcgcccggcctcttcggcggtggccggccaggcatccaggatcgcgcgcatatgctgcgtatccagaatggagcaggccaggggtgattgttcgatccggtcgatctctgccgccatccagtcgcgccgccgccccatccagccgaaccagtcggcatgctgcaggccgatccgacgctcatccagaatcggctgcggcacgcggtctgccagggtgcggcgggccagcaggcgcggcaccccgttgcggcgaaactggtcgcgcggcagcgacaggcagaactccaccaggcccagatcgcaatacggatcgcgccaggaccaggccatgccctgaaagaggtgggcgtattgggcgttgttctggcggaaatgttccagcagccggatatggttgtcgagatcgggcgagcccgtgcgcacggtcggctgatcgtgttccgccagccgcaaccgttccgcgacttctggccggatgctgctccattcctgccaccaatagtcccggccgccgcgcaaccgccgcgtcaggcggcgaatgccggggccggccaggggcgccaccgcctgaccccaaagcgcccgggggccccagaacagccgtggccggccccgcaattccgggcgatagggaacgaggttgcgccaggccgccagcgcccgcccgcgccgcaactgatcggccgccacccggccgccggtatagctgagcgtgacattgcccgcatcgccgctcaggaccacgccgatgtcctgttcccgcacagtgcgctccaagggcaacagcatccaggatatctgatagggtctcttcaccggccagtcgcggctctgcagcggcccgccggcatattccatcgaaaggtcgggttgccaggcatcgaccagatgcggcgtcaacccgggatagcgggccaggaaaggctgcagacgctcccactcgtcggcgaaatgaccggcatccgggggcagctggggaacatcgggatcggcgcggatggtgagggtatggacgggcgcgtcatggctgcgggaggccgtcgcggcgacgccgggggaatccagccctgccgacagcaggcacaggatgggtttgccggcagggcagcgcgcggcgaccgcccggtccagatgttcgcgcgcggcctccacatactcggcatcccggcgcagacgcagtgtgcgccgcggcaccggtgaccagaagggggccgtctgcgtggatccgtcctgccattccagataccagcccggttgcaggcgccggatgtggcgccagggggtgcggtcgccgatccggctttccatcttgaccagccggtaggcaagcacctcggggtccggttccggatcaacctccgggacggccagcaaccagctgggtcggctggccgcaacgatgccgtcgggcgtggcggcatggcacaggctgtcccgccccatcgggcaggcggcgagcagcagcgagcgatcggcgggcgaccagcgcaccagggtgtagtcgccatccagccgggcgagcccgtcgacgccccaccggtcgagaagggcatcgaccagccgcaccggcgtcagcggcgtcgtccggtccagccccagctctcgggccagaccggcgagattgtagatctcgccgttgaccagcgtcaccgcgcctgacggacccgccccgattgatcggggcgcggggcgccgtagccggccggtcgggttgtcgcggcccagcccgacgacgacaccgccgtcaccctggtgaatccggtcgatgcggaagtccgacgggcagcggcgggccagatcacgcaccgcgccaccggtgccggccagaaacccggcgctgctctgaaccatcctggcggcgggtcaggaatgggtggaaataaagccgtcgtccgaaacattgctgatcccctgggtcaggggcgtggcattgtaaacgcccagaaccggcgcagcccagggcagcaggtccgtattccggggcagggcaggatgcgccggagaggcggtcatttcaggcttgttcatatccacaccagcacataacgggttcaagtggcgtacggggttccggtacacgggtgacctcgcggtcagggcactttgcaggaaaacgtcgtcattttcaaacagactttctgaccgaactcttcggacgcagctccaggcgtcgctttgggaaagtcattccaacgctgtttatttccacgcgaaagatatttgcgtcgccggcgtgaaaccggcgccgacggcccgaaggcggtcaccccgcccgcggcagcggcagggtgcccggggtcttgatctcgcgcagcaccaggctggaatgcatctcgcggatgccggggaggcggcggaccacggtcatggcgaagctgccgaaggcatccagatcggcggcgacgacctggagcaggaaatcggcctcgccggtgatcgcccagcaggccgtcacttcgtccaggcgcatcacctcggcctcgaacagccgggcctcggcttcggaatgcacgccgatgcgggcgcggacgaaggcctgcacgccgaggcccagcctgcggcggtcgagctgcacgccatagccgcggatcacgcccaactcctccagccgccgcacccggcgccagcagggcgagggcgagaggccgaccgcctgggccagatcctgattgctcatccggccatcgccctgaagcgtgcgcatgatccggatgtcggcggcatcgaagctgatctccggcatgatccatccccggattaagagaaagccggcaggatcttgcgggatctgtgacgttgtcggcaagctttgcacgcgcttttcgggcgaaacgcgctacactgcgcgtgtccggtgcacagggccgggccttatcacccgaaggttatcatccatgctgcacggtttcacacccccctataccccggagggccgttcctctctggtgccgccgccgccctggcattatgccggcacggtgctgtccatggcctgcccgaccgatccggcggccgccgcgcgcttcctgccccaggggttcggccgcgcgaccgggcggatcatcgcccatgtctgcgaatggcaggcgaccaccgacggctgggaactgctcgacccggtcaatgcccagtaccgggaattcatcctgctggtcgaggccgagcgcgagggtgcgctggtcaatttctgcccgatgatctgggtcgatcaggacatctcgctgatccgcggctggctgcagggctggcccaagaaactcggccaggtgtggatgacccgctcctacgggctggaccatccggcggccgctccgctccgcgccggcacccggctgggggcgagcctggcggtcaaggaccggcggctggccgaagcggcggtgacgctggatggcggtgaaggccaggcgctgggcttcctggccgggccgacctatgggctggtgggggcgccgtcgatcatcggcgaaccgacgcccggcgcgctccgcctggtgctgccgggcatcaccgggcggatggccgggccgatggtcggcggcacggcggagctgcgcttcttcgacgcgccgcgcgacgaattggccgccctccgccccaccgggcctgcggtggcggcgatcggcaatgtcgcgatcaccgtgacgggtgcgaccgatatgggcgtggtggcggggtaagccccaccaccggccggccctcaggcagccgcgccggatgccttcagcgcggcgatctcgtcggcggagaagccccaatcggccaggccctgatcggtatgggtgccgggggccggcggcggggtcggccggtcgggtgccgtgcggctgaagcgcggcgccgggcccggctgaaccacgccgtccacctcgatgaaggtgccgcgttcgcgattatgcgggtgctccggcgcctcgaacatcgacagcaccggggcgaagcagacatcgctgccttccatcaggctgcaccactcgtcgcgggtcttggtcttgaacacctcgaccagccgggccttcatccgcggccattccgccttgtcgttctgggccgcgaattcggccgggtcgagcccggccaggcggatcagctcggcatagaattgcggctcgatcgagccgatcgagacgtgtttgccgtcggccgtctcgtaagtgtcgtagaaatgggcgccgccatcgaccagattggagtagcggcgatcatcccagctgccggcggcggccatgccgtacatcatggtcatcaggctggcggcaccgtcgatcatggtggcgtcgaccacctggcccttgccgctgcgcccggcctcgatcagcgccgccatcagcccgaaggccagatagagcgcgccgccgccgaaatcgccgaccaggttgagcggcggcaccggcttgtccgccccgccgatcgcatgcagcgcccccgacatggcgatgtagttgatgtcgtggccggccaccttcgccagcggcccggtctggccgaaaccggtcatgcggccatagacgagcttcgggttgcgcgccaggcagatatcggggccgaggccgagccgttccatcacgccggggcggaagccctcggtcagaatatcggcgctctccaccagtttcagcacggcggcgacaccttccggcttcttcaggtccagcaccaccgagcgcttgccgcggttggagagatcgaatttcggatcgaacagcccgctgccggtcgcccgctcgatccgcagcacatcggcgcccagatcggccagcagcatggcgcagaacggccccgggccgaggcccgcgatctcgatgaccctgatcccctgaagcggacccattcccagcctccctgtcggttgcggcgcgtcgcggcggtatgcccggtcttgcggccgtatgattgaagtgaacggcccggctccgcaaccgttttcatcgacccatgggtttcttcccgtcccgcgggtcaattctgccggcggcgacagtgcgggacattccggccggaacggatcgggcaggcggggattgaggggcgaaaccgaaggagggtcagcggtgacggccgaaaccacaggtcagaagacacaagcttcggggtcgcaagcctcgggctcgggcgagcccggcaatctcgacgacctgctcgaccggctgggagaggccggccggaacgaccaggacggcaaggtgtcggtcgacgacatctggcacaccatcggccagcgatctttcgggccgctgctgctggtggcggggctggtggtgatgacgccgctgggcggcattccgtcggtgcccaccatcttcggggtgatcgtgatcctgatcgcaggccagctgctgctgggacgcgaaagcttctggctgccgggctttctgcgccggctgcgcaccgatcagggcaagctggacaaatccatccgggtgtcgcggccggtcgcgcgcttcgtcgaccggctgatcaagccgcggctgacctggctgacccgcagcccctggaaccgggtgatcgcgggtgtctcggtcgcgctggccgcgatcatgccgccgctggaactggtgccgatgggggccgccgtgccggcggcagcgatcaccgctttcggcctggccctggtcgcccatgacggggtgctggcgctgatcgccttcgcaatcagccttggcggcttcgtcctggtggggacccagcttctgtgacgccgccagtgacgaagctttcagcaaagacgggggccggcaccggccggccaaacagatagccctggacctcgtggcagtcgtggcggcacagcatctcaagctgcgcctcggtctccaccccttcggcgatcacctccatgccgaaactgcggcccagatagagcaccgcgcgcaccacggcggcatcctcggcatcggtggtgatgtcgcggatgaagctgcgatcgatcttcagccgggtgaccgggaagcgcttcagcaggctgagcgaggcgaagccggtgccgtaatcgtcgaaagccagccccacccccagcgcccgcagatcatcgagcagctgcagggtcagcgggtcgttgcgcagcacgatggtctcgacgatctccagctccagcgcctggggcggcaggccggtttcggccagcacctcgcgcaccagctccagcagatggccactgcggaactgggcctcgaacaggttgacggcgatccggaagtcgggccggcttgcgcgccagaccgcggcctgccggcaggcggtgcgcaggacccagtcccccaccgcggcggctgccggtttctgcgccagcacgtcgatgaaggccgcgggcgtcagcaggccgcgctcggggtggttccagcggagcagcgcctcggcaccgaccacgcggcggccctcgcaggcgatcagcggctgataatacagctcgaactggccggtctcgaaggccagccgcaattcccgctccagcgcgcggcgggcggtggccgccgcgcgcaaggccggctcgaacagcacatggcggttccggccggcccgtttcgcctgctgcagggccagcatcgccgcccccagcagctcgtccgggtcgccgccatggccgggccccagcgcaatgcccatgcgcacacccaccgtgcaggggcggccggcgatgtcgtgcggggccgaaacggcggccatcagccggtcggccagcgcgctcgcccgcgccatgtcgtcgcccgccagcagaatgacgaattcatcccccgccagccgggcgaccatcatcgccgtccccgcacagatgtcgcgcagccgtgctgcggcgcttttcagcacgacatccccggccggattgccgaaggcatcgttcacttccttgaagccggccagatccagcagcatcagcgtgaccggacgggaggcggccatcacctcggccatgcggcgataccaggcgccgcgattgggcagcccggtcaggctgtcgacataggccaggcggaacagccgctcttcgctgctgcggcgctcggtcacgtcgcggatgatcacgccgatgctgacggccccgccttcggtccaggtggagaccgacagatcggcgggaatggccttgccgttccggtcgatcaccggcagttcgatcgacggcccggccgccggcatcagcccccggcgcagccggtccagctgtcgcgcataaagccgccgccagctgtccggcaccaggatcgcggcgtcgcggtcgaccatctcggcggcgctgtagccgaacagccgttccgcggcggcattccagaagctgacccggccatcgccggtcaggcagagaatggcgtcgggagaggtggcggcgatgttttcgaaccgcgcctgatcggcgatgcgggcatggatcaggcggcggatttccatccgctccatcaccagcccggcgatatcggtcagcgtgtggcggtcggccgcgctgaaatcgtcgcgcggccggctgtcgatcaggcagacggtgccgatccgccggcccgacggggtgatcagcggcttgccggcatagaagcggatgaagggcggccccagcaccagatcattcgcctggaaacgcggatcctgccgggcatcggggacgacgaagacctcgtccgcgaggatcgcatgggcgcagaacgacacgtcgcgcccggtctcgcagacatccagccccagccgcgccttgaaaaactgccggtcgccggccaccagcgacaccagcacgatcggcacgtcgaacagccgcgaggccaggcccaccagacgatcgaattcctcttcgggtggcgtgtcgaccagatgataggccgcaagcgccgcaagacgatcgtcttcgtccgcggacatcggccaggaggtcggggtcggctcgacggaagaagtcggctcggtgggtcgggtcatctcgtcctgctcgcacgcggccctttgcggggcagaggttgaagtttagcagaaccgggttaacaaactctccctccgcgcggatcgatcgggccctgccggcgttgcaccggcaggtcgatcatgaaacctggccgaagacggaacctgcaggagaccgcccatgcacgcccgcgcgcttctccccatccttgcagcgccccccaatgtcgcccccctcaccctggtcgccaccctgaccctggtcgccaccctcaccctggccgccacccccgtccgcgcccaggacccgccgatggcggtgcaggcgaccgtcgccgtggtgaagccggcgaagctggatctacccgaacgcgaccaggatctgatccgccacctgacggtgtccgacggctacaaggtcgaggtctatgcccgcgatctgggggcgccgcgcatgctggcggtttcccccgccggcacgctttatgccacacgccgcgacaccggcgatgtggtgatgctgccggcggccgatggcggcggcgcgcgcacgccgcgcaccgtggcgagccgcgccgggctccacggcatcgccttcgacggcgaccgggtctttcttgccaccaccaccgatgtctatgtggccgaggtgctggccgatggcggcttcacgcggctggaacggatcatcgacgacctgcccgatggcggccagcacccgaaccggacgctggccatcggccccgacgggcagctctacatctcggtcggctccagctgcaatgcctgcgccgaacccaatcccgaacatgcgaccatcctgcgcgccagccccgacggacaaagccgccggatcttcgccagcggcctgcgcaacaccatcggcttcgactggcagccggaaaccggcgcgctttacggcttcgatcacggcatcgactggctgggcgacgacggccagctggaagagctgaaccggatcgaacagggcggccgctatggctggccgcatctggtggatttctcccgcccccatgtccgcagcgccccgcccgacggcgtgtcgctggccgactggaaggcgatgtcgaccgaacccgcgcttggctacaccgcccatgccgccccgatgcagatggcgttccacgacggcaccggcatgccggcggatgtggcgggcgatgccttcgtcgccatgcgcggatcctggaaccgggccacgcccagcggttacgaggtggtgcgggtacgcttcgaagacggccgcccggtcgaggtccgccccttcctgaccggctttctggcggcgccccggggggatgaccgggtgcccggcatgatcggccggccggtcggcctcgcgatcatgcccgatggcgcgatcatggtgggggacgacaccaatggcgtgatctaccgcatcacccaccccgcgacggaggcgaccggcgcgcgcatcgcgcccgcagagccgccggcgcagaagcctgcgggccggccgctggcgctggagcaactggcgccggaccaggcggcggaaatgacggtcaccgccggtttcgaagacggcggcagcctgccgacggcgatgctggcccgcggccacgacgcctcgcccgcactcacctggtcgggcgcgcccgaaggcacccgctccttcgcggtgatcatggaggatccggatgcgggggatccgaaacccttcgtccactggatgatccacgacatcccggtcggccatcaggctctgcgcaccggcctgccgacggcgccggtgctgcgcgatccggaaggcgcccgccaggcgaccaacagccagggcggcatcggctataccggccccaagccgccgccgggcgacaggcgccacgcctggcacctggtcgtgctggcgctggatgtcccgcggctggaggtcggccccgccgccgatcccgacgcggtgctgaaggccatggacggccatgtgatcggcgccggccggctggttggccatgctggtggctgatgcatccttcccgctgccggtcgtccacaaccccggcgccggcggcggcctgtggccggaggcgcggctgcgcgcgcggcttgacgcacagggactggcggcagcgcccctcatccacgcaaaggatcccgatctcggcctgcgccttgccgccgccgcagcgctgccggctgacgctgggcgaccgggtcgtagccctgcgcagcctgctggtggaggttccctgcctgccatggagcgggccgcggctgctgatcgcacccggcctgtcgcccggcggccgccagatctgcgccgtcaccctgtccgcccgccatctggcggcggcccgggactggctcgccgatcccgaaatgccggtccatgtcttgtcgccgctgaccgcgccccatatcgttctggacggcccatagcgttctggacaaccagcggcccggtcaggatcgacgatgcgcagctgaccgaagatgccgccggccgccccttcgccttcgacccccacccctttcggatccggcccgatcccttccgcatcctcaccgatcccgatatctgatcgacccgccagacggagacccgccgtgaccgccctcagcccgaacgagcttcatgacatcgagatgctggcggtggaactggccgagcgcgccggcgccgaaatcgtctcgcggctgggctctctgctgtcggtgcgctacaagaccggcgccgaagacgaccgcacgctacgcaacccggtctcggatgtcgacgaggcggtcgagcgcgcgatccgcgagcgcctggccgggcgcttcccggaacacgacgtgatcggcgaagaattcgaccaccgccccggccgcgatcacagcgtggtctgggcgatcgatccgatcgacggcacctccaatttcgtcaacggcttcccgcttttcgcctgctcgatcggcgtgctggaacggggccggccggtggccgcggcggtctggtgcgcgaccagccatgcgctgcgcccgggcgtctatcacgcacgcaagggcagcgggctgcaattcgaccgccagccgctcacgcctgcccgcaacccgatggtgcaccgccgtttggccggcgtgccgcaattccgccgcggccgccacccctgggatctgcgcaagaccggatcggctgccatcgaatgcgccttcgtggcggccggcctgctggaggcggcggccttcaattcgcccaatctctgggatgtggcgggcggcgtgctgctggtgcaggaagcgggcggcacggtgctggaggggcgaccgggtgcctggcaggaattcacgcagttcgccccccgccgcggccgcggcgacacccccgacgcccccgccgatctggcacgctggaacgccggtctgatcctgggcaccagtgccgaagccgcccggatcatggcggaacaggcgatcgcggaggggtgaggcgatcagcccggttcggccgatgccgggctgccgcgccggcggccggccagcacctcgtcgaaggcatcggcgatgcgcgccactgcggtcagcagcggcacgtccttcaggtcatgaccttcggccagggcggcggcgttcagacccgatctgcgggcgcgggcgaccagccgttcggccagggcgtaatcggcggcgatcctgcgggcgagcgcttccagaaccgggaaggcagtctcagactgtgcaacgttcgacatgacggcgatccttggaacggcacgtccgggacatctgttggggggagacgacgtgttgggcgagacgacgggcgtgccagggcgttatcataacctgggcgccgccggcgaacccggcccggcgtctcagatagccggccccgcgtctcgatccgcgatggccgttatgaaagaccaccgcccgtgcccaacccttccgttcccgacccggaattgtccacagccgcgcccacgcaagcggccggggtcgtccggctgttcggcgccaatgccgggggccatgatgcagccttcgaaggctggcgtctggcgctggacggggtgttcgacgtctcgcgcccgcgcgatggcggcgatccgttccggggcggcatcgtcgcccatgatttcggccaggcggtcatcaccgacgcccatgccggcggccagcgcttccggcgcgacggccgcaccatcgcccgcggcggtctggatcatttcatcgtccagctctaccgccagggcggcttcgacggcgaggccgagggccgcgagatggcggtccgcccgggcgatgtctgcctgttcgacctgtcgcggaccatgcagaccgatgccgggcagttccggaacgtcactctgctgctgccccgcgccctgctggcgccgctggtcgacacgcccgacgatctgcacgggctggtgctggacggcagttccggccccggccggatcctcgccgcccatctgcaaagcctggtggcccagggcgcgctgatcgacccggccgatgccgggccggtgatggaaggcacggccgggctgatcgccggctgtttccgcagggccatggcgctggccggccccaccgacggcgaggccgcccaggtggtgcgccacggggtgcgcgatgccgtgctcggcgccatgcaccgtttcatcgacgccaacctgacctccccggagctgacgcccgatgcgctgatgcagcgtttccacatctcgcgccccaccctctaccggctgttcgaaagctcgggcggggtggtcgcccatatccgcgcccggcggctccggcgctgtttcgcggcgatcaccgatccggcccaggcccatcgccggctgtcggacatcgcctatgattggggcttcaccgacgacaccgccttcgcccgcgccttccgccgcagtttcggcctgtcgccccgcgatgcccgccgcgcggcgctggaagcccgtgccgccggccaccacgacggcaccatccgggcgctgcccggcggcgatcccggcctgcagcggctgatccggcagctgcggaccgtctgaggccccctgctgccccctcccccctgccaccggtgcagcccggccctgcacattccgccatctgcaatcgctcgcctgatcgcgcgggatagggcacactctctgccttgagaggatgccggttcgggaggaccggccgcgacgcgcggccaacgcgcgcgcagaaacggcagaacctgggcagtcgcaaggcggggtcgaatgacgagatttaagagcggcggcgctgccgatgcggcgctgatggggtcactggtgcgcctgtggctggaagcgggcacggtgatgatgatgcgcaccggcatgagcctgtttcagaccggcccggcgggcgaggaagtccggatggtgaccgaaaagccggccgcgttcatccaggctcaatttgccgccaccgccgccgccggcgccgccatcacccgcgacccgatggacccgatgggcgccatggtcgccgccggccgcgcctggaccggcgtgatctcccgcaagaccagcgcaaatcgtcggcggctgaaccggcatatctcggcgaagtgaggggtgggggtggccgctgaggctttgccggcagccctcagatcggcggaagcccggctgcgatacggacccggttgaattcgacataagggatgatcagcgaaagtggccggtcgtccagtggcacggcgccgtatctcgcataccatcgggctgcatcggcatccctggcatcgatgaacagggcggtaccgccaacgctggcggccgcacgcatgcagcgctcgacggcacccaccggcagatgcccgccaggactgcggtcatgtccgcgtgcaatcggctcttcccgccaggtcggcaggccggtcacgaggtcttccggacattctgttcttcgacgaaccggagcctggtctgcacccgcatgccattacgctggtgtctgaaatgctcaagcgggtggccaggacacggcaggtgtttattgcgacccggtcgccctacatggtggactgcttcgacctcgacaatatcgtggtcgccgaagccagcgacggggcgacgacgctgcgcaaccttccccgggcgcagtaccagcaatggctggatgacgactatctcctgtcggatatctggctcctgtcggatatctggctcctgtcggatatctgactcctgtcggatatctgactcctgtcggatatctggctgaaaatgcccgtcggggtgcccggatgatcagggtggccagatgaatcgcatctgcatcgtctgcgagggtgcgaccgaggtagagttcgtcaaggggtgtctggcgctgtcggtagaacggctggcgcgcttcctgtcccatccgtatcggacccgccggcagcaggcaaagaggctggattcccgtcccacaggggcctgggttattaatggatcgttccggaaggtgagtgtcatgtcgacctctctcaagattgatgacgacctcgaacggcgcctccacgaggtggcaggccgccgccgtcgctccgtcgatgccgtcacggttgaagcgatccggcaatatgtcgaacgcgaggaagcccgcgacgacttccgacgggaggccgaagtgtcctgggccgcttatcagacggacggcctgcacctgaccggccaggaagtcagcgattggctgaacagctggggcgccgacggcgagacgccggcgccgcggtgccacaggtaatcgtcaccaggaatgccgttcgcggcatccagcgctgccaggcctttctggcggccaaggcgcccgatgctgcttatgtgctggctttccgacaccagaaggaagccggctatctgttgccttgaccacccggccctcacggagcccccacctcccacccgatcccatcgctccgccgccacccgccggaagcggtcatgcagccggtcgaagctggcggtgtcgcgggcgaccagcaggaagccgtcgccatcggtcagcggcagcaccaccgcctcgatcggggcactgagcgcgggcgccggttgtgcgatctcaggccggccgggcgggcgccaggccagaagttcggtttcgaaaagcagatcggccgtcgccgtcagggtgtcatgatccggcatcggcgcctctgcgggcaccaggatcaaaacctgttgctgcatgccccagcgcgcattgtccagcgccccgtcgatcaccgccgccgccgggccggtggcaaagatcagccgccgggtcagccaatagcggatccgggcgcggagtgtcgcgcaataggccgggtcgatccagaataccgcccgcccctccccggtcaccgcctcggccagccaggccgccagttccggcgtcggctgggcatccaccggcggcggttcggtcgaaaacgccacccgcatgctccggccatcgggccggacggggtcggcgatcagacggttgctgggcgtggtcacggctgcgctccgccggccgccgcaggcaagctggtctcaggcagcggcgtgaagaaggtatccgccgcccagtcataaacctcgccggacaccgcctcgcccagcgcataaccgccgatgcccccgacgatgcagccgcccagcgcgcccacgcccgtgcccagcccgggttccacgaaggtgccggcggcagcgcccaactggccgacaccccggcagcccagccaggccccggtccagccggagacgacctgcaccgtgcgccggatcggccggtcggcgacgacgatcgaccaggcatcgatcgcaatgcctgcgatcagaaacacccgcccggcataacgataagcccgcgccccctgatagagcgcggccccgccacgcccggccggcgcatggtcgctgatccggaagctgtcatgggtgccgcgctggttccagtgatagtcgatggtaccgctgcgcggattggggccgtaatcgagccgcagcacccgcttgccggtgacgtcctggaaaaacagggtggaggtcgactggccgcggaagcgcggatcgcgcgtgtccagcgccaccgccagcccgttggtcccgggtatcggaatccgcaccaccgaccccgcccccacacccaccgggatcatccccgacatcaggtcctcgtcgctggtcacctcttcgctcagggtcggatctgccatgatctgtcgtccgtgatggtggtcagggagcagagaaggtggatcgtcacccgcgcagggctgacgggggaagagagggtgagagggccggcatggccatgccggccaagaaccaccacatcaccgccacccggccctcacaaggtcgccacctcccagccgatgccatgctccgccgccacccgccggaagcggtcatacagccggtcgaagctggcggtgtcgcgggcgaccagcaggaagccgtcgccatcggtcagcggcagcaccaccgcctcgatcggggcactgagcgcgggcgccggttgtgcgatctcgggccggccgggcgggcgccaggccagaagttcggtttcgaacagcagatcggccgtcgccgtcagggtgttgtgatccggtatcggctcggccgccggcaccaggatcaatacctgttgctgcataccccagaccccgccgaacgcctctacggccagctctgcggcctcatccgtcacccgaaaggccaccgcccgggtgatccggcgtttcaggcgcgcaatcaggcccggcggagggtcatgatcgatccagaccacctgccagtatccgccggtcactgcctctgtcagccaggccgccagttccggcgtcggctgggcatccaccggcggcggttcggtggagaaggcgacccgcacgctccggccatcgggccggaccggatcggcgatcaggcaattgcgggcggtcgtcacggccgtgctccgccagccgccgcggagggtgcggtctcgggcagggcggtgtcgggcaaggcggtctcaggcagtggcgtgaagaaggtatccgccgcccagtcataaacctcgcccgaaaccgcctcgcccagcgcatagccgccgatgccgccgacgatgcagccacccagcgcgcccacccccgtacccagccccggttccacgaaggttccggccatggcccccagctggccgacaccccggcagcccagccaggcgccggtccagcccgagacgacctgcaccgtgcgccggatcggccggtcggcgacgacgattgaatacatatcaatggccaccccggcgatcacgagaacccgcccgccatatttgtaggcacgcgccgattcgtaagccagtgcaccgatccgtcccccgggggtgtgatcagaaacgccgaagatcttgtgaacccgatcctgattccaatggtaatcgatacatccggatcgtggattgtacccatagtctaaacgcagtactcgcttaccggtgatgtcctgcaaaaagagggtagaagtcgatcgcccgcgacggcgtgagtcattggtctcaagccccaccgcaaatccaggggtcccgggtatcggaatccgcaccaccgaccccgcccccacacccaccgggatcatccccgacatcaggtcttcgtcgctggtcacctcttcgctcagggtcggatctgccatgatctgtggtccgtgatggtggtggctggcgtgatggtggtggcggtggtgatggcggttgggggcgggccgtcaccccccgccaaaactcccccgcacgatctcgaacacccgccggttggcggcgtcgatcagataggggtcggggtcggggcgcgtgccggccagggcgaagaccacccagccgcgcggttcgcggacgatggtcatctccacccgcaccggcacgccggcccgattgaccgcggtggtgctgccggtctgcacctcggccgtcgcacccggggcgcttgcccggtcgagggtcggggtgtcgaaggtcaggtcctgccgggtgcgcagggtctcggccaccgccgccgccagcgccgcatgatccgtcgccgcctggggcgccagcgtgccgacatagatcagccccaccggccggccgccggcatcggtggcggtgaactgccgcccggccgcgcggggcaggcggtcgtcttgtgccatcgtccatgccgccggcaccagcagccaggcggggatcggcccgtcccaggcggcctcgcgcatcggctcggcataggggccgccgatcagcccttccaggcggaagccttcggtggcgatgaacagcgtttcctcggccgccgcaaagccgtcgcgcgacaccgaggcatccgccagaaacatcagatcgccggatttgtagctgcgcagccggtgcacccggcccgcgcgttcggccagaacatcgccctgggccccggccgcacccggcaggcggcgggcatccagcacctgccagtcattggccttcagccattccaccatccagtcggccggcgccagttcgcgacgcatgcgctgcaccgccacctccagccgcacatcgccatcgggcgccgaccacgcggccagcaccgccagcccctcggtctcctccgcccggggcggcagggcatgggtggtccagccatgggggatcagcaccgaaaaattcgtccccggccgtcgggcatcgccatagggcacccggctgtggccggcggcgatctcggcgcggggggtgacgggttcggtcatcagccgctcggcggcgccggccccggatgccgtcagcaaaaggaccgtcaccgccagggggaacagcgcctgcctcatgccgccgccgtcgcatcggcaaagctcgcgaccacgatctcgaaggcgcggcggttgatcgcgtccaccagcagcgggtcggggtcggggcggttgcccagcagggcgaagaccgaccagcgggcggggtcgcgggcgatgaccagttccagccgcacccgctcgccattggcgcggcgggcggggacccttgcctcgcggacatccacctgggcgtcgggctcgctcacccggcgcaacggcgtctcctggatctcgatctcctgatccttgcggaacgaggcggtcagccggtccgccagctcgtcatggccggcggcgccgtcatgggggatggtcgccacatagatcagcccgaccatatggtcttcggtcgccgggttggcgaagcgccaggcctggccctcgcgcagctgatcgtcgcgctgctgcacccagatcgccgggatcacgaagcgggcgggcgccggtgcggtcaacgtcacctcgcgcagcggctcggccggcacgggggatgccgcgccggtcaggcggaagccttcggtgccgatgaacagggtctcttcaagcgcgtcgaagcgatggcgggcgaccgaggccgcgaccaggaacagcagcggcccggatttatagctgcgcagccggtagatccgggcatcgggtgccgtacgcttcaccgccagcacatcgccgagcgcgccggcgggcgaggcgatccggcgcgccgccagcacctcgaaatcattggccttcagccattcgaccatccagtcggccggcgccagctcgcgggccagccgctgcaccgacacctccacccgcgcatcctcgcccgggtccgaccagacggccagcggcaccagcccctcttccgccgcccccgctggcctcgccggcgggtgggtgtcccagccatggggcaccagcaccgaaaacccggtctcggggcggcgatcgtcttcataggcaacgcggctccaggtccgggcgatgtcctcgcgcggggtccggggctcggtcatcagctgcatccggtcgtctctcctgctcatgaccgctagtctccaccgcccgaggggccgatgctgcccttcagccgcacgcccgcccccaggatcgcgcccagcttggcataggcgccgccatggacgcgaccgtcgccgccatagtcgtaatagccgaacccgcccgccgaggcggcaacggtgccggcggcaccggtcaggcgaccctgaagattgatcgtatagtcgtcgggcacccagggcagccagccgatcgggatggtgacatcgccctgcaacccgccttccagcgccgaggcgctggccatgccgcccagcgccagacccgcacggcggccgtcatcgcccagcaggatctcgcccttggccgaggccgccatctggcggtattccgcctggccgccgacaccgccggtctccagatcgcccagcgcaccgcggacattggcatccaccatgctggcccgggcctcgccataggcgccggcaccatagccgacgccggcatggcccttgccctcggcaccgagcacgttcagcttgccgccgacgctgccgtattcgccttccagatcgccatccaggaaggccccgccgcccttgaactcggcctccacccggccgtcatcggcggtgatcgatccttcgccgcccatcacccgggccgtgccgccatcgccgtcgcgcgtgccggcccaggcgtcgccttcggccttccaggcctcgcggtcgccctcggttccgggggtggcgggctggttctgaacatagtcgccataggccggcccgcaattcagcatcaccagcgggccgttgctgccgacgccgtcggcggaaatcgtcaccgaggatgtgccgccggcatcctcatccagcagcaccttgcccttgcgcaccaccccgtctttgttgacgaagatgaaattgtcggtgttgcgcagctgaagcagcttgttggtcgacgaaaagctgatgccttcggccgacaggtcgaagaaatggccgttggtatgttcgaaccgcacccgctcgccatccaggatgatccggctcatcacatgctggatcagcacattggcgcgggtcttcaccacctcgctgttgccgaccgcactgccccagagcgtgttggtgtcctcggtcgagacattggcggtgttgatcatgcggttgcggccggccatgcgggcatggtcgcgctgggcgcggaacaaaagctcctccgccccggccagatcctcgaagctcagctcgttgaagccaccgccgccggggctggtggtggatttgaacgaggtccgggtcttggtcgcaggcagggtcaggggcggcatggtctcggcattgggcacggtgccgaccaccagcggccggtcggggtcgccctcgatgaaggcgaccatcacctccatgccgatgcgcggaatggtctgcacgcccatgccccgcccgccccagggctgcatcacccggatccagcacgacgaccggtcgtcgccggtggcatagcgatcccagggaaagcggaccttgatccggccatagcggtcggtgtggatctcctcgcccttggggccgaccacggttgcggtctggatgccgtcgatcgccgggcgcggcgtggtctcgggcgtcacatagcgggtcgccgccggaatggcgcggaattccgccgcatagcgcggcgcatcgccggcagtgccgacctcatacccctcggcgctggcgcggtgcgacaccgccgtcaccacatgggggctgccgttctcgacctcagacgggtggccggtcagcgtgaacatatcgcccggcgccaggcatcgattggtcgccagcgcctcgacatggtcgacatcgctttcgatcgccgccatccagcgcgcggccccgcgcctgccactttcaggcgtcagatgccggccatgccagtcatagatctcgtaaggtccgttggtcgtcagcccggcgaccgatccggcccggccggcaagatccacctccggcgcctcgtagtcataatccgaccgggcgaccgcgccggtcacgaagcggaaatgccggtcccagcggatcaccccgttcaggtcgacatcggtgggggcgaagcgcagcacctcgtcggcggccggctgataggcatgcacgccatcggccaccaccagcacatgggcatcttcgcggtggcggaaggtccagaacagcccgtcctcttccatcagccgggcgacgaagtcgaaatcggtctcgcgatactggacgcaataatcgcgcttgggcggggtgttgatcacgccgccgaaatcgaaatcctgaaagccgttctcggtgaagatccggcgcatgatctccaggctggtcatgtcctggaagatccggcaatccgatgtctgggtcagcagccaggtccagggcctgaccaccagcgtataggcgcgccgtccgcgggcgaccgcctcgtcggcggaaagctcggtcacgatgccgcaccagtggcgccgcgtgccgccggccgatccctggggcagttccagcgaaaaccccaccggccggccgatcagctcgtcgggggcgacatcctcgcgcgtcgcccgcacccgcagttcgaagcggaacagggtggacagcgcctcgaagccttccagcttttccagcaggaagacgtcgcggccaaggctcgtgtccagcaccagcagccggccgtcctggatcggcgccgaggagatcggcgcccctcccaggcttccgagaccaccttccatcattccggctccctcatcggtctccatctccggcttcggctggccgagcctatcatcgccatccgcgggtctgaaccggcggcgcgcgccgccccggctttcacacgatcctgccgcagctttgtctcagccccggtcattgacagccgtcctttgcctcatccagcagctgcgcggcgcgcggcgagagcgggcagcccttcgccgccagcagctgcacggccagccgcgccttgtccggatcgaccagattgccggcgaagctcgacaacttttcatggaattccagaacgacattacaggtcccggctgtgtgccggacatcgacccgcgacacggccgcatagggccggcgatggctgcggatcacgccgaactccacgacattcgggtgcagcaccagccggggcctgatgtcgctgctggcccagctgatccagggcaggcccttgatgcccgcaaaccccgccgccagcggcagatgcagcacctcaccatccggcgcccccccaccgcccggcaccacctcgcgccgcacgggggccgccgcggtggcgtccagcttgccgcgcatcatcatcaccagcgccagcccgcccatgcccaccaccagcaggccgaacaccgcgaagatccagccggccatcattccgccacccccacctcttctgccgccgccgccccgccggtgcgggtcagatccgccgtccaggccgtgccgtcgggggcgccggcgccaccgaaatcggcgacatggcgcaggaacacgtccagcagctcggccatgtcctgtgccccgcgggcgaccagggcggcacgcacgggggccgcctgacgggcgaccacggccgaggggtagtcgcgggccagccgcaccaccgcttcgacataggcttcggtcgaccgggcgagtgccctggcgaggccggcgcggcgggcctccatttcggccaccgccgcttccgcctcggccagcatcgccttcgcgcggctgcccgacccggcctgtttgcgcattttttcgagcgtcggccgcgccacctcgtccaccgcgcgcgcgaccgcgtccagccggagcgcatcgccgcgcacccggtagcccgaaagcgcgcccgcattcatcaccgcgcgcagcgcccggtcgcgggcggcattgctttcggccagcacctcgcggatctcgcgaccgagcccggccagctccgcgcgcgccgcctcgtcgggcaggcctgccgccagggtctccagccgggcgaccgggtcgccgccgccgtcttcaccgcggatccgggccagcatggcattggcttccgacatccgttcccaggccgcggaaatctcgcccagccgttcctgagaggtgacggccggcaggccgatcgcgaaacgcgcgccgatggtgcggccggtggcgggccggccggtgcgggcatcgaagggcggaagctcgcggcggtcggccgagcccagccggtcggccggggtggtgatgtcgccgccgcgcaccgccagcccgccggcctggccatgtggccggccgcggcggttcaggcggaacggctcctgcgtcagctccgcggcattgcccagcatgtcgtgcagccccagcggatcgggtttcagcagccccaccgggtgcagcttgccgccggccgaccggctgccctggtgccaggcatagtccgagggcggcccgtccggcatcggtgcgtggcgggccaggaaggtttcggtcgcaaccgccgccccgccgcgggcggcatattcccattccgcctcggtcggcaggcgcacgaagccggtcatgcccgcccggcccggcagggtgtcgggggcctcggccatcagccattcggtatagcgccgtcccagatcgaccgcgtcgaaccagctcatctccaccgccggcaggcgggtgcggatggttggtctggcgcagtcacccagaagcgcgcggcgctgcgcctcggtcagctcgtatttggccagcaggtaatagcgttcccccggccgggcgggatcggtgaagccgccggccaccgcctcgatccgccggccgtcgatcggcgacagcgccgccccggcatcgcccgcctcgaccagcacatcgtccagcggcccgtcggccgggtgggccacgcgccggaacaccatcgatccgccgcagggcatgggcagcaccacatcgcccgcagccggcgccgggttgaacatcttttccggccacggttccgcagcatcaacctgccctgccatcagcaccaggacgattgcggccagccaccaccgttcacccatcccgcaacccctccgccggggcgatcccggccgcccgcacccccgcccagccggcggcgagcagggcggccgccagcgtcaccgccgcccagatcccgaaatcttcggcactcagccgggcgatgcgctcccccggcgccagatcgccggcaaagacccggtcgagtgccgcggcaagccccagataggcgagccccgccagcgccagcgcgcccgcggcaaaggccgccgcctgggtcagcggcaccaccaccagggcgcgggccggaaagccgatcagccgcagcaccgccagatcgcggcgcttgcgctccacctgcgcccgcagattggcggccagcgccaccaggcagccgaccccggccagccccgccaccatccagaacacccggcccagattgcggtccagcgcctgcatccgccggatctcggcaccgttggtgcgcagctccaccccgagatgccgggcggtatcggccgccagcccctccacctcgtagatcgtggacgcatacagccggaagcgggcatagcgtcgcggccggtcgggcggcggatcgccgcgccagcccagcgccggcaccgccagcccctcgcggaaatcctcggtcgcggtcagcaggtccagatgcaccagggcggcggtttcgggccgcaccgggccgtcggtgatgccggtgacggtcaccggcagccgcgtcaggtcgaaccgtccgccgcgctggcggctgacctcggcgatcagcgccgtacccggccccgcctgcaacgcctctgccgccgcccggctcagcacgatccggtcgggcgcctcgggcgccggcagactgcccagcatcggatcgccctgcccggtcggctggatcgcgaggcccgaaatggaggtccgtgcttggcggttgcgcagccgggccagccccgcggcgatcgcccgggtttcgggggtcacgaaggccgtgcgcggatcggcggcgatggcggcgatgtcgtcggcgccgaaaccgccgcttgccacgggcacgatcagccggttggcggggtcgcgcaccagccggtcggccatggtgccgatcacgccttcgcggaggccgaacagcaccagcagcggcgccagcaccgccgccagcgccagaatctggcagagcgacagccgccggtcggcgaccatatcctgaatggcgaggcggacgggcagagggaggcgcaggtgccggcgcatcaggcggcctccgtccagaaccgcgcccgcaccaccggcccctcggctgcgatctcgtggcggatcatcgcgcgcccggtcgccgccagccgctgccagtcatggctggcgatgatcgcggtggcgccggtgcggtccaccagatccagcagcagggcgaaaacccggtcggcattgggcgggtccagcgccgcggtgggctcgtcggccagcagcaccgccgggcgatgggccagcgcgcgggcaatcgccacccgctggcgttcgcccaccgacagcgccgccggcttcgcgtccagccgatggctgatcccgagccgcccggccagcgccgccaggtgatcggcatccaggcgccccgccagttcggccggcagcgcgatattggcgcgcaccgtcagatagggcagcagcccgccggtctggagcacatagccgatggcttgggcccgcagccgcgccagcgcatccccctgccgccgcgcccagagatccgccagatcgaccgcgccaaagcgcatcaccgccgcccgatccggcgccagacagccggcgagcaggttgagcagggtgctcttgcccgacccgctctcgcccgccagcagcagcacctgcccgcgttccagccgcagctccggcacctccagctcatagcccggccgcgccagatgcaggtcgcggatgtcgtagatcgggccggtcacggcagggcgtccagcgcgatcgggtagaccgcctcgccgcccgcgcggtcgtcgtcgagcgcgatccagaggtcggcgtcgtcgtggatcgcccgataaagccggatcttggccgccagatcgtcgaggaattcgcgctgctggccgaagctccaggccagccagtcgtcctcggtcagctccagcacccgcgagcgatagggcaggccttccagatactcgccgatcagcccggtatcggccaggcgccgcgcctctgcccccgccacccggtcgggccggcggctcatcgcggcggccgcgccctgcaaggcgccgaagaaatcgcccggcgcgatccgcgtcgcctcgccggcatccaggatcgcctgcagcgtcgcctgcaggtcgctcaactggttgcgggtgatcagcacccgcacatccagcgccttggaggccgggttggcgaggtcgcgatcggccacccaggcctggaacagttccggcggccggctgccctgctgcgcgccggcccaggccaggcgcatcgccttgccgaccagcccggtgcgttccagcgcctcggccaccggcgccggggccggcgccgcctccacttcgggcacgtccgccggcgtcagatccggccgcatgccctgggcgatggtcgtcgccagccggtcgaccaccgcctcataggccgcgacatcgccccccgccaccgggaaatacagcgacccgatattgggataatcggtcaggtcgcgataggccgccgccgcgcgggcgtgatcttccgccccggccggggtttccagatgcacggcggcgatcgcggtgcggttggcctgcgccagcaggcgcagctgttcggtgccaagccccgacgcgccgccgtcttcggcaccggtccgcgggctcgcatcggtgatcagcaccacgaaacggccttcggtatcgccccagtccacaccctcgatcgcggtgcgcaggcccgcataggcatcctcgcggaagtcgcggttggagaccttcgacgcctccagccggccgagtgcggtcaggaaatcggcctgctccggatcggcgaccggttcggcgaagaccttcgagacatagccgtcggggctgccgtcctccatcacgtcgcggaagccgaccaggccaaagcgcggcgcggcgggcccgaattccttcaccagccggtcgcgcaccccggtcatcacccgctccgccgcgcggatatagcggtcgaaggagatgctggtgtcgaccacgaacacgaccccggtgcggtagccttccgcgacgacatcagcttccggagccggcgcttcgggcgccgccgccgtctcgggcgcctccgccccctcggacgtcgcggccacattcagcgccagcgcctgaaagccgtcggggaaccagacctcctgccagtccaggatcggcagcagatagaactgccgcgagatgtcgacatgggcgggcggttcggccgcgatcaccggcgcatcggccgcgagcgtgccggtctggatcgcggtcagggtgtcgcgggcgaaggcgccggcatcctcttcctcaacgatccgacgcagatcttccccatccttaaagaacaacgcctggttgcggttgacccggtcggtgaaggccaccaccaggttctgcttccagtcgatcaccgttctggccggcacccagccgaccggcgccgagcggccgccgcggccgacctccacccagtcctcgccgcccgccgtctcgcgcccatagacgaagagcaggctgagcggcgggatcgccgccgcaccctcgggcgcatcatcccccggccgcgccaccggcacggcccccggccgggtcagcacccgctgttccagggtcgatttccccgccatcagcaggggccgccgctcgggcgcggattgcgccaggccaatgacaggcagcagcgccagggccgtggccatggtcagcgtcttcaacatcacccctggcctccgctacccgccgttccgtccaaggcatcgaacaggttctgcgcctcgccatcgcccagcctggccgccttggcataaaaggcccgcgcccgttcgacatcgggcgatttgaagggcgagggctcgcccggcgccaggcgcggatcatagaaccgcccgatcgcccgcgcggccggcgcgctgccctcggcggcggcgcgttcccacaccaccagcgcggtatccagatcgccgcggtcatagaaggaccggccggcctcgtacatctccgccgccggcagcttcgcgatgcgcggcagatcggccaccgtccagccgggcgccgcctccatcggcgttttatccatccggggcatcgccacactcaccgccccgtcggaggcctgcatccggtggctgaagccgaagccgatcgccagcacaagcccgacggccgccacccccaccgccgccagcgtccgaagactccagccctcgcgccgcgccggttccggcggcaaggccgcggcatccccgccgatcagcgcccgcatcgcatgcggccggtccagcggatcgggggcgagcagccgggcaacgtcgccgcgcagttcctccggcagggccgacagatccggcaccttccgccgcgcctccacggcggcatgcagggtgcggcccatatcgagcggccggccggccgccgccgcggccagcaccagccccaggctgtaaatgtcggtgcgctcgtcgaccgcgccgccgaacagccccgcctgttcgggcgatgcccaggcgagcttgccggcgaagccatcgccgaagatcgtgcgatgatcggcgcgggccagcttggcgatgccgaaatcgatgatcttggcgcggtccagatcgccgccggccagcagcacattgtcgggcgccagatcccgatggcagatccccgcctcatgcgccaccgcaagcccggcggccagccggtcgcgcagtcgccgcacctcgtcgggcgtcaacggcttctgacggatccggtcggccagcgacgggccgtcgacgaattccatcaccagatgcagccggccggtttcgtcgcggaacagcccgtcatagccgaccaccgcgtcatggcggatgcggcgcagcgcctcggcctcacgcaaaaacagggtcaccacgccctcattgcccatcagctcgggcaggatcaccttgatcgcgtgttccgtgccctggtcgacatgggtggcgcgcagaatctcgcccatgccgccgcgggcgatcaccccggtcacccgccaggtgttcagcagcacgcggcccacgggatcgggcatttgcggcaccgcggccacggcatcgtcgggggtggcgggggtggcgggtgccgcatgcggcagggccccggccagaatcgtgcgatcgtcgttgtcaaccatggggacggctccagggcgtcagggtcacgtcctcgatcgcgtcgcaggccagcgccacggcggcgatattgtcgggggcgttgcgcgacagcgccaaagttttcagggtctgcaccgcgcggggtgccgggaaattggcgatgacatcggcgatctcgccatcgcccacgcagcgcgcgatgccgtcggtgcacagcaggaagcggtcgccgggcagcaccgccgccgcctccatctccaacgccagatcgccgaaggcgccgaccgcgcgggtgatgatattggcggccgggtggtcgcgggcctgatcctcggtgatcacgccgcggtcgatcagctcctggacatgggaatgatcgcgggtgatctgccagagctggcggtcgcgcagcagatagagccggctgtcccccgcccagaggcagacgaagcggccgccatggatcatcagcaccaccaccgtgctgccgatcatctcgcgatcgcccagcgcccggccctcggccctgagttcgccatgaacctccgccagcgcccggcgcacatcgcccagaagctcggcgcccgatgccggcacggggatggcgtccagccgttccatgatcatgccgctcgcccggtcaccgcgggcatggccgcccatgccgtcggccaccgcccagagcccgatatcgcgccggtccagaaaggcatcctcgttatggcgccgcacccggccggcatcggtcatgccggccgatcgcagcatcatcgccgccctcatggcgcgcctcccctcaggatctcgtgccagagccgcggctcgggcaggtcgggcgcgaagacgaagcggcccggaagcggccccgcctcgccgcgccggggcagggtccagaactgcacgggaccggcggtgcccggcggctcggcgcgatgggccagggccgcgaaggccgggcccagatcgcccggccggtccaggcgcacggccaccaccccgccggtcaggctctgcccggcgccgcgggcgtagtggtcggcgatgaccggcccctccagctccagcagcgcccgttcccagcggtcggggtcgacatcggggtccagcgccgccagcgccagatcctccacccgctggaaccagtcggccgcggccgaggccagccccggcggcggcggcatctcgtccagccgggcggcgatggtcagcggataataccgccccacccggtcgacgctggccatcagcacccctgccgccccttgccggccgcagatccccggcggcagcacgaagcgccagaccggggcctggaggtaaagctccagccaggcatcgggcaggtcgtcgcgcacccgcgccagccctgcccgcacccagccgtcccagggttcgacgaagccgtcatccagccggcggcggacgaaatcgcccagccagggcagcttgccgcacacgcccggcggcgtggcggatctcagaagcgccgcggacatgaaaacgacctcagatcgtcgagagagaaggggttgagcaccgatccggcgcgaacctcgaagcgcgcggcattctgcccggccctgaaggtcacctcgaaacggtcgctcgcgatctggcgcacctccgaccggtcgatcagccggaacagcgcccaggggccggtcaggctggtgccgcccgccggggtgccgtcggtgccgatgaaggtgacgcgcacctgctgcgggccattgcccggccagcgcagcggcatcggccgcaccggcccgtgatcgtaagcggcggtctggccgttcacctccaccaccacccgggcggccgacggcgtcagcgacaccggcaccaggtcgaagccgatatcgggcacggtgccgccgccggggaagaaggcatcacggatccgcgccgcctcgcggaaatcggccagcacggcattcggaatgcccagatcggcattgttgatcttgcgccagctccagcgccggccgccggtctccacatagggcgccagctccttgcggaaaaagccgtccagaatgccgccgccggcgaagatccgggcaaaatcgtccagcttcacatcctggcggctgccgcgatcgaagggatagcggccggcgagcgccgtgcggcagagatcgcggccgtccagcgcccaggcctcgttcagccgggcccgcgtgtcgccgatggtgcggctggaggcgcgctcggcgatggtctcggcccagccgcgcatcacatcgggcgcgcgcccggcatccagcgacagctgctgcgccagcccggccagttccgcctcggccgcagccccgccgccggggccgtccaccgccatgcggccgcggctcatcgcccggtaaagctggcccagatcgtcgacgatcgcatccaccggcgcctgaccgccggggccggcggtcacgaagccgtccagctccttgaaccgctcttcgacataggcgccgggcagctccttgccgccgccgccattgccgcccgccagcgcatccgatgccgcatcgcgcagcagcaggctggcgatccggccgctgaagccgaactggcgctgcatccggctctcggcctcaagcgccaccgcatcgcccgcacgctcgctgccggacggccggccattgcccgcctgcccggtatcgccgcctccggctgtggcatccccgcgcggggtcgccagccgggtttcgtcggccaccgccttcagcagggtcaccatcggcgagcgcggcgaggacagcacgttcaggctttccaccgcatgggtgtcgctctggaaggcggccagatcgatatcggcgatcagcccgttccagatcccgacatagtcgtcgtaatagagctgcagggtgtcacgggcgagtttcgccacctcttcgtcggtcagtgcgcgggtcttctcgctcagcacccagccctcttcggcggtggcgcgcacctccgcttccagcgccggcaggaaggtgttgtggaagccgtcataggtatagatgccgggaatgccttccgacagccgcttgcccgatcggcggaccagcacccgcgccgcctgcggcccggcatggtcgaccggcgtccaggccggcagggcggttgcggccgggctctcgaccagccgggcatagacccgttcggccaaaggttgagaggccagcagcgtgcgcacctgttcgaccagcgcaccatccagcggcaccgaggcgatcggccggtcgagcagcgccgccagatggtcctgaagtgctgcacgcagcggcgcattctcttcgcccggccagcggttctgccagtccagcgccatccaggcgccgatcacttcgggctcgatcggcccctgcgcgcccagcatcagatagaccttgagcgcggtgtaagacacatccgacggcgaggccgccgcccgcagctggttctccaggcgcacaagcagtcgcggcaggaacaagcggttcagggcccggtgataggccgacaccgtgccctgcgacagggtcggcgcctggtccagcccgaagccgcgatcgatcggggtctcaagcccggcctcggtttccgccgcaccggtcggtacgtcgcgcaaccggtccagaacgggcgaaagttccgccagatcgtcatcggccaccgccgtttcggcaaaaggcgtcaccgccccgcgatactcctcgatgccggccgcggcctcgtcgatcagccggctgttgccgaagtacgagaccgtccaggcggcaacgcaggcgatggcgaccacggcggcggtcgcaaaaccggcatggcggatcagccgccggcgccgggcggcggcggggtcggttgtgaccacgccggcttcggcgaacaccacccggttcagcagatccgccaggaagaaggcgcggccgcggccggtcatcggcggctgggtggcacgatccagaccgaaggaccgggccatggcgccggtcagccggtcgaagggcgtgccctcctgggtgccgctggtcagatacacgccgcgcagcagcggccgctcggccagccgggtcggctggaacacctggcgcagaaagtcgcccaggggggcccggaccgaggccatctgcgccgggaagccatggatcagcgcccggcgctcaccatcgggctcggcatgcatccggtcgatgacccgggcgttcagccggtcgatcagccggtcgaattcggcatcgaaatgcgcgacggccccagcgcttcggctgccgctctcacccttgctctccccctcgctctcgacctcgtcgtcgaaggggaaggtcatgccccagacctgggcgcggccggccgcgtccagatcgtcgaaaaacgcggtgaacccggccagaagatcggccttggtgaccagcacataaaccggcacccgcacatccagctgttcggtcagctcgcgcagccggcggcgcagtgcgcgggcatgggcatcgcgttcggcggcagaggccagcgccacctcggccagcgaaatgcagaccagcacgccgttcaccggctggcgcgggcggtgcttcttcagcagctccagaaagccctgccagccggcacggtcacgcccgcctgcccgcgtcccgggtcccgcagccgtcccatcggacgacacgccgccatcgctgtcctgcgtggtatagcggccggcggtgtcgatcagcaccgcctggtcggtgaaccaccagtcgcagtcgcgggtaccgccgatgccgcgcatccggcgctcggcctgatcctccgccagggggaaatccagccccgaattgatcagcgcggtggtcttgccggcgccgggcgggccgatcatcagataccagggcagctggtacagccattgccggccacggcccagccgcgagcgcttcagcgtttccagcgcctgaaccatgcgctcgcgcagccggtcgacttcctcatcctcgggcgtcgggccttcgggggcggcgatcgcctcgatcatcgcggcattgcggcggcgggcggcgatcacgctccacacgaaagccaccgcccagatcagaaacagcccgcccgcgatcagcgcccgggtcagcaccggttcgaacggccggctgtcgccgatcgcgaccagcggcccgcccacccagaccagcacccccagcagggcgatgcccaggaagctcaggaaccatttcgaggccagcacctcgatcacgcgcgacatcaggatgccctcccgctggtggtggcggcggcagagccggtttcggcggtcttcatcaggatgatctcgatgcggcggttctgggcgcggccggcggcggtggcgttgtcggcgatcggctcggcggcggcccggccctcgaccgtgaaccggccgggatccgagacgtgacgcttcagcagctcgaccaccgcctcggcacgggcgaccgacagggcggtattgttggggaagcggatggtggaaatcggctggctgtcggtgtggcccacgacctgcacccggccgggctctgcctccagcgcctggccgatccggtccagcgtcgggcgctgggcatccagcaccgtgtcgctggcggaggcgaacagcccgttgctgttcagccgcacggtcaccgactgggcatcttccagcaccgtcaccagcccttcgcggatctcgggctccaggaagcggcgcagccgctcacccgcctggttttcggtcaccaccagcggcggcggggtgggtgccgaccgcgcgatcaccaccgcatcggtcggcggcagggtttccaccgccgccagcaccggctgggtgcgggcatccagcgccaggcggaaaccggcgaagaccagcaccagcagcaccagcgtgcccacccccacaagccacagcggcaccagcgtgcccagcggccgatgggcggcttccagcccctgccagtgcggcgacagcgcggctgcgggttcgtcgcgcacctggcggatcgcccgccacacccggtcgcgcaccaggcccagcgtctgcgccccggccggatcgacccgatagcggccctcgaagcccagcgacaggcacagatacatcagctccagcagcgtcacatgtcgggccggctgttccaggctgcggtccaggatgtcgaagaagcgttcgccgccccaggtctcgttgtagaaggtcgacaccatcgactggccggtccagatcgaccggccgccccagggggtgttcagcaccacgtcgtcgaccgtcgcggccacggcatagcgcgcggcgcgcagcgtctcgccatccacgccgtcggccgcggcgcggcgttcgaaggcgcggatttcggcgatcacccgctggcgcagggtcggcacgtcgcgatgcaccgcgcgccccttcagccgcacgatcagcgcgaacaggggggcggcggcccgggccaacgggttgacgccggtgcgggcgaagatgccggaggcttccggcaccgcttcggccacaccgccatcctgcggccagggtccgccgtcgtcgtccagcggcccgaccccgggctcgaccggccccggccggaacggcccatgccccagggcatcgtgacccggggcatcatgatcggcatagccgccatgggcgcgggcctcggccagccggcccagcgccggcaccaccgtgcgttcggccgggtcggtcaccaccgcggcggcgcgggcgcgccccgggcgcggtctcagaatcgtgcggtcggcatcttcgccgaagggatcgtcatcgaccatggatcacacctgcggcgccttgatcgcccagcattccagaaccagacccgggaactcgccggcgacatggaccgccatgccgccagaggtcttcaggtcgtcccagaaccggctggtgcgttcgagttcgaaatactgcacccccggatggaagggcagttgacgcggcgccacggccagcggccggatggcgatgccgggcagggccgcgttcaccagattgcggatctgttccaccgggccgatcttcatctgctgcggcagatggcggcgcacggcttcggccggcgcatcggccttcaccgccagcacgaaggcggcctggtccagcaggctgcgatcgtcgatgcgggcgacgcggatgccgtaattgcgcagttccagcggcacggggatggcggtctgttccagcaccgccgacagcgcctggcgcagttccgtcatcaccgcccggaaggtgcggccaagatcctcgtgttcatagggcggcagcgatgccggccgcttggcgccggcggtgaacaccgccagatcgcccatcagcgccagcatctccgtgtacagccgttccggatgcagccggctgagcgccagcagatgcgcaaagaccggctcgtggcggttgacggtctgcagcagcatgaagtcggcgatctcggccaccccgcccgatccggcatgggcgacgcggtcggccagcgcctcgccgcgctgatgcagcatgccggcgatctcggtcgcatggccggtcagcaccggcgatgcggtcaccgtcagcaccggcggcacgaaacgggtatccagcacgatctgccggtcgggccggacctcgacgatccgggcgagtgcgatcgtggcatagccggcgcggtcctcgccttccagcagatagcgcagcctgagccgcccgatgccgatccgggcctcggccgtgctgaaggcattggcatcggccacctcgatctcgcgcgcggcaaaccgggtgccggcctcgggcgcatcggcatgatcgacatcggccgccccggggcggcgcaatggaacccccagatagacaagccggttacgggtgtcgggcggcacggccaggggggccggatggtcggtgtcgtcgggtaccgagaacagggtgccgtcctcgaacacgccccgcacccgtgccgcggcaaagcggcctgtccccagaagatcctgatcgacggcaagctcgaccagcccccaggggcaggggcccagatctgccacccggccgcgcaccagcttttcgatccagcgatcctgctgctggaaatgctggggccggatgaacatgccctcggaccagacgaccttgttgtcccatgacatggatgcggatgtccttagcgaagatcgggggaaaacggatgccggtgcctgtaccgggtcaccagccaccgtcgtccggctgaagctggatcgtgacgtcggtgccgtcgatcaccacctgaagcggttccaggtcgtaggggtcgacctcgatcagcgagcgccaccgggcctcgtcgatgtcgcggaagccggcgaccacgccgatcgcgcgggtgcgctggtcggccgagaacaccagctcgcggctgctgcccggggccatgaccagttcgccctggtcgatcagcgtgccgcccagcacgccccgcgggttttcgttgagcgcgaaataatccgcctgctggaaggcgccggactggctcagctggaagaagcgcagcaccaccggcgaggcgcggccttccgcatccgggttggcgtcctcatgggccatgatcgcgatctcggcctcgtcgggcgcgctgtcgccgaagcgcaggctgaacaggcggtcggcggtgccgatcaggtcgctgaccggccggtcgctgcaggcctggagcggcagggacaggattatggccaatatggccatcctgaaaacggacattctgcccatcatcgccgggcctccccgccctccgccggtgtcgcgcgctgcatcgggagggcagcgtgagaggtggcatagccgcgggcgaagccttcggcgaacagcgaccgcgcatcctcctcggcgcggctgcggatctcggcatggcggcggcgatagccgtcccagagtgcggccttgcgggcggtggagacgatggcgcccagcccgccgacatggccgaccgcgcgttcggtcgcctcgggcgacagggtgtcgatgaccacgcccagccccgcttccagcccgcgcaccatggcgatctggtgggcggcgatgtcgtcgaagccctgttccaccgccttcacccccgacgagaaggccggcagggtcggctgcaggaaggccagcatcgcctcttcgggcgtcgccgagaatttcagcgggttgttgttgcgcggcttgatggtggtgcgctcgatgcggaattcgcccttcagctcggcccgggccgacagggtctcgatcagcccgcgggccgtcgcccggaacacctcgcccgcggtccgcagcacctcttcggcgcgggaaggcggcagctgctcgcgggtcagcccggcgcccgacaggaaggcatcgtagagccggtcgtcacgcagccggtattccgacggcggcggggtctggcgcggcggcgggtcgcgatagggttcggggtcctcgtccgggtccggatcgggcagcggctcggggtcgcggatcggcaccggatcctccagcggcacgtcttccgggtcctcgaccgggatcgggtcggggtcgcgcggcggccggggtggttggctcggcggttggggcgggcggcggatcggcggggccggcgggtccgaggggtcgttctcaggggccgccatcagcccgtccaggttctggccgtcggcatcccagtcttccgggatctcgacccgggcgacgcggggcggggtgaaggcgaaggcggtggccggcggctcgccgcccgagaaggccgcccccggatcagggcgctgcaccggcttcggtgccgcatgcagcggccgggccggccggggtgccggcgcctcgtccggcaccggcatcagccccagcgtcagcacgtaatcgccaacgaacacccggtcgccatcggccaccacatggccggtctcgcgcggcaccggccggcgcggatcgttcacgaaactgccgttggtgctggtgtcgatcagccggaaccggccgctgtcatagtcgatcaggcagtgctggccggaaatcacccgggtcggatcttccagcaccacgtcgttggccgggccgcgaccgacacgcaggccgcggcggtcgaagctccgcgagggcccgatccgggttgccggatcgtcgcgatgggcgatgtcgatcacgagccgcatggcttcctccgtaaattcctcaatctgtcacgacagccggctctcacgacaaccggggcgtcaggctgccatcgggcccggttgcgatctcgactgcacgcggcggcgcgccctcttccgccagccggtccaggatcagcccggccaggcccggcatcagctcgccggaaatcaccgcctccaccgcgcgtgccccggcatcgcgtgcccgggcgcgggccagcaccgccggcgccacctcgggcgccaccgtgaccggcagatcataggtttcggtgatgcgccgcactgcgcgatcgagttgcaggttcacgatagcaagcaacctctcatcatccagtggcatgaatgggaccagtttgaggcgcccaaggaaggccggcttgaaactctgccgcagcaccggttccagcgcctccgcaagcccctccggtcccggtgcggtatcggggtcgtccatcagtttcgtgatggtctccgatccggcattggtggtcagaatcagggtcacgttacggaaatcgatctcccgcccctcgccgtcgcgcacccggccttcgtcgaagatccggtagaacacgtcctgcacgcccggatgggccttctcgatctcgtccagcagaaccacgccatggggccggcggcgcaccgcctcggtcagcaccccgccttcgccatagccgacatagccgggcggcgcgcccagcagcatcgagaccttatgttcctccttgaattccgagagattgatcacggtcagcgcccgggcatcgccgtgcagcagctcggccagcgcgaccgcggtctctgttttgcccacgcccgaggtgccggcgaacaggaacacgccggccggccggcgcggatcgtccagccccgcacgcctggtgcgcaccgcccgcgccaccgcctccagcgcatggtcctggccgatgatccttgtgcggagccgatcctccagccggcgcacggtctccagctcgtcatcggccatgcggccgagcggaatgccggtccagtccgaaatcaccgccgccaccgcccgggcatcaacatcaaccggaagcagcggatctttgccttgcacaacttttagctgttcaagcaccgccgattgtgcggccgcacgcgcctccggctcggcgaccgcccgtgcctcggccagctcacccaccagccgcgtctcctcggtatggcgcttagccatttcggctatttgtgtctcaagattagccagatcgactatcatggtatcgaccgacaaggccgcgccgcccagcgccgcatcacgcaaccgcatgtcacgcgcccgttccagcgcggcgtgctccgcgcgcagtttctgcaatgccggcggcaccaccgcccggcccatggcgacccgggccgctgccgtgtccagcacgctcaccgccttgtcgggcagctgccgctccggcagatagcgggccgacagccgcaccgcctcttccaccgcggcatcgtggatatgcaccccgtgatgggcttccagcttctccaccagcccgcgcagcatggtcacggcccgggcctccgacggctcttccaccttcaccacctggaagcggcgggccagcgccgggtcgcgttccacatggcgcttgtattccgcccaggtggtggcggcgatggtgcgcagctcgccgcgggcgagcgcgggtttgagcagattggccgcatcgccctgccccgcagcaccgccggcgccgatcagggtatgcgcctcatcgatgaacaggatgaccgggtcggcgctggccttgacctcgtcgatcaccgatttcagccggttttcgaactcgcccttcacgcccgcacctgcctgcaacaggcccagatccagggtcagcaaccgggcacgggccagcgccgccggcacctcgcccgccgccacgcgcagagccagcccctcgaccaccgcggtcttgccaaccccggcctcgccggtcaggatcgggttgttctgccgccgccgcgacaggatgtcgatcacctgggcgatctcgtcatcgcgccccagcaccggatccagccggcccgcacgcgccgcctcggtcaggtcgatcgcataggtggcgagcgccttgccgctctgcagcgaagagagcggcgcctccgccgcggccgggccgctgcccgcctcccccgcctcgtcgctgccgtctgccagctccggcagccgttccagaacctgatcggccgacagtcgccccagaaccgggatcacctgggccagctgctgcgaggccagctcatcgcgcagggccgccaccagcagatggcccgatgcgatccggtctgccccgctctcgatcgaggccaccgtccaggcctggcggatcatggcgatcagccccggcgccagggccggcgcgcggtcattgccgctgcgcagccggtcgagcgcaccgtcgagcgcggtcagcgcccgcggcaccgcgacgcccgcctccgccagcgcccggggcagcactgcgccgtcatcggcgaccagggcgcgcagccagtgttcgatctcgatcgcgtgattgccgcgattgacggcattgcccgccgcggcttcgagcgccttgcggcaggtccggttcagcttgtcgaccagggaacggatctgggtggtggccatgggtgcgggtccggaaagagagagggaagcagaggggaagatcgggggcggaaggtcagcggcggaaggtcaggcgccgatctcgaacacggcatcgtcggggtcgcgggcgggcggggcggcgccggtcagccagccggtccaaccgaggcgcagcccgcccgcctcgcccaattcggccggcggcacctcgcgccggtccagcaccaggcggagcgcgaacgacatcgccggaccgacataaagccggaccagatcggtgagcgcgcgcaccgcggcaccttcgggcagcagcgccgcgaaatgggcccgcgacagcgggccgaccacgatttcaaagcggccgtcgacatcgcggaccttctcgcccgcgaccatgtcgacgcccaggcggcagaagccgccgggcgtcaggcggctgcgctcggccgcgtccagccgcacccagctgccggcgaactggcggatgcgaaccgacgcgccaagctggccggagagcatcgcctccagggcggcggcagaacgcggcccgcgcgcgaaatggccggcatggcggatcaccgtcagatcgtcgaccgccagccgcccggccagatgcggcgtgccaagcccggtcagggcacgcaatgcgccggtgatcgcatcctcgcggccttccgccgccgcgcgctcatgcgccagcgccatgcggtatttcacctgggcgccgtggaaaaaggcgccctggcgatcgaggaacagatccacgaaacgggcgaaaccgggattgcgccgccgctcggcctcgatcgccgccgcggtcatatgcgagggcagcacgcccgaggggccgagcagccccagatgggcgatgcgcagcaccgccggcgccccctccacctggcccagacgcgcgccggccaccgcacttgccggaaaggccagcggcagcacgccctggaagcgcacggcatcggccggattgctcccggctgcgcgctccagcaccctgaccgcctgcaccggctcgaacgaccagggcgcgcgggcaagatcggcaaggacgccggtgggcgccggggtgggaaccgtttcggcccggggcggttgcatcgtcgtcatgcgcgcccctcagaccagatcctgcgcgcccgcgcgcggcggccaggtgcggatgacgcccggccggccccgcagtttcgcggtcagccgggtgaaggaattgatcgtgcaataaagtcccaacacccggtcgagcaccgccgcgagcagatagagcccgccggtcgcatagcgttcggggtcgagttcgagcgtcacatccaacccgcgggccatgccgccgaagcggtcgccgggcacgcgcgccatgccccggcggtgcgaaatgccggtgatcgcatcgatcgcggcccgggtttcgggcgcgtcgcgcagatcgtgcagcgccagcagttcgcgcagcgcggccgccccgtcggtatcgtcggtcagcgacagatggttgagcgacaggaaggaaatcagccgccagcggccgcgggcccccgcctcgggtcgcagcgtccgggtgggcggggtcaggcaggacaccgcccggatcgccgacatcgcctcggccggtttcagcaccggatggccgccgccgaagggcagccgcgccggcaggtcgcggttcaggcacagcgtgtcgaccgacagcacgccggtagcgggctcggacggattgaagccgtcatcgaccaggctgagatagatctcgctcgcgggatcgcgcggcccggccggccggcgctcggcatgccaccagcgccgggtctcgtcggccatggcggtgccgtgggcgacggaatggaagggttgatagagttgccgccggccgcctgaatcgctgccctcgacccgcaggatccggaaaatctcggtcgagagcggccggcgggcatcgggcaccacccggtacgcagactggcgctgatccagccggatcggctcggcggcctggcggaacaggttgacgatcggcacggcgcccagcgcaaaactctccgccgtcaccgcccgctccagatcctggtcgtggcgggtgaggaagacatggatctccagccggtcgccggtgggcgccagcgtgcgggcatcaaggccgttcaggtccaggaacaggaatttctcggggaaggcgaaatattcggtcagcagccgataggccggcagggtgcgggcatcgtcgggcagcagcccctcatccccggcaaaacccaccggcgccaccgcatccggcccgagccgcaccggccgcggatcctcggggccggcggcaaccgcgatgccggcgacatcattggtcagtcgctcgtaaagccgcatcgcctgggcaccgggggcggcgatgaacagccgcagccggtccagcccgatttcggtgaagctgcgcccgggctgcgtcatccgcagcccgatcttcagcaccgccaccgcctgctccaccccggcaatcgccggcgccgccaccggccgcgccttcaacgccacggtctcgatctcgaccggccagagggtagctggccaggcggtgcggaagcggcagggttcgggcgcccgcccctcggccggggccacgggtcccgtcaccagctcggccccggccgggacggtatggggccccgaaagatccgcctgcggcgtgaaccgcgcgatcgccatcgagggcaccggcgccagccagtgcgggtgcagcacccccagaagggcatcggtcagctcggggaaggcatcgtccagccgcagctggatgcgggcattcagataggccaccgcctcgatcagccgggccacgaacgggtcatcggcggcatcggcggtcaggcgcagccgcccggcgatcttgggatgcgccgccgcgaactcgcccgcccggcggcggatctcgaccagctcgcgctggtaatggggaagcagttcgtcggtcatatcaggccgccatcgctggtggcggtgacccgcacgccgcgatcggcggggtccacgacgccgtcgaagctcatcggctcgggcgccggttcggcggcgaccagggcgtcgatccgcaaccgcagcgtgcggtcaccggcttcggaattgtccaacagatgtaccgccaccgcccggaagcgcggctccgcctggcggatcgccgcctcgatgccggcgcgcagccgctcgcggtcgtcatcggacgagaccggctgggcggtaaaatcggcgatgccgtaattggtgagcgcggtttccacctcgggcagcttcgccccccagcccaccggccggcggcgggtgttgagcaggtcttccaggtcgcggcgcagcccctcgcggaaggcctccaccgtgaaacggtcatcgggcgccaggcgctcgtcatcgaccagcagccggtccaggatcgacatccggaccgatccggcctcgcgccggccgcccgcggaagatcgcccggccggcatcacgccgccccttcgccgctgccggccgccgggcagagccggcggatctccgtcagctccagggccggcatcagctcgtcgccggccaggaagcagcgctggccgcgtccggaaatcggcccggcctggggcgcaccgggcccctggccggtggcccagtcggtgcgccggcccagcttgagggcggcatcgtcgctctcggcggtcagggcatagatcgagggcatgaagaccatgccgtcgggcccaccttcggtttccacctcgaccggccgccagatcaggtcgatcagccggcgcggcgcctggaaggccatccgacgcacccgttcgagcgggacccagaaatagcggcccgaggcggtgagcagttccagcaccgggccggtgaggtcgcaggcgtcgcggaaatcgtcgacccgggtgccgttcacctcgatggccccgcgcggccgcaggttttcggcctcgatcaccgccgccgccgcatcggcatggcggccggcacggatcgcaaccagcgcctcaagcgccttggcgaccgcgggcggcggcgtgtcgaggaagtcgggcacgcggccctcggtcatcacttcgcgtcggatctgttcggcgcggatcagctgacggaagcccgaaagccccaccgcctgttccggcgcctgatcggcgatcatgtcgagctgacgatccgcgcgcgtcagttcccccgccgccaccatcagctcggccaggaaatggcgcgccgtggtatcggccgggtgcgcccgcacccgcaggagctgggcatcgatcgcctcgtcgagcagacccgcctggagcagtgccgcagcaccgtgaatatcggcggtggaggtcatcatcttcatcccgagatccggtcgtttgtcttgcctggccacaggggtccggccggtcgtggtcgtgggcggcatcatgactggggcagcccccgcgccacgaaccaggtgaccaggcgaaagcccgaactcacctcgtccagctggaaatgcggcctgagatggatggtgcagtcatagatgcccgggcgaccgggggactcgcgcaccgagaccgcacattcccgaagcggatagcgcgctttctgttccggcgttgcggtgtcgctcgcgatcgaatagccgagcagccagcggcggagatattcctcgcaggccgcggcatcggagaaactacctacgcgatcccgcccgataaccttaacgtaatgggcgaaacggctgacacagagcatgtattgcaacatcgccgacagccgggcattggcgctcgccgcctcgcggtcatagggccgtgccagctgcagcgacgggttgccgtgaaacaccacccagggcgtgtcgcgggcaggcgccagcgcgatcagccccagatccgccagccgcttgtcctgggcatcggtcagctgcacgtcgaccggcggcttcagcccgacatccggacggtcggtgccgaaatgatcggccggcagctcgcgcaccagcccgcccagctcgtgatcgcgggcggccccccggatgtcggcgaaccagccggtggcgtcatgggcgcggatcagcaccagggcgaaggcgaaggccgccaccccccacagatacttgccggcatcggggcccgacacgtcctcgacatagcggaaaccgtcgatccgggcgggatcctcgccccaggggtggcggagcaggatccgcgggcaggtcagccccaggaagcgggcatcctcgcccatcctgagaccccgccagcggacatgatccgcgccctcgaaatcgcccggatcgaagccgcggcccagcgcctcgaaccggtcgaggcccagcagccgcggatgggcaccggcgatgaagggcgcgaaagccgcggccgccaccgtcgccatgcccttgaggccggtgacgtcgtcggtggggtgatcggcatcgcgcagatgcatcagctcataggcgccgatcagcacgccgaagggctcgccgccggggctgccgaactcgtcttcgtagatcttggcgaacatctcggcacggtcgaattcgaccgcgcgctcgaaatcgcggcagatcatgtcccaagtgacgtccagcacccgcaccttggtcgaccgcgcccggcccgcccgttccaccaccagcgccaggccgcgccaggccgcttccagcgcctgcatccgcgggtgatgcaggatccggtcgagctgccggccgatcgccgcatcgatcagggcgatgacccgatcgatcagcggccgcagtgccgtggcacgaagcggaggggcacgaagcggaggggcgctctggaggggaagcgagacggacatcggatgcggcccccggtcagttgccgctgccggggatgcgggcgaccatgcgcagagaggtcgtcagctcttccatctgcagccagggccggagccaggcgacggcgttgtaggtgccgggggcaccggggacttccttcaccgacacccgcgcctcggccagcggatagcgggccttcatgtccgggccgctgtccttgttggcgttgacgtagttcatcacccagcggttcagccaggcctcgcaatcctcggcctccatgaacgagccgatcttgtcgcggcccatgaccttcaggtaatgggcgaagcgcgaggtggccatgatatagggcagccgggccgagatcgcggcattggcggtcgcttcgggccggtcataggttttgggccgctgggtggtctgggcgccgaagaacaccgcatagtcggtgttcttgtaatggcagagcggcaggaagcccagccgcgacagctcggcctcgcggcggtcggtgatgccgacctcggtcgggcatttggcatccggatcgccgtcgtcggaaacgaaggtgtcgaagggcaggccctcgaccttgccgccgccctcggcgccgcggatcgccgtgcaccagccatgcatcgagaaggcctcggccaggcgcgtgcccatcacataggccgcgttcatccagcaatagtcgccgtgatccatggccttgcgcaggccgcgctcgtccagcggcgcctcttcgaaatcaaaggcatcgacccgtctcgtgtgccgcccgtagggcaggcgcgccagcacccgcggcatggtcagcgtcacgaagcggctgtcctcgctgtcgcggaagctgcgccacttggtgtattcggtcgattcgaagatcttctccaggtcgcgcgggcgggtcagctcggtgaagtcgtcgaagccgaacatcttcggcgacgccgccgagatgaatggcgcgaaggccgccgccgagacgtgggagacctgacccagcagttccatgtcttccggctcgccggtgaattcgtaatcgccgatcagcgcgccatagggctcgccgccgggggtgccgaattcgttctcgtagatcttgcggaacagctggctctggtcgaattccaccgcccgcgtcaggtcgcggtgcagctctcgcttcgacacgttcagcatgcggatcttcagcatgcgcccggtctcggagaagttgaccatgtggtgcatgccgcgccacgagccttccagcttctggaatttctcgtgatgcatgatccggcccagctgttccgacagcttctcgtcgatcgccttgatcgcgcggtcgatggtctgggtcaggttcttggaatagcggacggtgcccttcagcgcctcttcggtcagcgcgcgcagcagttcctccgcgcggtcgcgatcggtctggcgggtggcggaaatcgcctggtcgagcaacgagaccggggcctcggcaagaccggcttcggcggcgcggctctcttcgcggatcacggacatggaccttactccccgggcttgctgtcggcgggggcgcgcacacccagggcatccgacagctcggccagccgggcatcgtcctgcagcacgcgttcaagcagctcttccagctcttccgagcggtcgaccttgcccatcaggtcacgcagcttctcgcgcgtttccagcagccggcgcagcggctccacctggcgcaccaccgcgcccggctcgaaatcgtccaggctggtgaaattcagatgcaccgccatctcgctgccgtcgccggccagcgtgttctcgacgcgcaggtccagatgcggcgcgatccgggccatgacgtcgtcgaaattgtcgcggtcgatctgcacgaatttgcggtcgcgcagcggcgccagcggccggtcgggatcgggatcgcccgagaaatcgcccagcacgccgatgacgaagggcagttccttgtcgacgacggcgccttcggtctcgacctggtaggtgatgtgaacccggggcttgcgcacccggttcagcttttcatggatactggtcgcggacatggtcttcctcgtgggtgcccccgatggacgcggagcgtcggcggggccgtagatggcaatcaggcggcgtcggccggcttgatcccggcggcgatcaggaaatcgcgccgggcggtctcgtcgcggatcagttcggtgatcagatcggtcagcggcagacggccgcggcggacggcctcctccagcgtgtaggcgatgggcgaatgcggctcggcggtgcggaaccaccccgccaccgcctcgatcacccgaaaggcgtcctcgcgggtggcgatcgccgtgaccggcagggccatgccggccggcacgggagcggctgcagcggcagccggaagcgcctctgcggccggccggtcaccgggggcggcaaccacctccacagccggctcgggcgtcttgggcgcgcgggcgccaagtcccaggcgcagcccctgctcggccgcctccagcacctgacggatgcgggccagcggcggcgcgtcgcggccggcggcctgatcgagggctgcatccagccgggccagcgccgcgcgggcggcggcgatgccggcctgggcacgatcgatatcggcgctggtcatctcacggccggcggcctcgatcatcgccatgctggcggcacccttggccaggcgctgttcgcgacgatccgcctccagccggcccagctccaccgcctggtcgatctgccagagggcgatgccacggccctgcggccccagcaccggcaccttgcggatcgcctggaccagcacgccatcaccgctttcgccgttcagcgccatcagcggccgcacgcgcgacgcaatgccgtcctcgtccggggcgggccacagcccgtcccagaaattgcggatcagcccggtcgccacgtcgaagccgaaagccaggccggcaaagccgttgaggcgcacctgcgcctcgatcagcagcccggccacctccagatccttggccttgtggcgcagcacatccgccgccagccggtcgatctcgggccagtgttcggccggtgcctggggctcgtcctccacctctgccgcacgttcggcggcgcgggcggcggagcgcagatccttcagacgccggaacggggcatcgacccggtaatcctcgcgcgggtcctcacccgcggggcgggcccctgcaatcggctccagcagggcctgaacggccgggtcgggtttcggactgggcggcaccggatggggctttcctgtctggtgtgacgagacccccgcatgtgcttcgcggtcaccttcgggggctgtgacagtcatcgttcagtcatctttccgcagcgatccggcatccgaagcatcagagaccgtcgaagcgcggcgcgggaaatctgttgaaggcggcagtttccctgcattagcgcgaatcgcgatgccacagggaaatctgtcgtctcgctttctcagtgataggcaaaaccgcctgtgaccgggtggagcatttttggggtcgttccggcacagcagatagaacccgtcaaaactgtcatggaacccgtcagcgataaggttccacttcgctcacgatcacggcaccgggcaccggcagatcccggcgctcgacccccgccagccagatcgcataacggcccgaggccggggcatcgatggtcagcgccgggttgcgatcccccgccgccccgtcatcggcgcaacgccagctgccgtcggggaagctcaccaccagggcggtatcgctggcggcaaccgcgtagagatgcagcggccggctgccggcctgaaattccagcaccatatcgggccggtcgccggccaggaatcccgggcatccggccacgaaatccgccgccggcatggcaccgccgccgatcacgcccaccgggtagggatcctgtacgaagccgctggtcagctgcaccgttccgaaatgcggggccgccaggcgggcaccctcgggatccgccgccagcgccggcacgccgagcacaagacagccgccgacgaacacgttacggagtgttgatttcatcttcaccaacctctgggttgcacatccgggcacctgttccgaagcccgcagcctgcctcactctgccgtcgggcctgtgaccaaaaaaggttaataagctgttaattgaaagacgtgacgcaatgttcagaggtaaaaaccggatttcacgaaacgatcattgactcaatttcggactcagtgaaaaaacgttagcgggaaccggcggaaactgcgagcctcgaatgagaggtacttcccgcttgctccggaaacggcatccatgaccccgaaagaggcgtagaggaacgcaatgatctatctgaatatcgagggaattcagggtgacgccacccacgagacccacaagaactggatcgacgtgtcgtcgatgacctggggcacccaccgggcagtctccaccccctctggttcggcccagaaccgcgaagcctcggagccggtgatcggcgaagtgcacatcaccaagctgatggacggttcgtcgctgaagctgttcgaggccgccgccaccggtaatcagggcaagcagatccagatccacctggtcaccacgggcaatcccggcaacacctacatggaatacaccctcaccgacacgctggtgagcggctaccagatcaatacttcgggcgatcgcccggtcgaggaaatcacgctgaacttcacccgcgtggacatgaagtacaccacctatgatgccaacaaccggccgctgaacaacatcgccgccggctacgacatcgccaccacccggaagtcctgaccggtcacgcatgatcgggccatcctgcccgatcaccatgggatccgatgccgttcatggggccgcccgcgccggctgcgcccgcggcccctctcccgctcgggttccgtgctgcccggacctcctttcctctatctcccccccccttctctgtcacaaaccccggcacgccatgtctttgaggaccagacgtctgcgctcgctcaccgtcgttctggcggcggcccctgtctgggccgcctgttccggcgccgatctggccgggctggaccggcccgaagaggccggcatgccggttgcgagcttcgataccggcgcgccgcccaagacctttgcggccacgatgaagatgtcgggcggcggcttcgccaccggaacctcggacgtgctgccgccgccgctgctgcccgacgccgccggtcgtgccgaaaccgcccgcgccatcgcgctgaaggccgaggtactggccgccgaggccgagcgggaccgcgcgctgcgtgcgcggcagcttgatgcgctgaccgtacagctttccgctttgcgcacacgcgacgaggccgccgatccggccgaggccgaggcccgtgcggcgcttcgccgggccgttgccgccaatcgcccgccggggcgggtggtggtgcgatcctccgacggcggcatggccgagatgggcggcatgatccgctcgctcggcggcgtggtccgcgggttgggcgatcccctgcctgccgaaccgctgcctgccgaaccggatgctgccgcgtctcccaccccgccttccgctgaataggacgacccgaccgatggccctcgacgacaccctgaaccgcctgcaccgcacctttttcgacctgaccgtggtggtcgacacggcgctgcgtgccgaaagcccgcccgcgatcgacgagatctggccgcggatcgagcccttcggccggatcctgacctatctgcacgacgagctgcgcgccgccgccccctctcccggcggccgggcgcggcttgcctggtcgggtgccgcccgcgacaccgcgcccgccgcccatggcgcggccgagaccaccgtcacccgcggcatcacctgtgccgtgcgggccgaagcgggcctgcgcttctggcatctgggcgagggccggccgggcgatgccgccttccgggcctatgtcgaccggctgggccgcaccgcggccgaagccggcggcagcgtgccggcggcggcgatccgcggcttcatcggcgacaatggcagcaccaccacgctgatccgccgcccggtgcagcaggccgacctgccgccgatggcccggcttgtggcgctgaccgcccttgtcgccgcctcgatcgagatgctcgccccggcgcatccgcccgtcccggccgcaatggaagcctgatccgatgaccgacctcaccagcccgccgtctttggggtcgggcgatctggcggcactcttcggcgatgtgatccaggatggccgcctgctcaccatcgacagcccgctcgggcccgacatgctgctgctcgaacgcctggtcggcgaggaggcgctgtcggagcccttccgcttcgagctgacggtgcgcgcgaagcgtgacgacatcgcctcggccgagctggtcgggcacaaggtgtcgttcaccctggaacgcgccgacggcagccgccggccgtggagcggccatgtcgagcgggtggtggcgggggcggccatcgccaaaggccagcgctactaccatctggaagtgcgcccctggctctggcaattgacccataagaccgattgccggatcttccaggacaagtcgacgctcgacatcctggaagagatcttcggggaattcggcttccgggattacgatttctcgggcgtgctcaacacgccgcccaaacgcgactactgcgtccagtaccgcgagagcagcttcgccttcgtctcgcggctgctggaagaggacggcatcttctactatttcgcccataccgatgacggcgcccatgtgctgacgcttgccgacggggcccatgcctatgtgccggtgcccgagcaggagctgcgctacgccgcgaccgatgtcgacctcaacaacgtcacccgctggcgccatgcctggcgcttcgtgccggggcgctgggccgggtcggactataatttcgagatgcccggcaccgatctcgccagcgaggccgcctcggtcacgccgctcgagaccaaccgcgccttcgagatctatgactggcatgcccgtttccagacccgcgatgccggcgcccgggtcagccggcggcggatgcaggcgatggaaaccggccatgacacggtgcaggcggcctccaccgcccgcgatctggcgccggcgctgtcgttcaccattttcggccatccggcggccgacgaggccgggcgcggctatgcggtggtgcgcatccgccatcatgcgatcgacaccacctatgatacgggccccgaccggcggccgccgacctacgagaacagcttcaccgccctgccggtggaggtgggcttcgtgcccgcccgcaccaccccgcagccgcggatcgacggcatccagaccgcaaccgtggtcgggcctgaaggcgaggaaatccacaccgaccgctatggccggatcaaggtgcagttcccctgggaccgctatgccaccggcgacgaccggtcgtcctgctggctgcgggtgatgcagccctggggcgggcgcaatatgggcgcgcagaccattccgcgcatcggcatggaggtgatggtctccttcgtcgagggcgatcccgaccggccgctcgcgatcggcatcgtgcccaatgccggcaccatgccgcccctgaccctgcccgcgaccaagacccgcaccgccttcaaatcggcgtcgagcccgggcggcggcggcttcaacgagatgaccttcgaagatctggccggggcggaagagctgatgatgcgcgcccagcgcgaccagaccgaactggtcggccgcaaccgcatggtcaacaccgccaatgtctccacccaggataccggcacgctctggggcagccgggtgggcgacagcgagatcgtgatgacccaggcctcgatcctgatccagcacaagcagagccggatcatcctggatggagagcgggtgcggatcgagttcaccaacggccatttcatcgacctctcggccgagggcgtgatcatctcgtccaccgccaagatcgtgaccgtgcgcgacgagagcaatttcaccgccgtcgacggcgaaggcgtggtcgccaagggcaaggtggtccatgcggtcgatgccagcgagggcaacgacgtgaccgtctcggccgaaggcgtcgccgtcaacggcaaggtcgtgctgctcaactgcgagtgacggccaggcactttcgggcacgagagccatagcaggagacccgtcccccatgtcgtttcccggatacagcgtcggcgcgccggtgatgggcggccatcagggcatcaaggattacgcgctgggtgccatcaccgaagtcgcagccccgatgctcggcccccgcgaccgcaccgacatcatccccgaactgccgccggcgatcgcacgggcggccgaagccgccctgcaaagcaaggccgcccaggcgatccagggcggcggcgccgcggtggcccagggctatgccgcggatctcggccccgtggccggggcagccggcgacctggcgggcagtgcggccgggggtgtcggcagcctgttcggcgggcttcaggacgccgtggccggcggcatgacgctgccgcttcaggaactcacccccgacatcctgccgatggccgcccggctggtgcaggcgccggaagtcgccgccgccgatctgctgcgccgggccggcgcgcgtatggccgaacgcgcccgcgcggtcgccatggaacgcatgggcctgtcgggcagtctggccgatgccgcaacccagagcctcgcccaggtggccggcggcgccgacccggcccaggtcgcgatcggcgcgctgatgggcggggccgtgcccttcggcgacggtgccgaagacggcggcacgggcgacgcggtgctcgatgccggcgcgaaggtgctgtccggagaggtgctgaaaccggtgaccttctccgaagccgccgcgcccggcggtacgcctggcttcgcaccgcccggcctccgcacgaaataacgccctcgtcttctcccccaccatcattcacggatgaccccgccccatgtacgcccttcaggaaggccatctcgatctgcccaccgattgggaggaccagtcggtcaacgtcttcgcacccccgggggccaagtcgcaggggctgtcgctggtggtgacgcgggagccgctgccgcccgcgaccgatatccgcgcctatgccgaggcggaagtgaagcgcatgggcaaggaactgaaggccttctcgctgctcgcccgccatccgctggaaatcggggatcagacgatcgaggcctatgaggtgcggtggaaatccgacaaggggctggtgcatcagctgctggcggcggtggaggcgaacggccgggcgctgatcttcacggcgacgaagccggtcgacatggcgccggccctgcgcgaccgcctgctggcggtgatccagagcttccggaaggcctgatccgatgggccgcgcggcacgcgtcggggacgccatcgcccattcccacaaactggcggggttcctgatcggtgccgcgatcggcatcggcatcggcctcgccatcggttttgcggtcgcgaccggcggtctgggcgcgctgatcctgggggcggtggccggggcggcgatttcctacgccaccgaatcgatcggctcggccatcggcgacagtatgatggggccatcgacgggcgcgatcaccgtgggtgcgcccacggtgctggtcaacaaccgcccgctcgccatcgccatggatggccaggcgagctgttcgaaggaacccacccccaacgcccccgtcgcccagggctcggaaatcgtcttcgccgagaactggaacgcggcgcgcgagggcgacaagatccagtgcgacgccaagatcaccgaaggctccgacgatgtgaagatcggcggcccccaggcgacggtgatggagatcgacgacggcatcccgctctgggccgaggtgctggtgatcgccgccggcttcatcggcccgggcggcgtgaaggggctgttcaaactggccgggcgcggcgggctcaaggccgcgatccgcggtgccggccagtcgatccggggcgcgtcgcgcgccatcgtcaccggcatgacccgggcgcggggcctggcctcggccggcgcgcggcgcatggcccaggccgcgcgcggcatgcccggccgcatccgccagttcctgaaggacccggtcgacatggcgaccggcgactgggtggactggcgcaccgacatcgccattccgggcgtgctgccgctggaactgacccgcctgcaccgctcgggtgccgcaggcgccaccggcggtttcggccggcgctggaccgacagctggtcgcagcgcctgctgcatgatgccggccaggatgccctggtctggctgaccgaagacggcagcgaactggcctttccctggcccggccattggggcgacggcgaaaacccgctgcatccgggctgggtgatggaggtgcgcggccccgagaccaccctccgcgacctgccctcgggccgctggtgggccttcccgacgcctgatgtggagccggcccggctggcgctggccggcgcccgggcacgcgacgcgctgacccccgccaacgaccatgccgccccgccggcccatgtgatcgcgatgggcgatgcccatggcaaccgcatcgatctggaccgcgaccccgccggccggctgcgcgccgtgcgccataccgacggccatcatcttcgggtcgagaccctgcccgacggccgctatctgtcggtcgatctggtctcggacccgaccggcgccgatgtctcgccgatccgcctgctgacctgccgcttcgatgcgcgcggccatctgaccttcgtcgatgcgcgcacgaccggcatctaccgctatgaaaccgatgccacaggccgggtcacccgctggtcggatggcggcagcacctggtccgagctgttctacgacgacgccgaccgggtggtcgaaacccgcgccgccgacgggctctacggtgcccgcttcgcctatgacgatgcggcgggcaccgtcacctgcctggcagatgacggcgcggtcaccacccacacccatgatgcgctgggccggctgatccgctgcgtcgatcccgaaggcggggtcacggaacagatctgggggccgcgcggcgatctggaggccgtgatcgacccgctgggccggcgcagccgctatacccatgaccgtttcggcaatctgaccggcatcacccatcccgacggcagcaccgagattctggattacgacgtccttggccgcccggtcgcgatcaccgatgcgctgggcaatcgctggcgccagacccgcgacgacacgggccggctgaccgcggcgatcgaccccgaaggcggcgaaatgcgctggcgctatgatggcgccggccgggtcaccgccatcgccgccggccccggcgccggccagcccttcgccgtcacccggctcgcctatgatgccgccggccgggtgagtgcgatcaccgatcccacgggcgccaccagccgcttcgcctatgaccggctgggccaggtgatggtcagcatcgaccccgccggcgccgtcacccggctgcagcgcgatgatcgcggccgggtgatcgcggcggatctgcccgatggcggccggatcacggccgaatacgacggcgagggcaatctcacccggctggtcgatcccctgggccgcgagacccgcaatgtctatggcgccttcgatctgctgcgcgagacggtggatgcaaccggtgccgcctatcgcatcgcttatgacggcgacgcccggccggtcgcgatcaccaacccgctgggcgagaccgcgacgctcacctgggaccgcaacggccggctgatcgccgagaccgatttcggcggccgcagctggacctatctgcgcgatgccgccggccggatgatcgaacggcacgagccggatggcgacatccgccgcttcagctatgacgaggccgaccggctgatcgccgaagaaaccgcctcgggcatccgccgctatggctgggatgccgccggccggccggtgcgcgccgaagagggcggccatgtcaccgaatggcgccatgacgcgctgggccgggtggtggcagaggtccaggacgggctggaagtggcgatcagccatgccggcgccggcccgcgcagccgggtggtcaccccctggggcgccaccggtttcacctgggatccggccggccggctgaagggcctgaccgccggccccggggcgctcgccttcagcttcgatgcgctgggccgcgagacgctgcgccaggacccccagggcttcaccctggcccagagccacgacccggccggccggctgaccggccagcgcgtcaccggcggggcggatggccgggcggtggtcgaccggcgctggcgctgggacgtcgccggccagccggtcgcgatcagcgatgcccgctggcccgaacagcgcttcacctatgacggccgcggccagatcgcccgcgccctgcccggccggccccagggctcggcccaggtggaggccttcatctacgacgccgcccgcaacctggccggccgcggccgcgacctgcccgacggcgccgagaccacggcggcacggccccgtacccctgccgatacggccccccctgccggcctggaccgctggcggctgggccccggcggcgcgatcctggcccgcggccatacccgttatgcctacgacgcccgcggccgcctggtcacccggcgcaccgaccgcccgggcttccgcccggaaatctggcgctatgtctgggatgatcgcgaccggctgaccggcgtcacccgccccgacggcagccgctgggcctatggctatgacgcgctcgaccgccgcatcctgcgccgccgcgtcgatgcgggcggcagggtggcggagggcaaggcggcgggcagccccgacgccgtccgctatctctgggaaggcgaccggctggtggccgaactgccgctggatgccgccggccggcccgatgccgcaagggccacgctctggcattacgccccgggcgagatcgtgcccgtcgcccgccagcagggcgagcggctgtggtatgtgatcaccgaccagatcggcctcgcccgcgaactcgtcacccccgacggccgcctgggctgggccgccgcccacgacccctggggtgccatcaacgacaacgcccccccggaccccgacgccgccaccgactgccccctgcgcttccccggccagtggcacgaccccgaaaccggcctccactacaaccgccaccgctattacgaccccgaaaccgggcagtatctgtcgccggatccgatcggtctccatggcggcccccgcccccaggcctatgtcgaaagcccgaccgaactggcggatccgctggggctcgcctcctgtcccaccatgcttgcccgcggtcaggctgcgcttcagggagcgggccgcaacggcctgcgtccggccatgctggggctggagacgatcgcggacaacccgcagctgctcggccactggaacgacgcgctgcgctgggccgccggcagcacccggggcaacgcctataccaagctgctcgcctcgctggaagagggcgtgatgcctggcgtcaaggagtgggagaacgccttcggcaccgtgaaccagcaattcatgaaactcgcccgcgccgacggtttcgacattgcccaggtgcaccactggaacttccccaagggcgatttcgcaacccaggtccttgatccgcgccatctggttccgacagactcgcgtgccgtgcacgaagcgatccacgagttgaccacaggcgggtcgaaatggtctggtccggtcgatccgcgccatatcatcgacatccccgaatggtccacaccgatacagttctgacggagacggtgtccagatggacgactacacccgcctgatcgacgatctcggcctgcccggttggatgggcgaacttcgcgccggccgctggctcgccgaggatctcatgatcctggaaacgccgcctgactggtacacctgcccgccggccctcatcccgctgatctctcaagggtccgggccgaaatacaccggaatctggcaccgctggacggcatccggccacgcgctgcacatggtcgaagccgggccggaagaccatttcctgctgatcgagatggcactcacacccgagcagttcgcggcccgtctggccatgcatgcgatgtccgcagccgatggcgtcaccgccgacatccgcgccttcgccgcagccgcaggcatcgccgatctggatgcgctcgaccagcacacgatcaactacagcgaccagcccgacgatctcgtccacctgcccctcttcgacaccccccgccccgccaccgcctgcgccgaaggcctgtcgcgcgacggcatcacccccttcgccggcgacacgccatcgcccgaagaacccggcgccgcctggttcgagctctccggcgcccgccgcgccgccctggccgacgaccccgccgccgctccctggcagcgccgcaacgcgccggtcgaggccctgttcgccgatgcaatggcacagggcgaccacctgcgcgcctgggcgatcctgaacagcaccggctggaaactgcccgccgcccgcaaggccgccaccgatctggcggccgcagtggccgatccggtgatcgcggcacagctcagggcctgggtggatttctcgcaaaagtcgctcgatccggatcgagaggattattgagcggcaggccggatcgcgataccgccgccggacccgatcagggaccgcgctctcaagcgtgccgatgaactcccgacaactctgtcgtcagcaatgagggagccggaaaatgaccatcaagccacgatccgtctccgtatgggtcggcgatttcggctccgaagaggcgatgacccgatattttgaggaagacttcaccgaagacggtgatgccatcccatcaccctttcaggccaccttccatatcgattatgacccctacaaatttgaggccgatatattcaagggcacgtcagatatagcccgcgcgctcgatgacgcctcgtattcagaatattatgcagatgatgtcaagcgcagtctctccattattggcgaggcgaacacgatctgcatcatatttgattgcgatccgccacagaagaagaaggacgcgtatctcactcatatactttacaagagaatctgatggacgggatgttcatcacatctctcgggcgaaactccggagagggaccggccgtggtctgtaacggccgcccgggcctggcctgcccatgactgaagacgctccccattgcgaacgctgcgccatgccgatgatcccccatcacgatgcgaccacccgcgggctgatctgcccgacttgcggctggtcggtggtgtcgaccgcgctgcctgcggtactcaccgacgaccgcccctggcgcctcttcgccgcgggcttcccgaccaccgaccgggaccggctcaaggccctggcggaggtgcgcgggagcaatctggtcgaggcggcgaaactggtccgcgcgatgggcaccggccccgataccctggtcttcgagggccgggcgtcggagctggtgcagcgcatggcccggctgcgggcggccggtatcacggttgcgaccgaccccgggtttccacacgacacgcccgccgcccttgccgcggcgcggcgggtgcgggtggcgctgtgaggggcatgtgatggacggatatgatgcgcttctggccgctctggactgcccgacatggctgcgtcagcttcgccagggcgcatatctgaccggaactttgatgcgcctgtggcccggcttttcgacgactatctcagcgacggccgtcaggccgaagcctgggccacgctcaacagcaccggctggtctctgcccgacgcccgcgccgccgccgaacggctggcggccgccactgatcggcctttgctggcgcttcagctgagagcctggatcgcgttttcgcagcagacggatatgccggagcgttatggatactgacgggagagaccgcccatgaccgatgaacacggcatgcaggccgccatacgggagagcctggatttctttctcagcggccggattctgaacgggcagatatccaccgggctgaatcattatccaagacagaccggccgcctggacgtcgacgaatttatgaacaaacacgtctatccagagacaggcgaaacctgggacgacatggaagagacgatctttcatgaattggaaaagcaaatgaccaagattggcattgcacaagattttgataacatatatcaaaaatacaataatgataacagaaaaatcttcataaggaatcgtgtgaagaaaatattttcggaagattttctctttttcatcaacagaattgaagcgcatatcctgtacaatgccgcctcgtctctcgtaaagatgcacgaaccctatttcgccgacatcatgaccgtttacaagctcggcggcatgccctgcggcttcgagggggcgccgttcaggtcgagattgatcgtgtatgtgccgtcctgaatggccttcagatatcggccgccccgtgactgaccgaggtgcatcatggatctctacacccgcctgctcgccgatctcggcctgccccgctggatcggcgaggtccgcaatggccattggctggccgacgccatgggctgggaagcgcctgccgactggtacacctgcccgcccgccctggtgccgctgacatccgacggctccggcccgcgctatgtcgggatctgggtccgctggacggcggcgggccggttcctccatttcgtggaagcggagccggaggatcagtttctactcctggaatcggccctgacggtggagcagtttgccgcccgtctggcaatgcatgcgatgtcggcagcggatgatgtcactgacgacatccgagccttcgccgcagcagcgggcatcgttgatctggacgcactcgatcgtcacacgaccaattacagtgatcatccgcggaccctgatccacctgcccctcttcgacaccccccgccccgccaccgcctgcgccgaaggcctgtcgcgcgacggcatcacccccttcgccggcgacacgccatcgcccgaagaacccggcgccgcctggttcgagctctccggcgcccgccgcgccgccctggccgacgaccccgccgccgccccctggcagcgccgcaatgcgccggtcgaggcgctgttcgcggacgcgatcgcacagggcgaccacctgcgcgcctgggcgatcctgaacagcaccggctggaccctttttcccgcccgccgggcggccgccgatctggcggcggcggtggccgatccgctgatcgcccgccagctcagggcctggattgccttctcggagggtgagggggatgatgactattgaaccatatccgcgcgtcatatctcacccgggcgtcggggtcgctttccgcccatccggattcagacaaattcattgaagtcgtatgattgcggaccatatcctgaaggtccgatcaaggaggcagcccatgacagcgcttgcccgaaccgccgccggaagcgatcgccgggatctctccggtcccggcctcagggccttcttcaacattgccgcacagtggcgcctctccaacgagcagcagatgacgctgctgggcagccccagccgatccaccttctacaagtggcggaccgagggcgcgcgcaatcttccgaaggatacgctggagcggatttcctacatcctgggtatctacaaggccctgcagctgctgcttcccgaccccgaagcggccgacggctgggtggcgcgcccgaacgccgcggccccattcggcggccggtcggcgctggatcggatgctgtcgggccaggtggccgatcttcttgccgtccggcagtatctcgatgccgcgcggggcggctggagctgatggatcagccgccggctccggatctcctccctcgcagccatattgcctgggcaccctgctggcgcatcatccccagccgctttccgccgatttcactgttcgagcgggtcgccgcaccggaagatctcgatgcggtcctcgaactggaagccatgaccaacccccggctgagagacgaggtgggcgagatcagtctggttccccccggcgaacgggtcagcggcccgggatcgagcatcatcatggccgccttcacccacctcaaccccgaaggcagccgcttttccgacggcagcttcggggtgttctatgccgcagcggcgctggaaaccgccattgccgagaccgtctaccaccgcgaacgcttcatgcgggcaacggcggaaaaggccatggacctggatatgcgggtctatctggtcgatctgaagggtgagcttcacgacctgcgcggccggccggaggcgttcgccgccgcctgtcatccgacggattattccgcaggccagagccttgcccggaggctgcgcgcggccggtgcgggcggcatcgtctatcacagcgtccggcacgaggccgggctctgcgccgcggtcttccgcccgcacctgctgtcgaacggccggcaggagcgccatctctgctaccgatggaacggtcgccagatatccgacatctacgagaagtcgcggctgtcgatcgatgccggtccccggccgggcgatcgcggctgaccggatccgccccctcataactccgactgcctttccaagcgccccgcccggcccgcccgacggaacaggacgcccacggaacaggacgcccgcgcgccggttgacgtcccgccagagggccgcgtctcggcggccgaagcggcagagggcgaggaacagcatgcacgtcaccccgcgcgccaccatgcgcctgcaattcaatgccggcttcactttcgacgatgccgcggcgctggtcggctatatgcaccggctgggcatcagccatgtctatgcctcgccgatcctggccgcgcgcgccggctcgacccatggctatgacgtcatcgatccgacccggatttccgacgagatcggcggccgcgccgggctggagcggctggtggcggcgctgcgccggcacgagatggggctgatcctcgacatcgtgcccaaccatatggcggtcggcggcgacgagaacccgtggtgggccgacgtgctggcgaagggcgaggccagcccccatgcccgggtctttgatatcgactggcgccatccggatcctgagcgcgacggcaaggtccatgcaccgtttctgggggaggattacgaccggacgctggccgagggcgcgctgcggctggtgcgcgatgatgccggccggctgtgggtgacggcccatgaccggcggttcccgatccgcgacgaggatctgccggcgatcttcggcgagggcacgcccgatgcggccgaagccgaccggctggtggcacgctatcacgagcccgaaagcgggccccgcgccctgcaccggctgctcgaccgccagcattaccacctcgcctggtggcgcaccgcggccgacgaggtgaactggcggcggttcttcgacatcggcgagctggcgggcgtgcgcgtcgaagacccggaggtgttcgaggcgacccacggcctgatcttcgagctttatgccacagggctgatcgacgggctgcgcatcgaccatatcgacgggctggcagatcccggcggctattgccggcgcctgcgcgcccggctggaagacctgcgcgaccgccggccggcggcggcggccgaccatgcgccgctgatcctggtggaaaagatcctggccccgggcgagcgcctgcccgaagactggccggtggagggcaccaccggctatgacttcatggccgagctgggcgggctgctccacgacccttcgggccggatgccgctgcgcagcctgtggcgcgagatcacgggcgagcccgacgaccccgagatcgaagtgaaggccgcccgccgccagatcctggccacggctttcgaggccgatctggcccgcaccgtgcgcgccttcgcggcactcgcccgatcgcgccgccgcgaccgcgacctgaccaccgcggcgctccgccgggtgctgaccgaggtggtgatccaggtgccggtctaccggatctacgataccggcgacggccatgatgccgccgatgacgcaaccatcgcaggcgcgatcgaccgcgcccgggcccatgtggtgcccggcgaccgcccggcgctggagcggctggccgactggctgcatggcggccgggcgatcgagggcggcggtgtcgatgcctcggccgaggcgggccggaccgacgaggccgaccccgacatgctccgccgggcagccctgatccgctttcagcagctgaccgcaccgcttgccgccaaggccgtggaagacacggtcttctaccgccaggccccgcttctgtcgtgcaacgaggtgggctcggaacccggcgcgccgaccctgtcgccggcggcttttcaccaggcctgcatcgaccgccggcgccgccaccccatggggctgctcgccaccgccacccacgaccacaagcgcggccccgacaaccgcatgcgcctggccgtgctgtcggaaatggtcgaggactggagccggacggtgaaggcctggcggcggatgaacatgccatcgcaggtggcgccctcgcaggtgacattggacggccatatggcgccgcatccggccgacgagctgatgctctatcagacgctgatcggcgtctggccggccgggctcgacgccacccgcgccgcccgcaacacggcagccggcgagatcctgccccgggtggcgggctggtggcagaaagcactgcgcgaaggcaagcgccgctccaactgggtggaacccgataccggctacgaggccgcctgcctcgccttcctgcaggcgatcatgggcagcgacagcagctttcccgaggcgctggaccggctggtgcggcggatcacgccggccgccatggtcaatacgctcgcccagaccgtgctgcagctgacctgccccggcattcccgacatctatcgcggatcggaggtgctggacctgtcgctggtcgaccccgacaaccgccgcccggtggatcacgcgcgcctggcagggctgcttgcggccgaaaccgagcccgcggcggcgctcgaatcgccccgcgaccacgacgccgccaaacaggcggtgatcgcccgcatcctggcgctccgcgccggcgatcctgccctgtttctgaccggcgactacctgccgctgacggtgaccgggccggcggccgaccatctgctcgccttcgcccgggtcggcaccgcgacggaggggacccagccaccccatgccatcatcctggtctcgcgcctcgccgaccggctgatccccgaaggcggcgcgccgctgatcccggccgagggctgggccgacacgctgatcgagatcccgggcccgctcgccggccatcatcacgaggtgctgacgggtgaaagactggcgctccgcgagggcgggctcgcggtctcgggcctgctgacccggctgccggtggcggtgatgacgggggtttgacggcgccggacatcgatggcgcggctttacccacgcgtccgcccgaggaggcgcgccccgaaggcatccaccacccgcgcaaaggccgcttcggcgcctgccgacaggccggcatagcccgggaagttgtggatcatgtcgggcaggcgcagatggtcgaccggcacgccggccgccgccaggcggtccgccatggcgtcgccctggtccgagagcgggtcgaagccggcggtgaccagcacgatcgggcaagtgccggcgacctccggccagagcaggggcgaggcgcgggggtccagggcgtcctcggggccggtcagcagcagatcgcagaaccagtccatggtggcggtgtcgaggaaatagcctctgccgaaggcggccatcgacggatagctgacgtcttgtccggcattcgggcggaaatcggtcacgggatagagggccaggccggcaaccggctgcgggccttcgggccggtcgcgggcggtgagcgccgtgaccagggtcaggcagccgccggcgctgtcgcccgcaagcccgattgcggccggatcggcgccccaggccgccgcatcgccggccaccaggctgaagacgtcccaggcatcctcgaccgcggccgggaagggatgttccggcgccaggcgataatccggggtcaggaccagcgcgcccagccggtcggccagccggcgcgactggttgtcataggccgccggatcgccgaccacgaaaccgccgccgtggaaatagatcaccagcggcagtgccggggcatcgcccgcccgcgccggccggtagagccgggcatcgatcacccggtccggcagctccagcacatgttccgtcatggcgaccgacgcttcaggggcgcggatgccgcggatcagatagcgctcgcgataggcggcgcgcgcctcgggcaccggcagatcgcggatgctcggcccggcaggggcctcggcggcggccttcagcatcgccttcagggcagggtcgagggcgtcgtcggtcatgcggggaaactccggtcggaggggacatcacggctattgtgactttcatgatatcaaaatacaatatgctcagcaccccattcacgacggatcggcccccgatgtacgtgcccacccattaccgcaccgacgaccctgccgccattctgggctggctgacccgcttccccttcggcacgctggtgaccgcaggcgccgacggcctgccgctcgccacctcgctgccgttcatcacagaagaccacgccccccacgacatcaccggcctcaccatcgccgcccatatggccaggcgcaacccccatgcggcggcgctgtcgaccggcatgccggccctgctggtggtcaacggccccgatgcctatatctcacccgcctggtatgaaagcccggtcaacgtgccgacctgggattatgtcggcctgcagatccgcggccggctgacggtcatcgacgaccgcgacggcctgctcgacctgatgcaccgccagatcgccgccttcgaggcccgcagcgccaccggctggaccctcgatgcggcgccggagccccatgtcgaccggctgatccagggcgtcgtcggcctccgcatccaggtggagcggatcgactgcatgcagaagctcagccagaacaaacccaccgaccgcccgaccatccaggccgcattgcgcgcctccggcagcgattacgggccggtggtggcggggttgatggatctggttaagtgacggtcttttgattgcccaagagtcaatcgcatcaggtctcgtgcaggcacagcaaccgcttcgccgcaatccgcgtctcccccggatagccgaaggcgttgttcacatagcgcacgccgtcgatcacctggtcgcggttgacatggctgtgaccatagacatgggtgaccggccgccaggcgcgcagctgcgcctcaagtttgcgggtgccgagcacggggtagacgatgcgtttggccggcgggatgaagtccggcatcacgtcgatgcggggcaggaaatgcgagaccgtgatggtggcaaggtgcgctgccgccaccggggtcgggttgcgggccaggaaggcgtcggtgatcatggccggcgtcatgccctcgggccagcggcaggcgcggaaatcggtccaggccaggcgcagatcgcgcgagggctcgccgaacgagaagtcgtaccagccatagagcggcacgatccgcagcccggcgccgtgccagacctgctggacggcgccgctttcatgggcgatgcggcggacctcgtcgaatttcgcgaacgagtcctcatgggtgcggtcgcgcaccacccacagctcgtgattgccgggcagatagatcagcgtgcggaaccgcagggccagccgttccagcgtgcggcccaggcgctgcggcatgtcggagacgtcgccggccaggatcagcagatcgtcgacgtaatcggcggtcgacagaccggccacccactggtcgttctcgtcgtaatcgacatgcaggtccgagacggtaaagacgcgcatcaactccggtccgggttcggtctgggccatccgcccggcaccgtcggaaccgggttccgggagagccgccgatcatagaggcaaaccggtccggagggaaaccgcggccggcgtcacatggttggggcaggacttgcgcaccggtgaggcggggcttgcgcgccggtgaggcagggcttgcgcaggggcggcaggtgtgcgacagccggtcagcccctccccccggccggaaatgagacatccatggacgaccagacctcccagaccgacacgccacctccccggggcctgatcggcctgctgatcgcggcggtggtcaccgtcggctccaacgccttgctgctgagcccgatcctgctggatgttgcgcgcgatttcgccaccgacagcgtcaccatcgcccgggtgatctcggcctatggcgccgcaaccgcggtctcggcgctgtttctgtcgacggcggtggaccggttcggcgcgaagcgggtgctggtggcgaccaccgcggtgatggcgctcgcccttgccgccagcgccgccgccccggcctggccggtgctggccgccgcccagatgctggccggcatcaccgccggcatgctgctgccggcgatctatgccaccgccaccagcctgggcggggcggcacgcggcgcgcgggtgctgggccgggtgctgaacggctgggcgatttccctggtcgccggcgtgccggcctcggccgcgatcaccgatctcgccggctggcgggtcgcctatgtcgtgctggcggtgatcgccgccgccacctgcctgggttgccggcggctgccggcagggcctgcgcgcgacaccgccagcacgcctcaccgggtcgcctcgccgctcgccaccctccgccggccgggagtggcctctctgctggtggtctgcctcaccttcatgaccgccttttatggctgctatgccttcgtgggcgatgccttccgccgggcgctggatctggatgccggcaccgccggcctgttcgtgctggcctatggcgcgggcttcggcctcgccagcctggcggcaccgctgatcgaccggatcggcccggcacggctgctgccgcgggtgatggtggcgatcgccggggtctatctggtcctcacccccgcccttcagaccttccccaccgcactcgccgtggccgcggtctggggcatggtcaaccatctggggctgaacatgctggtgctgctgctgtcgcgccgggcggccggggccggcggcgcggtgatggggctgcattcggccgtgacctacacggcggtcttcctggggccgctgctgctgggtctggcctatgaaggcatcggcttcggcgcggttgcgggcgcggccgccgcggccgcactgatcggcgccgtggcggcctggcgcgatgcatcgcgctggtcaccctcccactagccgggccggtcttccatctgagagactatgggtgccccgactgcccgcaaggtcccgcccgatgtcgcagcccgccacccgcttccgccgccttgccacagccctgcccggcgtcgaggcggtgacggcggaaaccacccgccgcttcgcccgccacacccatgaccagttcggcatcggcgtgatcgtccgcggcgcccagggctcggccagcggccgcgggccggtggaggcggggccgggcgatgtgatcacggtcaacccgggcgaggtgcatgacggctggccgatcggcgatgccggccgcgcctggcgcatgctctatatcgacccgccggcgctggcagaggcggcggcggatctgctgcggtcgggcgatgccgaattccaccacccggccgccaccgccccggccaccgccgcgcgcttcctcgccgccttccacagcctgaccacacaggcgaccaccgccggacaggcgaccaccgccggccccctcgcccgcgaggagcgtctgaccgtgctgctcgccgatcttctgggcggcctgctggtgccggccggccgcccgaccatcccccccggcatcgcccgcgcccgcaccgccatcgacgacgaccccgccgccgcccatgatctggcggggctcgccgccctcgcggaaaccggccgcttccagctgatccgcagcttcacccgcgcgaccggcttcaccccccatgcctatgttctggaacgccgcgtccagctcgcccgccgcctgatcaccaccggcacgccgctcgccgaagcggccgccgccgcgggcttcgccgaccagagccacatgacccgccacatgacccgccggctgggtgcaacgccgggggtttgggcggggaaagaggtatgacggaacggcgtcagcgcgacccaggaggccagcggcgcgcggcatgcagcacgtgcaatatccgaaccgaatcaacgctcagctgatagaccaggatgtagttgcgatggaccatcagctcgcgtgtgccatggacacgaccaggccgtcccagagatggatagagcaccaactggagcgcctttgctcggaaaagctcgtccagcacaagtgcagctgccaaatcatcagcagcaatgtagcgacgaatttcctgtcggcttctgagtgcctggggcgtccagacaatttttcacgaagcggcgccgttcaacctgcgccggatttctgcccgccaaatctcggcatcagcttcaacatcatcactggatacgacattgcccgcatcagcctcggcgatggccgcctccacttcacgccgaaaccaccggtcataggctgcagcctcgacctggtctcgaacatagtcccgcatgaagtcacgcagaagttcggcgccggtacgatcactgcccttcgccgcttcggcaaacgcatccttcagtccttcatcgacctgaaaggtaaaggtggtctcggccatactgacccccggcattgctgagtcagcagattatggcacaccagaccctgcgggtgaacagccccgcaattccgttcaagacgcccccggccgggcgccgggccggattttcttgcctggccggtgcgatggtgcgggtcagccgcccctgattgcctcaggggaagcgggccggatggttcgacgggctcgcaagctcagtcctccgccgaatgcgatacccctgggacggggggccgcaccgcttgaaaatgtcggggcgaaagccgatccttcttgcatcggaggtacacatggccaacacacgacgacttgaagtcaatctcccggctgatgtcgctgccgcgatggacaaggaaatcgacacggggcggtatggctccgcggatgatttcctcgaagcgagcgcacgcgccctactggcgtgggatgaggatgtcgaacgctggctgcatgatgacgtgccccgggcctggcaagaatatctggacaaccctgatcgggccgtgtcctcggaaaatcttctcgacgtcatccacgccgactacctcgcccgcctgaaaggcggctgagtgtaccgccacgtctattccccgaatgcacgacgccagctgacgacgctttatggctacattgccgaagcgtcagggccagagcgcgcccgcggatacctgcaacgcatcgacgatttctgtgggctgctgacaaccttcccccggctggggcggaaccgtagcgacgtcatgccggggctacgggtcgcggttttcgagcggcgtgtcaccatcgcatatcgtcacgacgtcgatcgcctgacggtgatcgacatcctttatcgtggtcggaatgtcgaggcctattggcgccagccaccgccgaagtgatctccgcaattccgttcaagaccacccccgcccgccccgcgcatcctccggcgatcccgccactgttctggatgcgtgccgcccatgaccaccacctctgccaaaaccacctctgccaatggcaccccggccgggcgccgggtcgggtttgcctgtctggccggcgccatggtgctggtcgggaccacggtgatcgcctcgaagacgattgccgggggcggcggtcctggggggatggggccgttcaccgccacggcgctgcgctttgcgctcgcctttccggtgtttctgctgctgatgcgctggcaaagggtgcggctgccgcggccgggatggcgggatctggggctgctggtggtgcaggcgggggccggcagtgtcggctataccacgctgctgatttcggggctggccctgacctccgccgccgatgccggggtggtgatcgggaccctgccggtggtcaccggggcgatcgcggtgctggtgctgggcgaacggcccgggcggcggctgctggtggcgatcgcgcttgccgcggcgggcatgatggcggtggccggtggtggtgcggatgggcgtggcgcgggggacggtggcacgtcgtcgctggccggcaacctgctggtgctgggggcggtggtctgcgaaggggtgttcattctgctgaacaagcggctgcggacaccgatcgcgccgctcgcgctttcaaccgtgatgaccgggctgggcttctttgccgccgccctgccggcgctggtgctggaacggccctgggcggccgcgccggagacggcggcgctgctgggcgttctctggtacgcgctggtgccgacggtgatcggcttcgtgctctggtacgcgggcgccgcccgggtgagcggggcggaggcggcgcccttcacggcgctcgcccccgtctcggccgtggccctcgccgccctggtgctgggggaggcggtcagcctgccccagatcctgggtgtcgcctgcgtgctggcggcgctcgccgcccttcaacttccgaagcttcaacttccaaactgggcctcgtggaggcgccggtaaagcccgcccgcccccagcagttcgtcatgggcgccctgttcggcgatgccgccccggtcgaccaccaggatgcggtcggcgccgcgaatggtggcaaggcggtgggcgatgaccagggtggtgcggccgaccgagagttccgccagcgccttctggatctcgcgctcggtttcggtgtcgagcgccgaggtcgcctcgtcgaggatcaggatcgccggatccttcaggaacatgcgcgcgatggcgatgcgctgcttctgcccgcccgagagtttcacgccacgttcgccgaccaccgtgtccagcccctggggcaggctctcgatcagatccatcagccgggcgcggcgggcggcctcgatgatctcgggctcggtcgcgcccagccggccataggcgatgttctcgcggatcgtgccgccgaacaggaacatgtcctgctggacgatgccgatctggccgcgcagcgaggccagcgtcatgtcgcggatgtcgatgccgtcgaccgtgatcgcgccgccgtccacatcgtagaagcgcggcagcagcgaacagagcgtggtcttgccggcgcccgaggggccgacgatcgccaccgtctcgcccgcgccgatctcgaagctcacccgatcgagcaccggccggctgccataggagaacgagacctcgcggaagcggatattgcccgccagccgcggcgccggccgggcgcccggccggtcggcgatgtcgggctcggtggacagaagatcgagatagcgacggaagccggcgatgcctttgggatacagctcgatcaccgcattgatcttctcgatcggccgcacgaacacgccgaccagcagcaggaagccgacgaatccgccgtaagagagctgctcgttcagcaccagataggcgcccgcgatcagcaccaccagctgaatcagccggatgctcatatagttgagcgacatgctggcggccatgatcttgtaggcggcaagcttggtcgaccggtagcggtcgttgtcgcgggcgaagagccggcgctcgtgatcctcgttggcgaaggcctggaccacgcgcatgccgccgacattctcttcgatccggacgttgaaatccccgacccggccatagagcgcgtcccagttgccggccatgcgtttgccgtaatgggtcgcgacccacatgatcggcggcaccaccgccgcggtcagcagggccagatcgacattgacccacatcatcagcaggaaggcgccgatgaaggtcatgatcgcgatgaacagatcttccggcccgtgatgggcgatctcgccgatctcttccagatccttggtgacccggccgaccagatggccggtcttgttctcgtcatagaagcggaaggacagcttctgcagatggtcgaagctgcggcggcgcatctcggtctcgatgttcacgcccagcatatggccccaataggtgaccaccgccatcagcccggtgttgagcagatagacgatcagcaggccgacggcggcggcgatgatccagccccagtcgccgccgggcagcagctcgtcgacgtagaatttgaccgcgatcgggaagcccagctccagcaggccggccaggaccgcgcagccgaaatcgagcaggaacaggccgcgatagggggcgtaataggcgaagaactgtcgaagcatcggggggagggtcccaggcacgttgcggttggcggagtgacgcgggaagaggtggccgtgcgaagacggtgtcttcaggaccggcggtgtcttccgcgccccagcagccagaccagatacgggccgccgagtatggacgcgaacaggcccaccggcaattggtacgggaaggccgccatgcgcgcgagccagtcggcggcgaccatcagggcgatgccgatcaggacggcaccggccagctgggccagcggccgcctgagaccgagcaaccgggcggcatgaggggcgatcagcccgacgaagccgagcgggccgacatggagggcggcggccgcggtcagcagcgccgagagcagcaccaggatcccgcgggcacggccgaccctgagccctgcggcctgtgcgaccgcggagccgagcggcagcagggccagaacccggccggccagccctaagggcaggatcagcagcagggcggcacccgccgcgatccaggcatcgccgggggtgatggcggcggtggagccggccagccagcccagaagttcgaaggcacggaagccgccggtcgcgatcaccgccaccagcaccgcattggcgagcgccgcggtggcgaggccggcgagcagcagccgttcggcaccgaaacccgagcggccggcgatcgccaggatgaaggcgagcaccgcggcagaccccgccgcggtgccggcaagccgggcaccggtcgagggcaggtcgaggccgagcagcaccagggccagccccagccctgcccccgccccacccccagcacatcggggctggcgagcgggttggcggtgacccgctgcatgacagtgccggctgccgcgagcatggcgccggccgcggccgccaccatcacccgcggcaggcgccagggcagcaggtcggcgaagagcgtgccggtggcgagatggaggccctggggcccgcggccgagggtcaggccggcgaggaccagcaccagggcgagcagaaagagcccggccagtgccagacgcggccgggggtgatgcagatcccgcgcggtgcggtcgcgcatcggcgggcgctcgatcatccggagccggggcagcagccagagcagcagcggcccgccgagcaacgcggtcgcggcccccgtcggcaggccggcgatgccccgggcttcgagcagcatcaccgcgccatcggtcgcccagagcagcaccgcgccgatcaccgggctccagaccagctggccggcggggctgcgcgcgcccgccgcccttgcgagggccggggccgcgagccccacgaagccgatcacccccacctccgagaccaccgaagcggcaagccccgccgccaccgcgacggcggcgagccgcacccgggtgagcgacagccccaggctgcgcgcggcgccgtcatccagcgcgaacaaagtgagcgggcggacgagcaatgcgcctgcgatgatcgcgaggccgagccggagcgccagtcccatggccggcccccagctctgctgcgccagcgagccgccgccccagatgaacagcgacatcatatagcggccatcggcgaggatcgcggcggcggcgatggcgcctgcgatcagcgtgaccatcatgccggcgagcacgaccgacaccggctccagcccgcgccgccaggtcagcgccagcaccagggcgacggcggcaagcccgccggtcgcggcgatggcttcgcgcccggtcgcaagccagagcggcgcatggatcgtcgccagcaccagcgccagctgggcgcccgaggcgatgccgagggtggccggctccgccagcgggttgcgcagcacccgttgcagcagggcacccgaaaagccgagcgccgccccagccaggatcgagaccaggatccggggcgccacaccatccaggcggatgatcgcatccagcgccggatcggccgaaaagctgcggccgagggcgagcgccgaaagcagcgccgccaatgccgcaacccccaaccagaccagcgcgcccgggttgaacaggcgaagccgctcagccatggggcaccatggcggcggcgagcaggcgggcgaagcgcgcggcggtcggcagggcgccgaaagggttgaccgggtcgatgatcagcacgcggccctcgcgcaccgccggcagggcctgccagagcgccgcctgccccagccggcgcagcgtgtcgggcggcatcggcccgatcagcgcgatccaggcctcgggccgggcggccagcgcctcgatgccgaccggggcggtgccgctgtaacgggtctccgccccccaggcattggcgagccccatccgcgccgccacctcgcccggcagcgaatccggcccgaaggcgctgacatgggcggcatcgccgggggtgaccagaaagaccggccggccgccagaagctgcccgcgctgccgttcccgcggcggcaatcacggcatcggtatcggcgatcagggccgcggccgcatcgccccgcccgagccgggcgccgaggctgcgggccgccgccgcggccgcgccataaggcgccacgcccggccggtggatcgacatcgtctcgaccggtgcgatgcgggcgagattggggtcggcccaggcatggaaggcggaattcaggatcagatcgggcgcggccaggcgcagcagctcgaaattgatcgccccgcgcaggcccagatcggcgacaccccggggcaccggcggctcgaccacggtttcgcggaactggcggagttcggccgccgccaccggcaggatgccgagcgccagcacggtttcgagcagcgcccagtctatgaccgccagacgttcgggcgtggctgcccgcacccgcccgcctgcgcagacggcgagtgccgcagcggccgcgaccatcagcttgcgacgggagagatcagcggacataggcgaccggtgccccggtatcgggatgcgggaaagtgcccatgggcaggccatagatccggcccagcacatcgggcgtcaggatctccgccggccggccgcgggcggcgatgcggcccgccgccagcgccaggatctcgtcggcgaaacgcgccgccatgttcacatcgtgcagcaccatcaccacggtctggccgcgggcgcgggcctggtcgcggatcagccccagcatgccggcctgatgcgcgatgtcgagcgccgaggtcggctcgtcgagcagcagggccgcggtgtcctgggccagcatcatcgccagccagacccgctgacgctcgccacccgacagcgcatcgaccatgcggtcgcggaaacgctcgaccccggtcacccgcagcgccgccgccactttctcgccatcccgggcactgaaccgaccgagcgcgccgtgccaggcgaagcggcccaatgccaccagctccgccacggtcatgccctcggcggcgggggtgaattgcggcatataggcgaccagccgggcgaaacggcgcgcgtcatggtccccgaccggccggccctgcagccggatctgcccggccgccaccgcctgctgcccggccaacgcccggatcagcgtgctcttgcccgacccgttcggccccaccagcgcatagaccttgcccgccgccaggccgacactcagcccgtcgatgatcgcgcggccgtcgacggcgatggtcacgccgtcgaggtcataaagcgccggggggtggtggggctgatcggtcatctggtctccgtcaccagtcgagcgacagggtgagggttgctgtgcggccagcaccatagccgcattgatagacactgccgcagccgctgacatactccttgtccagcaggttgaccacatcgaccgacacgccccagcctgcccggcgatagcggatcgcggcgtcgagcaccgttgaatccggcaccttgagcgtgttggtctcgttggcccagctctcgccggtatagcggatgccggcgcccgcgctcagcccgtcgagcacggtggcctgaaaggcgtggtcgagccagagcgaggcgctggtatcggccaccagcaccggcgtcttgccgatcagcgccgtgttgctgtcttccgtgatctcgacatcctggaaggtcgcctggcccagcaggctgaagccgccgccgagtttcgtccgcgcctccagctcgatgccgcgcgagcggacttcgccgcgctggaccttgtaattgatgttgaccggatcggggaccagggcgttttccttggtcagttcgaagaccgaggcggtgaacaacccgtcgaattcgttggccatgtatttcacgcccgcctcgtattgcagccccttttcgggctcgaagggcgtgcccagccggtcggcgccgatctgcgggttgaacacggtcgcgacgctgacatagggcgtgacgccgttctcgaattcatagccgagacccgcacgaccgctgaacgcgccttcctccccccgataattataggcattgggtgtccaggggctgacataggcgtcatcggatttcgtccagacccggtcatagcggccggtcagggtcaggatccagttgccgtcgatgcgcatctggtcctgcagataggcgccgagctggtgcatgctcagctcctggtccagataggtgaaggcggccccctgaggcgcgccatagaccgggtcggtgacgctgatcggcgtgcccccgcccgacttctggacatggtcgatcatgtaatagcgatagtcgatgccacccaggatcttgtggtcgaccgatccggtggtgacccgccattcggcctggttgtcggcggcgaccgaattcaccgtggtctcgtgctcgaagccgatgcggaacagttcgttgccgggggccgtcggctcggtgccaccgccctcatagggggcgccgggtacacgccagccgtaaggataggggccgcgctcgcgggtatggacccggctgtagcggaaattctggcgcagggtcacgctgtccgacgcatcatgctccacctcccagccgatcatcgcctgctggcggcggtagaggtcgacatcctcttccccgtaatagaaatcgcgcgggatccgcccgaaggccgccggcaccaccgagccgacatagggccagaacccgccggtatgggtcagatcctgatcctgatacatgccgagcagggtgacccgggtgctgtcgcccttccaggtataggagggggcgatgacgccgcggaaatcctcggacttgtcagtctcccaatggccgcccgagaccttgccggtcaggcggtaggagctgttcgcatccagtgcatcgccgatgtcgaagcccagataggcattgccccagttgttgatgccggtctcgacatggcgcagccgctcccccgtcgggcgcttgctgaccagattgatcagcccgccgacattggcgccaccatagagcgccgaactcgcccccttcagcacgtcgatccgttccagcaggaaggtgtcgatcgaatagccgccgaaaccgtactggtagaggccgagcccgttcatgaatacgccggtctgtccggcatcgaagccgcggatcatcagccagtcggtatcgctgtcggtgccgaactgcccggccttcacgccggcggtatagcccagcacctcgtcgaccttgttgcccggcagatcgtcgagctggcggcggccgaccaccgagaccgattgcgggatctcggtgatcgcggcatcggtcttggagccggtggcgctgcggcgcggcacatagccgtcgatcggaccgttggcggtctggatgtcgtcttccacctgcaactgcggcagaaccacggcctcgtcggctctggccgccagcggcatgcccgccagcagggccagcagagcgacgctgcccttcaggctgcgattgaacgggatgcgcccgtcgaacgggatgcgccccaagcgggtcggagagatgcggtcggtgcccatgccttgatcctgtcgccctttgatcctgtcgccctggcctgccggcgtgatcagttgcgagtgtatatcactcgcagtcagggccgggcttgaccggatcgggacgggtttgaacgttttcgcgacgaatggcagcggcagggcataaaggtcgtcacgagacgagatcgcgccgccaggcggcgggggtggtaccggccacctgcttgaagacacgggtgaaatgggcctgatcggaaaagccggtgcgggccgccacctcggccagcgacaccgcccccgcctgcagcagatcctgtgcgcggcggatgcgggcctgcatctgccagtgatgcggcgccatgccggtggcggccttgaaggcctggcccagataggattgcgacagccccagcagatcggccagttcctgcaggcggatggcgcgcaggcaattggcctcgatgaaatcggtcacccggcgcagctggcggggggtcagctggctgcgcggccgggccgcccggcgctgctgcgccatcaggtcgatgaacagcgccgccgccagcccgtcgccatagagcgcgttcaacggatcggggcgctccacctcggtcgcgatcagccgggccagggccagcagccggtcatcggtgaagcccagccgcggccgcgccagcgcctccggatccaccgcctcgcccatgcgatcttccagcgtcgccacgtcgaaatgcagatccagatggcgcaggcggtgcgcgcccacaccccggccccagagccgcatgccggccggcacatagttcatcagccgtccggccagccgcgggcgggtggcgggcaggcccggccgcgggccgaccaggaaatcgcccgggccggtccgctccagcgccacgaacagacgggggtgttcgcccacataggtgccgcaggcatccggcaggcagtccacctcccagacatcggcgacgatgcccgaccagctgcggcagcgcagatcgccgatcacccggatcccctcgatccggctgtccattcgcgggacgaaaccgctgccggccatggcattgctccccggctgatgcagtgctgcacacatccgggcagtctagtgcggttgcaaatcagtcgcaagtgtgccgggcaagcgcgggcggcgtcatccctcggcgtcgaaacgcgggaacaggacgttgttttccagatggatgtgatccatcagctcggcgacgaaatggccgaggcccagatagagcgcggtccaggaacggcaggcgccgggcgggggcgtgaagccgccggtcatcgcctccagccggcggatctgctcgccgtgatcgtcgtgttcctcgcgcatgacacgcaccggctgtgcaaccatggccgaggcggagcggcgcatggcggggaagaggatcagctcctccttcttcatatgcatctccagcagcccggcggtttcccgcagcagatcggccaggccgaccggcagggcggggttgccggcatgcacccgctccaccttctgtgacagcaggatcagctcgggcaggtcgcggcggtgggcctcgtgatagcagaccaggatatggtcgatcagcgcgccggtttcgatcgccgcggccggcacctcgtcgggctccagcccggccagcccggcttcgatttcgtccagtgccgcctcgatctcgtccagcggcgccccgcgccgtgcggcggcttccgccagcggcacatcgccgccacagcagaaatccagccgatggcggcggaacaccgcggtggcacccggcaaagtggcggcaatctcgccgacggtgcggccgcggaaggcgatggcgggtgcgtgatcggtgagggacatcggatcatcctccggctgaacatctcgtgatccggagtatcccgccatgaagatggatatgaaatatatattatagccctgcgacgatccgccccgcccctcggcccgccctcagcccagctcgaaactggtgatgccgtaggtgcggtcgatcgcgatgtcgggggccgggccggtatacatgcgcgcggtttcgaagaccggggtcatgccgtgacggctggccagcgccagtgcttcgggcgtgaccgcgggcgtgtccaggaagaccggcgccccggccggcacggccgcggtcagcgcctggaacagcgcctcggccacggccggtcgctcggcgaagagcgggccgatcttgaagccggtgcggcaggggcggatgacgccatagccctgcaggcggccgtcttccacatagctgcgcagcaccgtgccgggctggttgatccaggccgagaggaaccccgcacgcggggcggcgaagaagcggcggtcccaggccggcagggccgcgcgctcggccgcgccgggggtgacgatcgccggatgcaccggccccgccaccgtcgcccggccttcatggcggatattgcgatgggcgagcacgaagcccgagcggcggtaattctcctgctgcgccaccaccccgtccagcccgaccagccggccctgaagccgggccatcagcgcctgccagatggccagcccatggccgcggccgcgcatgtctgggcggacgatgtagaagccgaggaaggcgaaatccgcgccatagcgcacgccggagatgacggcgaccggggcgccgtccagatggccgatcaggaagccttcggggtcttcggccgcgaaggcggcggcatcgtgcaggccgggattccagccctcggccgccgcccagtccagcgccagaccgatttcgtccggccgcatcggcctgatctccagcatcccgccgggggtctgcatgcctgtgccctccctctcgcattcgtcccgatggcagcttaggctgctcgtgacgctgatggtcacacgggatcggccagcggtaaatgacaggcgacctggcgcgcaccctgccccgccagctgcggcatccgttcccggcagatggcggcggcgcgggggcagcggccttcgaagcggcagcgctgcgggtcggggtcgatcgggcttgccggctcccccgccagccggcggcgcgggggcgggggtgcgccgggtgccgggatccgcgggatggcggcgatcagcccggcggtataggggtgggccggggcatcgaacacccgggccgtcggcccggtttcgatcaaccggcccagatacatcaccgccacccggtcggtgaccagccgcaccacattcaggtcgtggctgacgaacaggcaggcgaggcccagttcggcgcgcagatcgtgcagcagggtcaggatcaccgcctggatcgagacgtcgagcgccgaggtcggctcgtccaggatcagcagatcggggccgggcgcgatcgcccgggcgatgccgacccgggcgagctgcccgcccgacagctgatgcggcagccggtcgtgcaggctgcgcggcagatgcacccggtccagcgcccggcgtgccgcggtttcggccgcggcccctttcaacccgttcagccggcggagcggccgcatcacggcctggatcgcggtcagccgcgggtccaggctttcgcccgggtcctgaaacaccatctggatccgccgccgccagggggcatgggccgcgcgccgcgccggcagccgggccagatcctcgccgtcgaacaggatgcggccctgatcgggatcggccagccgggcgaccagcccggcgagcgtcgacttgccacagccgctttcccccaccagccccagcgcctcgccgcggccgagcgtgagggagacatcctccaccgcatgcagccagcccgccggccggccggccgcttccggcacgcggaagcggcggtgcaggccctgaagatccagcagcgccgtcatcgcaccagatccccgatccggctgtcgggccccggggtcgcgcggatcagcgcctttgtgtaggggtcggccggggcctggaacagctgcgcggtcggggcctgttccaccacccggccgcggcgcatcaccaggatgcgatgggcgcgttccgccgccaccgccagatcatgggtgatcaggatcgtggccatgccgcgcgcgtccgccagatcgccgatcaggtccaggatcaccgcctgggtggtgacgtcgagcccggtggtcggctcgtcggcgatcagcagccgcgggttgccggcaagggcaatcgcgatcatcacccgctggcacatgccgcccgaaagctcgtgcgggaaggcccgcgcccggcgcagcggatcggggatgccgaccgcggtcagcagatcctgcacccgggcggcacgggcggcgcgcgtcagccggcggccggcatgaacgccgaccacatcgccgatggcatcgcccacccggcgcagcggatccagcgcccggcgcgggttctggaacaccatcgagatcgcccggccgcgcagcggcgccacggccgcctcgccgcccgccagcaggtcgacatcgtcgaacaggacccggccacccaggatcgtggcggcgggcggcagcaggcccaggatcgacagcgccgtcaccgatttgcccgagccgctttcgcccaccagcgccagcgtctcccccgcgcccagatcgaaggagatgccgtcgagcgccggggcggcgcccttgaagccgaccttcaggccgtcgacccgcagcagcggcgcggtcatcggcgcctcgggtcgagcaggtcgcgcagcgcatcgcccgccaggttgaaggcgaagaccgcgagcatcagcgccaggccggggaaggtcgcgacccaccattgcccggtcatgatgaactgggcgccctcggccgccagaatgccccattccggcgccggcggccgcacgcccaggccgatgaaggagaggcccgcggcgttcaggatcgcccagcccagattgagcgacacctggatcgccagcaccggcagcagggccggcagcagcacctcgaccagcagccttgcctcgccatggccgcccagccgcgccgcctgcacccaggcggcatccttgagcccggcgatgccggcgcgggcgaagcggatatagaagggcaggttgatgatcgcggtcgcccagacgatgttggcgaccgtattgcccagcgccgcgaccagcgccatggcgaccacgaacagcgggaaggccatggcgacatcgaccagccgcccgatccagcgatcgagccggccgccgcgcagccccgaaacggcgccggtcagcgtgccggcgataccggacatggcaacggccgaaaaggcgatcgccagatcgagccgggtagcggcgatcacccggctgaagatgtcgcggcccagctggtcggtgccgaaccaatgatcggccgagggcggctccagcccgcgggtgacgtcggtggcgagcggatcataaggcaccagcgccgggccggcgatggcggcggccagcagcagcaccaccacccccagcgccagaaagcccggcggattggcgcgcatcagccggacgagcctggtgaggccgcccgcaacaccgcccgtcccgccagcgggcggcgggccgcccagatggcgttccgcggtcatccgatccgccccacccggggatcgatcagcccgtagagcagatcgatcgccaggttgaccagggtgaaggcgatggccaccagcagcacgaagccctgcaccggggcgtaatcggcattcatcagcgcatccagcgcataggagccgatgcccggccaggcgaagaccttttcgaccagcacattggcgcccagcatgtacgagaacaccatgccgagggtggtgaccaccggcaccgcggcattgcgcagcgcgcgggtcagcaccatgcgcccaggcaggccggcggcgcgggcggcggtgacgaaatcggccgagagcacctggatcatggcaccgcgggtgatgcgggccagcggcgccaccgcaaacgcggtcatcgtcaggcagggcagcaccatgcgccccagcaccgatcccagaacctccatgtcgcccgccagcagcgcatcgatgaccagcgatccggtcaccaccggcggcgggatcagcatcacatccatccgaccgaccggctccggcgcccagccgagttcggaatagaacacatggatcagcagcagcccgaccacgaacgtgggcagagaagtgccggcggcggcgatcgcccggcagagatggtcgatgaccgatcccggccgggtcgccgccagaacgcccagtggcagcgccaccaggatggcgagcagaaaggcggtgacggtcagctccagcgacgccggcagccgggcggccaggtcgtcgaccaccgcctcgccggtggtgtaggaccggcccagatcgccccgcagcacatcgcccgcatagatcgccagctgttcgggaatgctgcgatccagccccatcgacacccggatcgcctcgatctccgcctggcccatgccggggccggaagcgaggaaggcggccggatcggccggcagcaggcgcatcaccacgaaggtgaacaccaccgcccccgccagaaccggcagggtggcaaggcagcgccggccgatgaagccgaggatggcgggcaaggcgatactccgtcgggatggatcaaaagaggggatccgcgatgcggatccacctctttcccatagcctgccttacgccttgcggtccagcggccggaaatcgacctggccgtggatgtaataggtgaagtcggtcacccccggcttcagcgccgcatcgaaagacggcagccagagcggcatgatcggcagttcgcggaacacgatgcggatcgcctggcgcatcagctcgtcataggcgtccttgtcggtttcccagcgggccttttcgaccagggcgcccagttcctcgttcttgaaggcgccgaaattccagcgccagtcgccctggaagaagatccggaagaaatagtccggatcgttgaaccaggccgacgagccctcgacgtagaacggcaccttcttttcggtcagaagcgtgccccactgcgccgccggcaccttttcgatcaccaccttgatgccgatccggcccagctgttcctgcaccagcagcgcgatggggtcggcggtgatcgcatcggcgacattgtacgagaagctggtctcgaagccgccttcatgtcccgcctcggccagaagggcgcgggcgcggtccagatcggtggcgtaaggatagggctgcgggaaggacgaggtttcgggctggtccgaagccgcgccgtaaagcggcgtgccgcggccgaagatcgagccctggaacatggcgtcatagggcagcgcgaaggcgatcgcctggcgcacccggacatcgtcgaagggggcggtctgcgtgttgaaggcgacgaagcggaagctgttggtcaccggcagcgaaatcaggtcgaccttggggtcggcatcgatcgccgccacatccttgggcggcagctgcagcgccacatcggcatcacccttggtcaccgcggcgacgcgggccggtgcggccggcaccacctgcaccacggcgcggcgaatgcggggcagatcgccgctcttccagtcgtcgaagcggtcatagatcacctgctggccggcggtccagttggcgaccttataggcgccgccgccggcggcattgttgcgcagccattccttgccccagggatcttcggcggtggcattggccttgaccgcctcggcattgatcaccgaggcgaaggtcagcgccagattgggcatggtgtagcggtcggccttttcgaaccgcatccggaaggtatgggcatccaccacctcgaactgatcggccgaggtgatcgagccggtggagagctggcgcttggaggccggcaggttgatgccgcgttccagcgaccagcggacatcctcggccgtcaccggccggccgtcgtggaaggtggcatcgggccgcagatggaagaccagcacccggccgtcttccagcacctcccagctttcggccagctcgcccttgaacttcagatagtcatagcgatagagcccgggcgccacctcgatccggtcgaaattcaccagccggtcgtagatgttggtgaaggtgcccagcgccgcgcggttgacgccgtcgccatggggatcgcgcgaattcggcccgtcctcggccagcacgcgcagggtgatgtcgtcgccctcgcgcgcgaaggcccggccgatcggcagcgacacgccgcccaccgacaggaacagcccggccagaccgccggtcttcagaaaatcacgccgatccatcttatcgggcctcccttgtgtcgggtatctcgggtcgtcttccgtcgtcgtcagctatagccgtcgggcggcggatagcgcccgttcagggcgtaatcgccgacctccagcaccttgtacaccagcgggtcgtgcaaggtgtgggtccgggcatcccgccagaaccggtcgaaagcatggcggttatgggtcgcacgggcccccatggcgtcgtagatcttcgtcgccacgtcaaggctcaggcgggcagaaaatacttttaaggttgcgacgtcaatggccgcatcaccccgaagttggatatcgagcacagggcgcgccgccagcagccgctcgaccttttccgcagcacggtccgccagcgccagcgccgcctgcagcccggtccagatctcgccgaactggctgatcaccagcgggtcgtcggccgcgcgctccctgcccgatgccggccatgcccgggtgctctgccgcacatagtcgcgtccggcccggaaggcgccaaggccaaagcccagatacagattggcgaacatcagctggttgaccggcacccgcaccgccgcggcgaagtcgcggtcgccctcgcgccggtcgggcagcacctctgccgccgtgaccgggacgtcttccatggtgaaaccgctgctgtcggccccggccaggcccagcgcatcccaatcccgatcgcagctcaaccccggtgcatcggcgcgcagccaggcggtgacggtctcgccggtatcggtgcgccggccccagaccgacagccgctcggcaaaggcggccccggtgcagaagctcttgcggccattgacccggaagccgccatcggcggccggcgtgatgcggacatcgtcgtcgcgcggattggcgacccccgccgcccacagccggtcgcggccgatttcggccagccgtgccgcccggcgcgggccggcgccgatatcctggtggatcaggttcatcgaatgatagccgaacagcgtgccgatcgacccgtcgacggcggccagctcccgcgccaccgccaccaccaccggccagggcgcgccgccgccgccgaactcttccggcagcaccatggtggcgagcccgctccgcttcagcagcgcgatctgcgccagcggcggggttcgcgcccgatggcgctcggccacgtcccgcgccagctccgccgccacctcgtctgcaagcgcttcccatgccatccggtcacgcggccccgtcattcgcccctcccctgcccggccctaccttgcccggccccgccctgcccggccctaccctgcccggtacgcacggccgccgccggatgcccggcccccagccgcggcccccggccgaacagcttctcgcgcagcgtgccctcggcatagccggtcttatagagccggcgggcctgcaattccggcaccagcaggtcggctgcatcgatgaaactgcccggcgccacggtgcggaccagattgaaaccgtcgatgccgctctccgccacccgccggccgatctcttcggcaacctcgccagccgatccgatcagcggccggaaccggccgcccagcgccaggccggccagcagccggcgcacggtcggcggcccctctcccgcgctgccaagcccggccaggatggagcggatggcattgccgccgccgggcgggatggggatcggcgcatccgggtccaggctgccgaaatcgatgccggtcgccgccgacagctgggccagcgccgcctcgggcacggcatgggcggcataatcgtgatatttctcaaccgcctcggcccgcctgcggccgatcaccgtctgcagcgacccgaagatcttcaccgcggaccggtcgcgcccggcggccgccagccggtcttcgatccgctgcacgatggcgcgggtgccggggccgccatcggcggggatgaagatgcattcggcatgggcggcggcgaaatccagcccgcgcgccgaagccccggcctggaacagcaccggcgtgcgctggggcgagggctcggccagatggatggcgtccaggcggaaataggggccgtcatggcgcaccgcccgcaccttcgccgggtcggcatagcgccgggcggcgcggtcgcggatcaccgcatcgtcgtcccagctcgcctcccacagcttgtaggcgacctgcatgaaatcatcggcgcggtcatagcggtcatcatgcggcagcgtgccggcggcaccggtggcgcgcgccgcactgtccagaaagccggtgacgatgttccaggccagccgcccgtcgctcagatgatccagcgtcgacatccgccgcgcgaacagatgcggcggctcggccgagacgtcggcggtgatgccgaagcccagatgccgggtgacggcagccatggccggcaccagcaccgccggatcattcaccggcagctgtaccgcccgttcgatcgcggtggccgccccgccgccatgaacgtcgtaaaccccggtgacatcggccagaaacagcccgtcgaacagcccccgctccaggatccgcgccagctccatccaatagccgatgcgccgatagccggtcgcccgatcttcgggatggctccacaccccatgggccagatggccgaccgcattcatctcgaaagcattcagcaggacatgcggcggcgccaagaccgatcctccggaggggcgggatatcgtcctgtgagattattttgtcaaaatgattcgcgcaacgggagatgatctcgcggctgaagatcatggccggcgggcgggcggccgggggcggccacaccagcggccggcacggtgtcccatcgccgggatcccgaacccggcggcctcgatccgccgcaacaggtcgcggccccgaaagggggcgacaaatcttgatccggttggcgccggagccgtgggggtttcaatccacgcacccgcaagggtgcgaccccggcttcagggggccgatgaccgaggcacagcgcgtttcaatccacgcacccgcaagggtgcgacccagtcgcgcccacccgcacgccgaccgcggcgacggtttcaatccacgcacccgcaagggtgcgacccccaccccctcttaatatcctgaatccggctccggaaaaaggcgatccgcgcgaacctcgtctggacgtcatacccgggaatgaacatgcatatattgtgtaatttaatccattgaaatcctgataatatttttcccgcgaacctcccgggttttttacgggagcttgaggttcgcgggcgcggcggtgcaggtccgcgatcgccccggatggccatggcgaccggccagccggcggactacaaaaccagaggatggcggatacaagcgtcaacccggctggccgggccggccgccgggggcggcccgtgcggcgatcagctggtcgatgttctcaaggaaggtgtgcagcaccggcgagggattgtccgcccgatagccggccgcgatcccgatcaccggcgggttgccggcaagcggccggctgaccagcgatcgcggcagcaggggctccacataggccggcagcagggtgacgccgccggtggaggccaccagcgaaatgccggtggcgatgccgtccagcagatgcctgggccggaccaccaccccgcgatcacgcagatagcgggtcacgatgtcgcgcagtacatggggcgtgccggtatagccgatgaacgaggccgggtcgatgtcgcggacatcgatcgccggccgggccgccagcggatggtcgcgcggcaggatcaccaggatcggctcgtgcgcgatgaccttgtaggtgacgtcgggctgcggctccacccggcagacgccgagatcgatctcgccgcgctggatggcggccccgatctcgggcgagaagtcgctcatcacccggaaatcgatgtccttcagctgcccgcgcagcagatggctgacatgggacagccactccacctcctgcccggtcaggaagccgaccgcgaaaccgggcttgggcgggcgtgccgcgcgccgtgccgccgccaccgcatccgccgccgattgcagggcccgccgggcatgctcaagaaaggcctgtccggcgggggtcagctccacgccgcgggcgctgcggatgaagagcgtggcgccgacctcctgctccagatcccgcaactggcgactcaaggacggctgggcggtgtgcaggcgccgttcggcggccaccgtcaggctgccctcttcggccacggccacgaaatagcggaggtgacgcagttccatgtcatcccatgcctatgaagtatggctggtacatataacaggtcgttctccaccagcaaagtcgcgggtatgaaaagggagacggagaccccatacacctgcctgtcgggcatgacccgacatccggaggcataacatgaccacgacccgggccacgcccaccatctcgatcgtcaccggcggcagccgcggccttggccgcaacaccgccctcagcatcgcccgccgcggcggcgacgtcatcctcacctatcgcagccagcttgccgaagccgaggccgtgctggccgagatccgcgcgctggggcgccgggcggcaacggttcagctggacaccgccgacatcgccggcttccccggtttcgtcgaccggatccgcaccatcctggccgactggggtcgcgaccgggtcgatcatctggtcaacaatgccggccatggcgagatggtcgctttcgccgaaaccaccgaggcgcagttcgaccggatcttcgacgtccatgtgaagggcgtcttcttcctgacccaggccctgctgcctctgatcgccgatggcggcaggatcgtgaatttctcgtccggcctgacgcgggtctcctttccgggcttcgccgcctattcggcggccaagggcgcggtggaaatcctgaccgtctatctggcgaaggaactgggccatcgcggcatcaccgccaacaccatcgcccccggcgccatcgagaccgacttcctgggcggtgcggtgcgcgacaccccggcctataacgaggccttcgccgggatgaccgcgctcggccgcgtgggtgtgcccgacgatatcggcccggcggtggcgagcctgctcggccccgacaaccgctgggtcaatgcccagcgcatcgaagtttcgggcggtcagaccatctgatcagccctcgccgatcacggccacccggtggatcgccgccaccacgcggccgtatacccagggcggcaggtcatggcccagcccctcgatttcgagcagaatggcccccgggatcgccgccgcggtgtcgtggccggccgcgggcgggatcagcgggtcgtcggtgctgtgaacgaccaggctgggcgcggtgatcccggcaagccggctgcggcggtcgccggcggcgatcatcgcggccagctgacgcgcggtgccgccgggggcgcggccgcggcgaagctcgtccagcatcagggcgcgatgggtggccggatcgaaaggctgccccgtgccggcgatgcggcgggcgaaggccaggccatgggccaggaagccctcgggatcgatggcgggatccggcgccgggccgagcagcaggcccagaacatccggcgccggtccggcgacggtcggattgccggtgcccgacatgatcgaggtgagcgagcgcacccgatgcccgtattcgctcgccaggatctgcgcgatcatgccgcccatcgaccggccgacgacatgcgcccgcccgatacccaacgcatccagcagccccacggcatcattcgccatatcctcaagggtatagggcagatccggccgctgcccggccccgagcgcccggatcagcgcgcccatgtccggcggcgggtagtggtcgagatgggaggaacagccggtatcgcggttgtcgaagcggatcacccgccagccgcgcgccgccagcgcccggcagaacggcaccgtccagcggatcatctgcgtgcccagcccggcgatcagcaggatcgccggatggtccggatcgccgaagctctcccaggcgatatcgaccgcgccgatccgcgcgatcgcttccacccgtgtctcgtgatgaccggccatgatcctgctccgccgtgacgcatgtcctgcaccggcggatgtctagccgggggcggctgtgctgtcaatattacccgggtaaaattctgtgacgcccgacccccgtatcaaaccgccgggcgaagatcacctcacctcccgtcttggctcgcggcccgaaaccatggatgatcgtcagtcgagggatgtcgcccgaccgctggtcgcaagatgagaacgtccccagggaggatttcgaacaatgtttcaccgattgcggcagatctgcctggtggcgcaggatctggatccggtggtggcggagctttgcgacgtcttcgatgttgcggtctgccacagggatcccgaggtcgggatgttcgggctgcacaacgcgctgatgccggtcggccacggcttcatcgaggtggtggcgccgctggcaccgggcaaggcagcggcggccgagcggcatctggagcggcgcggcggcgatggcggctatatggtcatcaccgataccgacgacctgacgcgctgggaaccgcatctggcggcgacgggcgtgcgcatcgcagcaccgctggaaatgggcgcttatcgcggcttgcagctgcatccgcgcgacaccggcggcgcgctgctggagatcaacaccacccgcggcaatacgggccccgacggtaccgcgatcgacgacccctatggcccggccgggcccgactggcgggcgcatctgcggaccggcaccgtcaccggcatcaccggcgcccggttgcagaccgccgatcccgaacggctgggccggcgctgggcggagattctgcgccgcgacctcagatccgacagcgatgggcccgacagcgatgggcccgacagcgatggacccggcggcggtagcttcgtcctcgacctcgacaatgcccggatccgcttcgagcccgaccgcgacggccgcggcgaggggctgggcggggtggatctggcggtggtcgatgccgacggcctgcgccggcgggccgccgcgcgcggcctgccggtcgcgggcgatcatgtcgtgatcggcggcctgcgcttccatatcgggggctgaggccccctcccccttctctgttcctctgctcccccggaaagtccgaccatggatctgaactataccgccgagcaggacatgctccgtgacagcgtgacgcgcgtgatgcgcgacgccggttccttcgccgatcgtcagaaacgggtcgccctggcctggcaggcaggcgccggtgccgccgaggcccgcgccgcccaggcagggcccttctggcagcgtttcgccgaactgggctggctggcggtgccctttgccgaggccgatggcggcatcggcggcggtgcagtcgatttcggcatcgtgatggaagggatcggccgggcgctggcgatcgagcccttgctgcccaccgtgctggcggcacggctggtggcggcaacgggcgatccggcgcagaaatccgcctggctcgccccggtgctcgacggccgacggcgcctggccttcgccttcgccgagcgccaggcccgctatgacctgaccgattgcgccaccaccgcccggcaggcggatggcgactgggttctggacgggcgcaaggcggtggtgatcggcggccatgccgccgacggcttcgtggtggtcgcccgcaccgccggagcgcgcaccgatgcggacgggttgtcgctgttcctggtggcagccgatgcgccgggcgtggaggtgatcgcttatcgcaccaacgacgccacgggcgcggccgatctggtgctgaccggggcggtccttcccgcagatgccctgctgggcacggcgggtgccgccgccggcccgatcgaggccacggtcgatttcgccatcgcggcggtcgcggccgaggcggtgggtgcgatgacggcgctctgcgagcagacgctcgactacctcaagacccgtaaacagttcggccggccgctgggcgacaaccaggttctgcagcaccgcatggtcgacatggtgatcgcgaccgaagaggcgcgctcggccgcccttcacggcgcgctgatggcggaagatcccgacccggcggcccggtcgcgggcgctgtcgctgaccaagatcgaaatcggccgcacggcaacgaaggtgggccaggaggcggtgcagctgcacggcgccatgggggtcaccgcggaactggcgatcggccattatttcaagcgcctgacagcgatcgccgccagtttcggcgatgccgactggcatatccggcgcatcgcccgcatcgacgccgccgcccgatctgccgcctgacccggcccgccgcccgaaccggagacgccccatggacatcaagctttcgcccgaagatcaggccttcgccgacgaggtgcgccgcttcatccgcgacaatctgccggcggatatcgccgacaaggtgcgccgcgacatccatctcgccaaagacgattacatgcgctggcagcagattctgggccgcaagggctggcatgtgatgacctggcccgaggcccatggcgggccgggctggaccatcacccggcgctatctgttcgaggtgatctcggccgagatggactgcccgctgatccagcccttcgggccgcgcatggccgggccggtgatcttcaccttcggcaatgacgaccagcgcgcccgcttcctgcccggcatccgcgacagcacggtgtggtggtgccagggctattccgaaccccaatcgggatcggatctcgcctcgctggcgacgcgggccgaggatcggggcgaccattatctcgtcaacggccagaagatctggaccacctatgcccattacgccgactggatgttctgcctggtccgcacctcgaaggaagaccggccgcagaagggcatttcctttctgctgatcgacatgaccacccccggcatcacggtgcagccgatcccgatgctggagggcacccattccttcaacaccgtgttcttcgaagacgtgaaggtgccgaaagagaacctgatcggcgtcgagggcaagggctggacctatgccaaattcctgctggagcatgagcgggtcgacaatgccgcgatcggcgtcaccaaggcggcgctgcgccgggtgaaagagatcgccgccgccgagcccggcgagggcggccggccgctgatcgaagacccgctgttccacgcccggctgaccgcggtggaagcacagctgatgtcgctggaactggcggcgctgcgcacgctgtcggccgtggcgtccggcggctcacccggccccgcctcgtcgctgctcaagatccgcggcaccgagattgcccagcggatcagcgagctgggctcggaagcggtcggctggtatgccctgccctggcagccggaggtgctcgacggcagctccaacgaggaaccgatcgggccggcgcatgcggggccggccgccaatgcctatctgtggcggcgctgcatgtcgatctatggcggcagcaacgagatccagcgcaacatcatcgccaagcagatgctcgggctctgacggcaccggaggcgcaggcgggtggtcccatcaagcgagacccgacctcaggccaggcccgacctcaggccaggcccgacctcaggccagactcttcgggtccaccttgccttccttcagcagcagctccagcgccgcgaccgcgcgttcgaaggtgcgggtcttggtccattcccgctcggcggcgatctggtcgagcagggccgccgtgcgggcattgacgcgcaggctgaccgccaccgtcggcggcccgggcgggcggccgcgcgggcgcggggcatagtcgtcggcgacggtgcgcggatcggtcggacgcagatcggtcgggcgcggatcggagacatcccgcggatcgcggctgcggaagccggattgttcggccaggggccgcaccagttcgcgggtcagacgcggatcgtcggcatggcgccggccgggacggaaatcgctcagatcgcccagcggatcggagaccgcatcctcggcggcctcggccccgaacaggctcggacgcttgcgctcgctcatgccccctgccctcctgcaacggccgccgcctgcgcctcggcctcgttttcacgcaacagctggatgaccgcggcggcataggcgcgggcattctcgatcgccttgtcgacgccggccacctccttgcggtccagcgcttccagagtgccgccataggcgaggaaggcgtcgaaggcgccccgttcgatcagctccaccggcaggatcttcacccccgccgcctccagatcctcgacgatggcgcgcagcgcccgcgagcggatcgcggcgctggtgcgggtcaacagcacgctgtgcgggatgcgccgacggaaggccttttcctggcgtttcaccagctggatcgcccgcaccgcctgcttcccgtccagctgcttggcctgcaaggggatcagcacgagatccgcccggccgatcgcataggcgaccacggtcgaggccgtgccttccagatcgaccagcacgaaggcatgggtctcggccgcggcatcgatggtctcgacgatgttgtgctcgccgatatcgcccagcacggtcaggttgtcgggcttgcccggcagggccgcccagtcggtgatcgggtggttcggatcggcatcgatcaccgccactttggtgcgcgccgcaagctccgtgcccaggaccagcgccgaggtggtcttgcccgccccgcccttcggattcgcgaatgcgatgatcgccatgggaaactcccctccggcccgccggggccgcctgttccagccgcaaaagatccgctgcaaaagaccggccggcgccagcccggccgatcccgttgccgcatcatagcgcgccgggcggctggaacaagcgggaaccagcttccgcaagatgtttcctgattgatctggttttttctggctgaaaatagaagcgtatgggttctatctgttttcccgcacatgtcgaacgcgcaggatcacgaccatgccgacgacgacctcgtagcggacttcccaccatctgacaatgatacgccgcacgtcacgctgaccgaagccggcaaggcgtgctccgatgtgcgaaaactggccgagacgttccgtcgcttcaatcatcgccaatgcgatggcttgcgctgcggtcggattccggacgacaagaagctccgacagcctctcaagatcacttgctgctcgtgctgtccagagaatgtccgccatgcggccgccgatatgatatcagtcgcggccacgcgggcgaggcaggggaatggccgcctccgtgcccaggcggcgtgcccactccttcatctcgtcatggggcaccagctcaccggcgtcgacctctgcaagagcctccagagtctcctgatatgcctgctcttccgatgagatcaggatttcaatggcctcctccagcacatcgtcgcgcgaccttccctgacgtccggccaggacatcaagacgggccaccagatcggccggcagatctgccgtgactgtgcgcatgggcatcgctgagcctccgtgaacgcggcactgcgcgttgatcatagcgccgccgatgcccccggtcgacagactcagaccgacgccataccgcagatcgcaaaaggatcgatcgcatcgaaatcggccgcgaccggcacgcccaagtcgtcgggcgtgatcgggctgccgggggcgcggctgcggtccaggcggatgaccgccatgccggcgctgcgggcggcggcgatttcgcccgggtggtcggacaggaacaggatctcacgcgggggccggcccagtgctgctgcgatcctcgtataggagccggcctccaccttcagcccggtggtggtgtcgaaattatgcgagaacaaggggttgaggtcgcccgcctcggtatggccgaacagcagcagctgggctgcgaccgagcccgaggaatagaccgcgagcgtaacccccgccgcatgccagcggcccagcgccgccgcgacctcgggatagagatgggcgcgcagcgtgccgtcggcatagccgtcggcccagatcagcccctgcagggttttgagcggggtgatcttggcgtcggcatcgatccaggcgatcagccggtcggccagggcgtcgatctccccgtccctgcccgcctcgacgcgcccgccggtgggcgccggcagagcgccgccttcggcgcggatgcgggcgcggacgtcgtcgagggcggccgcgacctcgggcagatgggcgttagcgtgcaggaaatcacgcagccgcgcgcgggcgaagggaaacagcacctcggacacgaaggcgatgtcggtggtggtgccctcgatatcggtcaggaccaccggtccgccatgcgaaccggtttcaggctggccggctgcggtccgatcactcgccatgacgcgggaagccctctgcgatcgggctgccggtgaagcgtgccacccagccttccgggttggtgaacaggcggatcgcggcgaaacgcggcgcggggcccatgtcgaaccagtgcggcgtgccggcgggcaccgaaatcaggtcgtcgcggcagcagagcgtgcggaacacccggccgcccagatgcaggtagaaggtcccctcgccttcgacgaagaagcgcacctcgtcttcggcatgggtgtgctcgtccagaaacttgcggcgcagcaccgggtggtcggggttgtcgggggtgagacggatgacgtcggcggtgacatagccgccctcggccttcagccgtgcaatctctggcgcataggcgcccaggatctcggccgcatcgctttcgatgccgagggcatggcgcgcgtcccacctttcgaaacgcacgccgacctcggccagcagacgcgcgatcgccgccgcatcatcggtatcggcgatcacctgtgcgggatcggtttcggcatgaacgaccagacggctcatccggcaatcctccgcagttcaagagacagggaaaacagggcgtcgaaggcatcgagatggcgttcagcatcggccggcgtcgcaccccaggcatagatgccgtggccggcgagcagatagccgggcgccgccacctgccccccgggccggggtgtagccagatgcgccgatacccgcccggcgagcgcaaccgtgtcctgatcattggggaagaccggcacggtcacggtcacgtcatgagtggtgatgccggcgaaggccttctgcagctcccaccccgccagcgccagcacgccatcgcctgcgcgcagatgcgagatcagcatcgaggccgggctgtggacatggaagatggcgccgatcgccggatcgtcgcgatagagcgcctggtgcagcggcgtctcggccgaggtgccggccggcgcggggccgtcgatcgcgacctcggccagatccgctggcacgagccggcccttgtcgcggcccgaccgggtgaccagcatccggcctccgtccagccgcaccgagaaattgcccgaggtcgcaggcacccaaccgcgcgcagccgccgcgcggcccgcctggatcacggccgccgccgcctcgtcaaaacccatcccgcccatggcgtgttattgtctccggcaatggtcactcacacccggccggcctcttccgggccgggcggacgcgacaccatcctagacaaggggggtgaagttcaaaacgaaaaatcgctgttcatcgatcttattacacagttagaatatgttattcgccctctacccttcccttcccgccccgcacgccgcggcgccacacctcgcttgcgcgcggaagacggggattgttgacgaggatggttgatggtcgggaccgataatccgtaccgggcatcaacccgctgcatgaccccggttatcgaccttgatgccgtgttttcgcagccatgcccgatgcctcgcggggccttttacagccgatgagagcggccgtccagagcgggacccggccaggttggggaccgtcagatgtgggacgaacagatcggggcccatcagagcaggcactggccggccgcggcggtacccggcccggtcttgatcattcatgattgcgcaagatggatctggcgagaaatggcccgatgacgcggcctcacgacggcggagagcgacggcaccgcggatcccggccactttccgccgcacccggcgtccaacggaacaggacgggaccaaccgccgcatcgccgctctctcgccggatctggcctgcgccggccccccttcggccagacagggccggacgggcccccccttccaaggcactctgcgggtgccaaccaccggcggggccattcggccggggtggcggccgtcagtcacgcttgccagttccagattgcgcaatatagatctggctggaaacggggtggtgcggcaagccccggcgccccctggcctcagccgtatcatggccagatccaggcggtgcaagaccgttccgggcaccaacgcccgcgcctgccgcaccataggggtgccgatgacgggtcggcacagagagcttccgccatcctcgccaattccagattgcgcaggatagatctggcaggaaatagcatggtccagccagcccgacgcctgccgtgccaggctggtgggccggtgggctgatcgggcgcggcgggatccgccatgctccggccgatacctgcccgcgcagagctgtcatggctgagcagggccgtacccaacgcggcctgcaggtgccgtagacgagccgggccttcaggtctgcgcggaagaccgcgacgatccccacccatgcccgaggaggggcggagcccggcgtccacatccaggcagcgaggcgccaggcttaccgtgttcgccggacgagtgggcgcggctggggcgccgaggtcgcggaggtcgcaactatcaccggaaatcttgattgcgccagaaagatctggctggaaacagcctcatacagccacccaccatccgcgccctggggaccactgcggatgcccggaccccatggccaacgaaaggagggagggggcggggcggcagtcatatcccgccggatcgccgcctgagcctggtggcggcgcccggtcccgcgcccccgtccgcgccggctgccggtctgttcatcctgtcgggtcggagagcaggggcggcgaggggaggggtctgtctgccagttcctgattgcgcaagatggatctggcaggaaatagccttatgagggcacgcgctttcggccgtcggaggtgacgcgcagatgggggagggggctggatcggtgatcgtcccttatctccttgtatttctttgcaattctggcgagaaaatagcggaacggacgacgacgaccggcgcggccgaagcaagaggcaagcctctgccatttcttgcaggaacatgattgcgccagatatttctggcaggaaatagcagcttaaagcgttcatccagggcaggggtggaccgcagtcaggggcggagcggccggctgcggcgctcgccagatcaagattgcgcaatgttaatctggctggatcaggccttcttctaccatgtgggcgtgccgtgagagaccggcactgccacactggccgggcaggcgggcggccgggcaggccagacggtgacactgggcccgggcaggcaccagcctgaacgagattgcgccagctttttccagattgatcctgccgtaattccggcgcccggcctgccggtcgatccatccggatcctggcgcatcccgcctgatcccgcctgatcccgccggatcccgacagatccggcgggatgcggcaggtaggagatggttgttgcctgcgtcagctctttcctgattgcgcaatatttttctggcaggaaatggacgctgcggcggcgaaagcggcgtgccggggccaactcgccggcggcaccggctgccgagacgtggtagtctggccgcggacacaccaccgccagcagatgggggcggccacccccggccgcccggagacgcatgaagcgaccgaccaaacggacggatacccagatcgacctgttcgtcgcactgccgggcaccatcccgacttacgaccagcaggacacgatggagctgcccttcttctcgctggccaagccgacgccgacctcgcgccggtcttcgatcgactaccgggcgacggacggcaataccgagatccatatcaacgtcaccgcgcccgagagcatcggcgtcgccacgatctgggatgccgacatcctgatctgggccgccagccagctgcgcgcggcgctggaccggggcgagccgacctctccgaccatccgggtctcgctgtacgaattgctgcgcggcatcggccggccgaccggcggcgacgaataccgccgcatcctgaaggcgctggaacggctgaacgccaccttcatccgcaccaatgtccgcagcggccgccgccgcgaccccaagggcttccactggctggagagctattcggccccgctggacgaaaacggccgctcgctcggcatcgaattcaccatcgcggactggctgtacaagggcatcgtgaccgaccggctggtgctgagcatcgaccggtcgtatttccagctgtcgggcggcatcgaacgctggctttatcgcctgatccggcgctattccaccgccaacacccagggctatgtgctgccgctgcgcttcctgcacgagaccagcggcacaacccagcgctatgccgatttcgcgaaggaactgcgccgcaccatcgcccgccagcgcctgcccggctattggctggatctgcgcacgcaggaaggcgtgggcgaggtgctgtacttcgtggcgcgcgaacacctggccccggtcctgccggcgccagaggtggaggcgaacggccgcaagcgccgcaaggcaccggcaccggcgcccgaaaccgccaccgacgcgctgatggaaacaacggtggaaatcctgcaaccgccggccaggtcccggcgcaaggccgccgcatccgcagatcacgccgccaacgccgcggcgggcgaggggcccaagccccgaacccgacgcaagaccacagccgcaccggccgatacgccgcccgcaggggccgaaaccccgacagaccggccgctgaccgccgatctgctcgaccaggcggttcaggccgcggcaaaacccgcccgcaagccgcgcagcacaggccgcaagaccgccggtgccggggcaaccgccccgaaaaaacccgccgcaacgcgcaaaccgcgcgcaaccaccaccgcgaagggggcgaaaccccgatagggtaggggacgcgccgaccggcgccataacggcagggatgacggcgtaagcccttgatcatcaagacaagatggcgcgggcgcgagccggccgccgctgcggccagggcgccgatacgccatggcgggacgacacaacccgacaggcccgcccgacacgacaccccggcagcacggcacgcctgcggatagcacaaccggcacaaccctttgaaccataggcagcttccgggcaccacctctgcgccggggggcgaaaccccgatagagcggcgccggccgccacgccccctgcgcgcagggcagaacgaggatacgccccccatacgcagtcgccggcggccggaattgtggtcgccaggggccgaaaccccgatagcacgcgcgtcggaaccggctttcggggggccgaaaccccgagagtcagggccaggggagggcggttcacgggggccgaaaccccggcaattccgccagttcggggggtaaaaccccgtgtcatggccgggcgagggccacagccacgcccccggggccgtgtcggcagccgatccgccggccgggcatcgggcagacgaaacctctctgttgccgcattttttttgccaggggccgaaaccccgactccgacagcaccggcccgcagccaccagccacgccccggaaaaccggtatcccacaagccgattcggggtttcggcccccaagcgtcccagagacgccagaccgacccaccacggcccggaccgcgggagtccggcaggaatccacggctcccgcaggggacagcgcggcgcggctctcatacctctgccatcagaggccgaacacacccgcagcagggcgtttcaaatgcagcgaagactccgggggccgaaaccccgattcccctgggggccgaaaccccgatgattatttgcagaaaccatgtattgggggcttgacagacgcgggaaggcgtccggactcggcttgactccaggctttggggtgcgtttctcttgtttctgaccggagttgggccggttttctcatgcaggccgtgagtcgttctgctccgaccgcagatcacgaatgcaggccacgaacagggagatgcgccgatcatgaccccgaaatgagatagtcccgtttacgaagccgctttgggcgacaccgcaaacgggaccgacctcgactgacagactggcattcgccgccctatcagcaccgtgacaagtctgattctaggcgtaagtgctactgttttcaagcgccgacaaggcgttgacggtcttcctttgcttgtcgtccggatgtgacaccgcggatcaccagatccggccgggagtgttttgtcgtgtccgacatctttgaaccgacccgcctcggctggctgcaaagcgtgcagcgcagccgggagacggatgtttatggcctggcgctggccgccagtctgagcgtgctggccggcagcgaccatgtcgtgcgcgccagcctgcgcgaactggccgaaaccgcccgcatcagccccaaaaccgccggcgaccgcctgcaacgcctggccgaagacggtctgctgaccctggtcgacaccggcgccaccggcggccatcagccgcggcgcttctatcggctcgccatggccggcgttgttccaggcagccgggggcatgatgcccgggaggcggcggccatccccgcggccatggcgacgccgaagcccacggcattggcggcagacccggcgccgatcgtcgatccgatgatccggctggtcagccgcatccagcagacggccgcggccccgggctggaaacgggtgaaggcggccgccgcggtggccgccgccgtcgaggccgccggcctcgatgcggtggaagacttcgccgaccgtctgggggccggcccgaaacgcccggcctatgacatcgccgtcgccctgtcgcagctggccgccaccgcaccgaccactgcaccggcagccaccggcgatgccggccaacgcgacgacgacgcgcggcacgagaccggggccgcccccgaggagagacgattcgaggatgggcgatccgaagacagacgatccggggatgggcagaccccgccccctgcaccgccgctgcccgccgcctatcgggccgaagccgaaagcctggtggtcctggccgggctcgacccggcgcgccggcgcacgctggacgcgctggtgaccgcaagcggccgcccggccccctgctggggcctgcgcgacatgaccgtcaccgccatcggccgggccctggccgaggccgatcacggccatatcgtcatccccccatccgtcgcggatctccgccacgacctgcgccccagacccgcctgccagaccaccctggcgcccataggactcaccaggaacaggactcttccttcaagaccatatccggactcggattcggagccggggttgatgagaatggcaggacggcttgccggcacgtccggtggcgagatggtcggacagcgggtcacggggtgaggcggatgatgtggcccggcagggtgatcgaggtgatggtgccgtgaaggacagcctgcttggtgcatcggcctcgggcgccggggatgatttccaccaccgctgggtggcccgggaagtgctgcagctgctggaccccgacagtccggttgccggtatcaccgtcgagggtctgcccggggatgcggttcaccaaggccttggagagcatggccaggcggtggacgttaccttgaggctgagcgacggcagctttcgctatctccagctcaaatactcggcaagtcatccggaacaggcctggagctgggcgcggctgctgacgcccaaaaacccccgcaagcccgaaagcagcgttctgggcaagcttgccgggctgacgacggccggcgaactgcaggggtgcttctccatcgtcaccaaccagccgcttgccggggaggtcgcgcgcgaagtcgaggcattgcggggcgaggggccggtcgaggcggcggtcgaagcacgcgggcaagagctttgcgaaaaactgacgctggatgccgaccagctgcgccgctttctcagggcctgggatctggcgggcttcggcgaggtttcacgcctgcgcttgcagacggaggttatcgcccggcttgcgacgagcatcgatggcgatgcgcggtccgatgccgattatttccggcagaagatcatggagctgatgctgcccgagggacggcaagagccggagatcacgcgggaaacggtgctgagctggctggggatcgggaccgaggcggatctgtttccggcaccgtcacggatcatcccgccggaacacctgatcacgcgccgggtggcgcgtacgctggtggagaaactgaccgcaccggctgaacggcccttgcggatccatgccgatggcggctgcggcaagaccagtctggtgaccgcgcttggggggttgctacccccaggatcggaggtcttcgtctatgattgttatggcggcgggctgttcctggcgagcgatgccggtcgccaccggccggagcaggccttcatccagatcggcaacgagatggcggcgcggctgcgcacgcccttcgtcatccggcgccagacgatcagcgccgagccgttcagggtttttcatcgccgggtgacggcggcatcccggatcctggcggaccgggatccggcggcgcggctggtgctggtcttcgatgcggtcgacaatgcccgcaaggcggcggagcattggagggacgactgctttctcgatccccttcaggcggcaagcggctggcccgacaatgtccgcatcgtggtgacctgccggaccgcccggctggacgaggtggggccggcctggcgctatgaagactttctgatcgagcccttcgatgaggccgagacccgcagcttcgtggcgctacggcaaccggcatggccggtggctgtcgccgaccggctgttcgacctgaccggcggcaatccgcggcgcctggcctatgcggtggacggcctcaaggaggatggggcagggcaggcggtcgagcgtctgctgccgcgggaaccggggctggatccgctgttccggaagcggatcagggaagcggggatccggtttgccgacgagcggctggtgtggcgggtgctgggcgcgctcgcccgtttgccccggccggtgccgggcgagatcctggcggcggtcaccggcctgacggccccggatattcaggacatcgccaccgataccggcggtctgacccatcatccgggcggctggtcgttcaccgacgaggatttcgaacatgtcgtcgggatcgaaacggccgccgacggaccggcgctgctttctgccgccgcagatctgatccaggcccgggccgggcaggatgcctgggccgcccgggcgctgggtcaggtgctggtcggcgcggatcgcctcgatgcgctctatgatctggtcaggggagatccggcctttccggacgacatgtcggaggggaccaaggcctatgtgaagacgcagcgccttgccctcgccatccgggcctgccgtgcgcgcgacgatatcgatcaggcgaccctgctgctgatcgcgcaggcagaagggctgcatcggcagaggctgctgaacgagctgatcctgggcaatctggatctggcgtgtcggtttgagcgggaaacggcggagcggctggttctgtctgatccgacgcaccgggaacatcgtgcgcgacttgatgtcgaactggcggcagccctggcggagaccgacaagatcgcagcacgccgccatgaattgtggtgggagatctatctcagataccaccgggacaggctcgacggtcgtgacgtcaacgacgagatgcttgcggccgagtaccggttcaaccgcgacatatcgggtcaggaaatggccttgcgccgcctgaggcgctggcgcccgctcacagctctgacgggggtgttccgcatcctcgccgaacaggatgccgggtggcgaccgcaggtcctgctggaggtcatggacgggaaacgctggccaccggtcattctggccccgctgatgacggctgcgctgcttgcggggatcggcttcgacgatccgatcctccgtgcgaccttgcggcggctggccggggcgagccgtgcccgctggtcgtcccaatccggcaacagaccccgcaaccaaccgctcctcgccacggatgaggccgtcctgttcctgtgcgaacgggcggtgatcgatcctggcctccacgacacggtgcggaccattatcgataaggcgtttccgcggccggatgtcgacgacgaggaagcgctttctggagtccgggcgaaggccgtgcactatgcccggatgtttgctctgcgcgaagtgctcgacggcagcccggtagatatcgaaacctggctcattcccgagaaggagatgccaacgtcgcaccctgctggccaacgacagcaccatcacgatgatgagccaagccgggagcagttcttgagcgaccatcgtaacagggcattgatttctctgatcaggccttggggtggcgcgcgtgcaacgatgtcgttttttacccgggaggcggataccgatgctgcgtgggcgactttcacttcggcgatgcacgccgaacacccaaatgaaatgacgcttcatcgggacgccgtctgcctgctccttcgcgcccatatactgcatcaatgtctgggtggcacggacgttacaaccctcttcgagggcatgtggaggctgctgaagagttggcaggtctcgctgaccgacgtccagatcgatctcgtccggtcgctgaccctgacacctcagggccatgacgcggcggcggccctgctctcgatcctggaaacatcgctgccgggggcgttcggttcggcgaaacacctgtcggacgcgcaggctgactgcgcccgggccgccctgcctattgatcccgatctggcacagcatttcttcgctgaagcgatcagaagtactgaaaaggtcgatatcgaggcggcggcggagctggccgccgcctcggcggtcagccgggcggggctgggcgggacgcgggcggaccgcctgaggcttgcgcagcggctgggggatgccgccggggccacggccgtggcgctcgcctgggacggctttccctgggcggatgtcatcaccggcatcgctgcggcggatctcggggtcggcctggccgctgccgcccgctggcacgatctcggggaggtggcgtatgagaccaccatcccggctctgctgaccagccgggcgggcgaggccctgggcctgacccgccgatatgcgctcgcctgtctggcgggtgatgactgcccgactcttgcccggatcgccggcggaaccccggtgcccgagagcatcatcgcccgcgagctgcacgacgctctgatctccggagaccccgcgcaggcaatggcgaccttcgagcagatcggcggcctgccgggcgcggccgcgagcccgtcccggctggcggcccaggactggtacgagcagatgcaatcctggaatttgtcgggggcgagtggggcggcctccacgccttcagatccgcccgcagacccgccgctgacgacagccgaggcggtgagggcggccctggcagaaccgatgatcgactatgtccggcttgccgcgcgggtcggcgggcgccatctccgggtgggttttctggaggccgccgtggccagtgccgcgccgcgcggagatctgtggatcgtattgccccggatcatcaagaggtggcgggattatgcaccggtcgccaactgggcgcgcgagaacctgatcccccatctgccggacgcgctgcccactcttctcgcatggaccggtcagaacccgcgcggcatcgaaaacctgctgcaggcgacgggcctgccgccggaggcgcaggccgaggggcttctggacgcgatcgcccgcaatgccgaccatctctcggccgacagcctgttcacgctgatcggcgttctggccgcccgggtccgccccgaaacccgcaacagcctggccggcgatctgatcacgcgcatcgccgggcgcgtggggcgtgagccgcgggtcgttctcttcggccaggaggtgccggaagatccgaccctctgccttgcccgcctgatctttgccgccatgggcgacatggacggccgggtgcgctggcgtgcggcccatgcggcgctgatcctgatcgaggatggcgacccggtggtggcgcccttgattgcgcagctggcagtggaggcggaaccggtcttctcaagccgggatttctacgtctatgccgcccgcgaacagctgttatggaccctctggcgcggggcgcaaacggcgcccgcggtgatcgccccccatgcgccggagatcctggcgcatctgcgcggcaccagccatctgatggcgcgcgaggcggggcggcggttgctgcttggcctggctgagcgcggccatatcggtctgggcgatgcggatcggctgtggctcgatggtctgaatcggagggcgttgccgcgcagcccggggaaggggggtgcggcgggcggccggcttcacgacgggaagacgcgcgcgttcagcttcgacatcaccgacaccataccctattggtacagaggccccgcggccttcttcggtctggagatggacgcgtttctggaccgggtggaggcctggattgacggccggtggggatatggtggagccggtcatcacggacgggaggcgcggacgaagcgtctcaacagcgcgtctttgggagcctcgtcacacagccagggcgtgcgaccgcttttggcgccgctctccagatatctggaatggcacggcatgatgtgtgccctgggcgagttgatcgggacccggccgctcgttgcagacacaggcatgtatggggacttcgacgactggtgcgacggccatctgccgacgatcgggccgttctggctcagcgatctgcgcaccccgccgcccatggagccgcgtttctggggcgtgttgccggacggtgacgtggctgcgaatcgtgtctctgggaacgacatgtggccgcactcagtccatgacgccgtgttgacccgggaactctgcgcggccgatggggggcgtgtcgtcgcgggggatttcacactgcgctggcaggtacatcagcagcgtgtcagcattcgctcggctctggttgcgcatgaccgggcggctgatgtcgcgcacctcatgcttcaggcagacagccacatggatttcatcgtgcctggcgtcggagatcatccgggtaagccgttcagcgagcgcttcacaggctggctccggtacgacgactccgatgtccgtggggatgaacatgacgaggcccgcggcgatatctccggcatagctgccgcgccctgccatccggccctcccgctggttcacgacccccgcgccgcggccttcgtggatagcggggggcggccgttgatgtggcttgcgcagtggtcttccgccggccggtcgggcagctcgggctggcgcctgacggccgggaccgaggcgctggaccggctggtgcagaccagcgggatgaccctgctgacctgtgtcgaaatcaggcggacgtattcaggcgacgaccgtcgtacagagccgccgccgacatattgggccgtctggcttcacgaagccgatggcgggctgcgatatgtcggccagtcctgcacccgccgatccccttgacccaccgcccccaccccggcacaacggatcgggcacagacaccagacagcgagggccggttcctgacgacgggagagaggggcggcaggcagggggagggccggcggcgcatccgcagcctgggcctccaggccctggggcttgccggggttgcggtggcggccctggtgacggcgctggtgcatggccatgtcacccgcagcaatctgcacgatctgcgcgagcggagcctgaacacgttgcggctgaccgaggccaccttgcgcgggcagctgctgcgtttcgaccggctgccggggctgctggccgatgagcggacgatccgggcgctgctgctgaggccaggggatcccgggctggccgatcaggccaaccggtatctgaaggacaccgccacccggctgggggcatcggatctctatctgatgacccgcgacggcgagaccatcgctgccagcaattacgaccagccgcaatccttcgtcggcggcaatttcgccttccgcccctatttccgcgatgcgctgacgcagggcgagggccggttcttcgcgctgggcaccacctccaacaagcgcggctattatgtcggcgcgccggtggtggtctacgaccgggcggcagggctgcgggcgctgggcgtgctggtcatcaaggtcgatctggacgatatcgaacgcgcctgggccggcaatgatccgcggatcatcgtcaccgaccccgaaggcatcgtgttcatgtccaaccggcccgactggctctatcgcggtctcggccgacgcagcgccgaggacatggcccggtcgcgcgccacccggcgctatgccgaccaggaggtgggcgagattccggtgatcgcccggcgccatctggagctgggcagtctggaaggggggcgcgacgccggggcggatctgatctgggttgccactgaaggtggtggagaaaacgaatatctcgcggttaagacgcagatgccggatgccgactggacggtgatggtgttgagcgccaccgcggccgcgcggctggatgcgctggtctttgcgatcgccgccctgctggccatgggggtcacgggcaccggcggcatgctggtctggcagcgccgccgtcagctggccgagcggctggcggtgcagcaggcgacgcaggccgaactggagaggcgggtgaccgcgcgcaccgccgaactcgctcgcaccaaccgtgcgctggaagaggaggtcgaggaacgcatcgccgccgaggcccggctgcgcgagacccagagcgagctgatccaggccggcaaactggcggcgctgggccagatgtcggcggcgctcagccatgagttcaaccagccactgtcggccgcgcgcaattatgccgaaaatgccggcctgttcctggcacgcggcgagttggccgaggtggaggccaatctgggccgcattcaggagatgatcgaccgcaccacccggatcagccgccatctgcgcgatttcgcccgcaagcccgatcaggcgctgcgcccggtggcgctggcgccgaccatcgccgcggtgcaggaactgctgggctggcggctgcgccaggccggcgccgaattgatcgtggacctggacgatccggatctggcagtgaccgcgggggcggtgcggctgcaacaggtgctggtcaacctgctgaccaatgcgctggacgcgaccgccgatgccgccgatcgccggctgcatcttcaggcccggcgcgtggccgggggccgtgtcgagctgcggctgcgcgatcacgggccgggcgtgccggtgcagctgcgcgcgcggatcttcgacccgttcttttcgaccaaagaggtcggcaaggggctggggctcggcctgtcgatctcctacaacatcgtcagcgatttcgatggcgtgctggaggtgcaggatcatccgggcggcggcgccgaattcgtggtccgcctgcacgaggccgatcgggaaggggagggaacatgaccgcaggccgcgtgctggtggtggacgacgatgccgatctgctgggctcggtgctgcagtcgatgaagctcgccgggcttgccgcccagggcttcggtggcgggctggaggcgctggagcatatttcgggcgggttcgacggtgttgtcgtcaccgacatccgcatgccggatctggacgggatgagcctgatgacccggatccgcgagatcgaccccgacattccggtcatcctggtcaccggccatggcgatgtgccgctggcggtgcgggcgatgcgcgaaggcgcgcacgacttcatcgagaaaccgttttccggcgcgcatctggccagccttgccgcccgggcgctggatttccggcagctggtgctggacaaccgccgcctgcgggcggtggccgggcaggccgacgatctggaaacccggctggtcggccggtcggcggcgatgatcgatctgcgccggcggatccgcaccatcggccccaccgatgccgatgtgctgatcgagggcccgaccggtgccggcaaggatctggtggcacgcaccctgcacgacctgtcgccgcgccgcgaccggcccttcgtcgccatcgcctgttcggccctgccggccacgatgatcgaatcggagctgttcggccatgatccgggcgcctttccgggggcgatccgcgcacgcatgggccggttcgaacatgcccgcggcggcaccatcctgctcgacgatatcggggcgatgccgatcgatcttcaggcccgtttgctcagggtgatcgaagagcggatgatgacgccgatgggcagcaacagcccgatcccgctggatgtgcgcttcatggccaccagccgcacgccgctcgaccacgaggtggaagccgggcgcttccggccggatctgctctaccggctgaatgtcgtcagcctgcgcgtgccggcgctcgccgaacggcccgaagacgtgcccgctttgttcgaccggctgctggccgaggctcatgcccgccaccgcctgcccgaccggccggcctctccggatcttctggccgaaatggcgcggcgcgactggccgggcaatgtccgcgagctgcgcaatgccgccgagcgggtggcgctgggcctggccgatccggccgcggcgccggccggcggggagggcggggcggcaccgacgctcgccgatctgatggccgagcatgaacgccggatcctgatcgatgcgctgatccgccatcgcggcgtgctgaagccggtctacgagacgctcggcctgtcgtgcaagacgctctacgacaagctggtccgccacggcatcgacaagacccggttcgtgggcagcgacgagggcatgtaaccccggctacacaccgcccggcggatctgggtagatttctacccatctctggaaaaatcctgagatttcatgaagctggagatgtccgggcggttgtccgcgcccggccgttcccgcaacagttcttcccgaaagcacaaacacgatacgggaggaaagcagatgcgtttcaccggatttgccgccatggccgcggccgccctgattgccggcaccgcccttgtggcgccggccgcggccgaggatcgcaaggactggccgtctgagatcaccatcggcaccgccagccagggcggtacctatttcgtctatggcaacgggcttgccgccttcatcggcgaggcgctgaaggtcaatgcctcgggcgaggtgaccggtggcccggtccagaacgccaccctggtccagaccggcgagcacgccatcgggctgatgaccatgggcccggcgcgcgaggcctggacgggcaagagcgaactggcgccggggcttgagcacagcgagctgcgcgccctgttcccgatgtacatgacccccttccagggcatcgccatgaccggatcgggcgtcggcagcgtcaccgaactcgggggcaagcgggtcgccgtcggccccgccggcggcacgcccggcacctattggccgcgcttcctggagacgctgggggtcaaggccgacgtgtcctatgccggcgcatccgatgcggcggggcagttgaaggacgggctgatcgacggcttcgtctttgcggccggcgtgccgatttcggccttcagccagctggcggccgaggcggatgtgaagatgttcggcttcaccgatgccgaattggcccgcctccttgaggcccatcccgaggtgagcgcgctgaccatccccgccggcacctatccgggccacgattatccgcagaacaccgtggcgatgtggaacttcgcggtcgtgcatgccgacatgcccgacagcctggcctacgagatcgtgaagctggtgatggagaacaacgaccggatgcgccagatccacgcctcggccgccgacaccgtgctggagaatgtcgacaagaacggcttcctgcccttccacccgggggcggtgcgctattacgaggaaaagggtctcgtcatccgcgacgggctgaagggctgatcccgaagccggccgcaccccgagcggcccggatgcttatgcctccgggtcccggggtgccggccggcgcgtttcttgggggataagaagggggaaagcccgatgtcgtcatccgcaccgatggcgcccggcggcgctgccgacagcatcgccgacggggtcgatgccgaggtgattgccggcaatcagcgcgtgttcaccggccgtatgggcctgatcatcgccgcggcctgcattctctataccggcatgcacatctattcgatgaatgtgcagccgatcgaaacctgggtctatcgcctgctgcatgtgtcgggcgggctgatgctgggcttcctgctgttcgcatcccggccgctgcgcgacgatgcgccggcagggcagagttaccggctgaccgaaaagctgctgctggcggcggcggccgcgggcattctggtggcagccggccagctggcggccatgttcctggccgatgaccgggtcgtgaccggggcgctggcgacgaaacatctctataccttcggttatccgctgatcgccggcacggcgcttgccctgctcgcatcctggatggcaccggcgcgcggacgggggcggctcggggccgccgataccctgctggccctggcggcggtggtggtcggcggctacatcatcggccatgccgatttcctgcgcatccgtgcccaggtcttcccccatgtcaacgacatgtgggcggcggtggccggcatcctgctgatcctggaactgacacgccgcctggccgggatggcgctggtggtgatcgtgggcctgttcctggcctatggcttcgtcggcccctggctgccgggggtgctgaaccatcgcggctatgcgcccgggcggttcttcgccttcatctacaccgacaacggcattctgggcccgaccacggcgatctcgtcgacctatatcatcctgttcatcgcctttgcggccttcctgcaggcgagccgggtgggcgagtatttcgtgaacttcgccttcgccgccgccggtgccatgcgcggcgggccggccaaggtggcggtcttcgcctcggggctgatgggcatgatcaacggcacctcggcgggcaatgtggtctccaccggatcgctgaccattccgttgatgaagaaggtgggctaccgcccgcagaccgcggcgtcggtggaggcggcggccagttccggcggccagatcatgccgccgatcatgggcgccggcgccttcatcatggccgagatcaccggcatcccctataccgagatcgtgatcgccgccgccatcccggcgctgctctatttcctgtcggtctatttcatggtcgacaaagaggcgctgcgcaacggcatgcagggcctgccgcgcgaccagctgccgcgcttttcggccctggcccgccgggccttcctgttcctgccgatcgtcatcctggtggtggcgctgttcctgggctattcggtgatccgcgccggcaccgtcgccatggcggcggcggccgtggtcagctggttcaccccccatcgcatgctgctgcgcgaggtgctttatgcgctggaactgacggcgcggatgtcgctgcagctggtggcggtctgtgccgcggccggcgtgatcgtcggcgtgatcgcgctcaccggcatcggcacccgcttctcgtcgatgctgctggggctggcgggggaaagccagttcgtcgcactggtcttcgccatgctggtctcgatcatcctgggcatgggcatgccgaccacggcggcctatgcggtggcggcggcggtgatcgcgcccgggctgatccgcatgggcatcgagccgctgaccgcgcatttcttcatcttctactatgcggtcatgtcggcgatcaccccgccggtggcgctcgcctcttatgccggggcggcgatcgcgcagtccgacccgatgaagacctcggtcgaaagcttcaagatcggccttgccgccttcatcgtgccgttcatcttcttctacaacgcgccgatgctgatgcagggcagctggttcgaggtggcgcatgtcttcgtcaccgccaccatcggcatctatctgctggcctcgggcgtgcagggctggctgttcggccggctgggctggccgctgcgcatcatcgccatggcggccgccctggccatgatctcgggcggctgggtttctgatgccatcggcttcgccgccggcgcggccatcttcctggtccagcgcgcccgccccgccgcggtaacacccgcccgccgcaccggctgagccgcctgcacgggggttgagacgagacggaggcttgagacgataccgcccgcagccgggggtccggctgcgggcggtccgtcggtccggcggttcagaaccggaacatcagaaccggaacaccccatagcccttgcgttccagcggcgcatttgccgccgccgacagcgcgatgccgagcgcgttgcgggtgtcgacggggtcgagcatgccgtcatcccagatttccgaggtcgaataccaggacgaggtctggatctcgtagtcgcggcgggtgtcggcgatcaccgcttccagcagctccggatcggccgcggcgccgttgcgggccagctgacgggccttgacctcggccagggtccggccggcctgctcgccgcccatcaccccgatctggtggccgggccacgagaacaggaagcgggcgtcataggcgcggccgcacatgccgtaattgccggccccgaacgaggcattgcacatcaccgtcagcttgggcacatggctgcagctctgtgccatgatcatcttggcgccgtccttggtgatgccggcggcctcgtaatcgcggccgaccatatagccggtgatgttctgcaggaacagcagaggcgtatcgttttgattgcacaattcgataaaatgggcacctttgagtgtgctctcattgaacagcacgccgttattggccaggatgccgacccgatagccccagagattggcgaagccgcagaccagggtcgggccataggccggctggtattcgtggaagcggctgccatcgaccaggcgcgcgatcacctcgcgcatgtcgaagccctttttgatgtcgtcgggcaggatgccgtacagctcgtccgggtcgtaggcgggcggttccggcgtatccaccgcggcgatccatttgcgcggggcatcccagcgcgccacgatctcgcggccgatggcgatggcctcggcctcgctcgcggccggatagtcgcaggtgccgctgacgctggtgtgcatgtcggcgccgcccagctcgtcgacgccgacgatttcgccggtggccgccttgaccagcggcgggcctgccaggaacaccgcgccggtgccgcggacgatgacgttgtagtcgctgagcgccggcacataggcgccgccggcggtgcagtggccgaagaccagcgccagctgcttcacccccatccggctcaggatcgactggttgcggaagatccgccccgccatctgtttgtcggggaagacctcggactggcgcggcaggaagccgccggccgaatcgcagagatgcaccaccggcagccggttctcgatcgcgatgtcgagcgcgcggacgatcttcttcaccgtcagcgggtaccaggcgccgcccttgatcgaggcgtcgtcggcatggatcatcacctcgcggcccgagacgatgccgatgccggtgatgctgctcgctcccgggctctcgccgtcataggcaagcccggcggcgagcgtcgacagttccaggaagggcgtgcccggatccagcagccgttccagccgttcgcgcggcagcatcttgccctggcgctccagccggcggagatcggtttcgggccgctggtggcgggcggcatgctggcggtcgcgcaattccgcgaccagtgcccggttgcgggcatagcggcggcggaactcctcggactggccgtcgatcgccgatctgatgaagctcatggaaccatctttcgcaagggggcggcatcaccggccgcgtcgacgggctgaagcgagaccagcaggtcgccgcgcgagaaggcggcgtccgcgccgagatgcacctctgcgaccacgccctcgcggggggcggcgagggtggtctgcagtttcatgctctcgatggtgacgagcggcgcgccgcggtcgaccgtatcgcccgcggcgcaatgcaccgccaccaccatgcccggcatctcggcgcgaacttcgtcggctgccgcccctgcggccgcgtcgccaccccgccggtcatcgaccgtcaggcgatggcagcggccgtcgaggcgcaggaagacgtcgtcgccggccacgtggacccagccgcggaccgggcggccgtcgacttcgagcgcgaaccgtccgggaccggcggtggcggtatccagcacctcgtgaaccacgccgtcgacgctcagcctcaggccgggccgacgggcggcgacgtccagcgcatggtcgcggccgtccagggacatatgcatcggcatcgatatatccttcacacccttggccgatgccgccgcgccggtgcgctggtatgcatcgacatcgatgtatctctgtggtcagttccgccagaagccgatcgagccatgcggctccggcgtctcgcggatcagggtgcgcagcaccggatgggcgagggctgccgcgatcaccgccccggccgcggtggcaggccccgtttccggcagggccagatccgcgccatgggtgtcgagaaagccggtatcgacggcccccgacaggaaggccgggtggcgcaggatccgcgccagatggtcgacattggtggcaacccccaggatcgcggtctcgtccagcgcccgggccagccgggcggcggcggtggcacggtcggggccgtggacgatgatcttggccagcatcgaatcgaaggccgccgtcacctcctggccgcgggcgatgccgccgtcgatgcgcagcccgggcaggcgcggcagatcgagcaggccgatccggccggtcgccgggcggaagccggcctggggctcctcggcgcagatccggcactcgatcgcatggccttcgggcatcatgtcaccctgagtgaagcgcaggcccccgccggcggcgatgtgcagctgttcggcgacgaggtcgatgcccagcaccatctcggtcaccggatgctcaacctgcaaccgcgtgttcatttccaggaagtagaaggcgccgtccggggccaggacgaattcgaccgtgccggcattgcggtaattcgccgccgatgccagatcgaccgccgcccggcagatcgcatcgcgcagcgccggcgccaggccgggggcgggggtctcttcgacgatcttctggtggcggcgctggatcgagcagtcacgctcgcccagatgcaccacccggccggtgccgtcgcccagcacctgcacctcgacatggcggggccggtcgatcagccgttcggcatagatccggtcgtcgccgaaatagcgcagggcctcgcccgccgcgatccgtgccgcctcggccagttcgccggcgctgcgcacgatcttcatacccttgccgccgccgccggccgaagccttgatcagcatgggaaagccgacgatgcgggcggcccggtcgagaaaaccggcgggatcatcctcgcggatcacgctcggcgccaccggcacgccggccgcgcgggcgaattcgcgggagcggatcttgtcgcccatcagccgcatcaccccggcatcggggccgatgaacaccagcccggcggcggcgaccgcctcggcgaaaccggcattctcggacaggaagccatagccgggatgcaccgcctgcgcaccggtcacccggcaggcctcgatgatcgccgccgcgtccagataggccgcggccggggtggcaccccggatctccaccgcctgatcggccagggcgacatggggcgcgttgcggtcgacatgatggtggatggcgacgctgcggatgccctgctccttcagcgtgcgcaggatccggcaggcgatctcgccgcgattggcgaccagaacggtggtgaacatcggggatcagtctccggatttctggttggccgatcctgcacgggcgagcagcgcctcggcctggaccagatgcggccggtcgagcatgcggccgtcgagcccgaccgtgccggctccgggtgcggcggcgaaggcatcgacgatccgccgcgccgcggcgatcgccgccgcatcgggggtgaaggcggcattgatcggcccgacctgatcgggatgaatggcgatcttggcgcggaagccggcatgggcggcggcacgtgccgcggcggtgagcccggcctcgtcgcgataatcggcgtggagcgtgtcgaccggatcggcccccgccgccaccgccgccagcaggcagagatggcggacggtcaggtagagcgggtcgagcccgcccgcggcatcgcggttggaaaccgcccccaatgcggccgacagatcctccgccccccaggtcatcgcccgcagcctgggcagcggcccgccggcatagctgccgagggagagcaccgccgccggcgtctcggttgcgaccgagaagatgcgggtcgacccggtctccaggccgaacgccgcttcgaaggcatccagatgatggccgaggcggacgacctcggcccggtcgcgggccttgggcagcatgatgccccggggggcccccggcatcaccgccgccagatcccggagacccgcctccccatcgagagccgcccccccatccagcggattgatccggacccataattccggccctgccccccggctccgatgctccgtcagcgcctcgcgcagcatggcccgtgcggcgggcttgcgctcggccgtgactgaatcctcaaggtccaggatcagcgcatcggcgccgctctccagcgcccgggccagtttacgcggcgcatcggcgggcacgaagaggtaagagcgcgccccggtcatgccacctccgccgtgcggggcgaggcccgcttcatcagggcgaagcgccggcaggtcgcgaccatctcgccgcgctggttgaagcatttatgctcgaacaccgcgaccccggcatcggggcgggagcggctgtcgcgcagctccaccacctcggtcgtcgcgcgcagcgtgtcaccgacatgaaccggcttcggaaacttcaccccctccatgcccagattggccaccgtggtgccgagcgtggtgtcgccgaccgacacccccagcatcaggccgaaggtgaagatgctgttgaccaggatccggccgaactcggtgcccttgcagaattcggcatccaggtgcagcggctgcggattatgggtcagcgtggtgatcagaaggttgtcggtctcggtgacggtgcgggtcacggcgtgctcgaagcgctggccgaccgtgaactcctcgaagaacagtccggacatgggggtgtggcttcctcggctgacggggcaccgggggtcgctccggcctctgcccgcattaaagtgagtgatatttactttatgtggcgctcattcagaggtcaatcccgcttgattggcttgaaagcaatgatttttgaggggattatatttatgaatcaaatttccttttggaggatggcatgcagagtcccgctcccggtggccatttcgcccccggtctcttcaccggccgcacggccctggtctcgggcgcgggctcgggcctcggccgggcgatcgcgctcgccttcgcccggctcggcgccgatctcgtgatctgcggccgccgggcggcgccgctggaggagaccgcggcggcgctgcgcgatctgggcgcgcgggtgctggtccatccgatgaccatccgcgaccccgatcgggtctcggagctgttcggggcggcgggcgagtgcttcggcggcatcgatgtcctggtcaacaatgccggcggccagttccctcaggcggcgatcgacatgtcgcccaagggctggaatgcggtgatcgacaccaatctcaacggcagctggtacatgatgcaggcggccgcccgggcctggcgcgatgccgcacggcccggctcgatcgtcaacatcaccgcgccgatctggcgcggcatgcccggtgtcgcccatacctgcgccgcccgggcgggggtggtgttcctgtcgaagacgctggcggtggaatgggcgccgctcgcgatccgggtgaactgcatcgccgcaggcgtgatcgaaagcgagggcatggccgcctatacgcccgaggtgcagcgggccttcgaccggtccaacccgatgatgcgcaagggacgggtagaggaggtggccgatgcctgctgcttcctggccggccccaccgccggctatgtcaccggcgaagtgctgaacgtcgatggcggtcagcagatgtggggcgagctgtggacggcggggcggccggattatttcgcggactgagcagtttaatggtccgggcggttcaatggtccgggcggatgggcggcggcggccggtgccgttgccggccgtcgccggcgcgttctatttcagcagttcgcccgcgatgatcagcttgcggatctcggtcgtcccggcgccgatttcgagcagtttggaggcacggtaaaggcggttgatctcggtctcgcgcatatagccggcaccgccgaagatctgcaccgcctcgctcaccaccctggtgcagccctcggccgcatagaggatcgcaccggcggtcagcttgtggatctcgccgcggccgccttcgtcatgttccatgcggttggcctcgtcgagcacccgatagcagaagctgcgcatggtctcgaccgtcacatacatctcggccagcttggcctggaccatctggaacgagccgatggtgcggccgaactgctggcgggtgcgggcatagtcgagcgccagatcgaaggcgcgctcggccatgccgagattgatcatcgcgaccacgatccgctccaggtcgagcccgctcatcaccaccgcgacgccctggttctcggtgccgaccaggttctccgccggtacccggcagtcgtcgaacaccagttccgccgtggtgctgccgcggaaccccatcttgtcgagcttctgggcgaccgagaaaccgggggtgcccttttcgaccacgaaggccgagatgcctttggcgccaagctcgggcgccgtcttggcatagaccagcaccaggtcggcgacggggccgttggtgatgtagagcttggtgccgttcagcacgtaatggtcgccctcgcgccgggcggtggtgcgcatcgatcccagcgcatccgaaccggcgccgggctcggtcaaccccagcgcgccgatcttcgtgccggcgcagagcccgggcaggacccgggccttcaccgccgcgtcggcattgcgcaggatgttgttcaggcagaggttttcatgcgccacatagctgagcgagatggcatggttccaccgggccagcccctgggcgatcaggcccgaggcgaagaggtcgctttcggcaccgcccagctccgccggcgcggtcacgcccagaaagcccatctcgcccagccgcggcatcacctggggcggccaccattcctcgtcgtccatgcgctgctgcagcgggtagagctcgttgcgggcaaaacggtcggcatggtccaggatctcctgccgctcgggcgacagcgtccagccggagaccggcgggtggttggggatggcgtcgatcacggtcacggtctgcaatctccttcgcggcgtcagctcagccagcgcttgcgccggcggtaatgtttcacccgggcgtagtcgacgctgccgccgccgcccagatagaagtcgcggatgtcggggttgtcgcgcagctccgccgccggcccgctcatcaccacccggccgttctcgatcagatagccatgggcggcgatggccagggcggcatcggcattctgttccaccagcagcacgcccatgccggtctcggcggcgatatgggcgatggtgtcgaagatctcgtcgaccagatgcggggcaaggccaaggctcggttcgtcgagcatgatcagccgcggtgcggtcatcagcgcccggccgatggcgagcatctgctgctcgccgcccgagagatagccggcctccgaccgtgcccgctgccgcagccgggggaaacgctccatcacctcctcggccctgtgggcggcggcgcggcggtcgccatgcatggtggtggcggccatcaggttttccatgggcgtcagatgcggaaacacccggcggccttccaggacatggacgatgccgagccgcacccgttccgccggggcgaggccggtgacgtcgcgcccgtcgaaggtgagcgtgcccttggtcaccagcccgcgttcgggcttgagcagcccgctcaccgccttgagcgtggtgctcttgccggcgccgttggccccgagcagggcgacgatgccctgcccgggaacctggagcgacaccccggtcaccgccatgaacacccggtcgtagacgacctcgacattgttcaggccgagcagcatggggcggtcactccccggtcttgcggtagtgctcggcctcggcgcggaccagcttccagaccaggtcctgatgggccgcgaaccagtcggtcttcgccacccagcgcgtgccgtcccaggccgccatccggccggcgccgccgccctgatgatcttcgggcgtcagcgtggtcggcggcagcagcccctcggcgtcgaaatcgcgaatgctggtcagcccggcattcagccgctctgcggtcagcggcagggtcggatcggcggcgagcgccagccgcaccccttccaccaccatcgccatcatgccgacgcccatattgtaataggcggtgccgaccttctcttcggggccggcgcctttgcccttggccaccacctcggccaggatgtcggcgatgatcttcggctcgcggccgctggccaccgcctcgaatttcagcacgcctttggcctgttcgcggccgacgatttcggcgtccgattccgacagccagacgccggtcgccaggcggtcgcgggggatgccgttgcgcacggcttcccgcagggccacggtctggccgatgccgccgccccagatgatcgtccagtcgggccggaagcgccggacctgggtccagaccgccgactgttcgctgccgggggaggggtaggggaaggtgccgagttcgaaaccgtcggcctcggccaatgcgttcagcaccggcagcggttcacgaccgaaaggcgagtcgatatatacgtatgcgagcttcttgcccttgaggccaccctcgctcacctggttcatgtaagacacgaccgcggcggcctgcgaccagtacatgggcgacatcgggatcacccaggggaaggtggtgccgtcggcggcgtcgctgcggccgctgaaggtggtcagcaggttcatatgatcggccatcgcccgcggcaccagtgcgcgcgacaccggggtggacagggcatcgacggtcagcaccccggcctttttcagtcgttcataggcctcgatgccgcgctggggctggttgccgtggtccaggaccagcgcctcgaaggtgaccccgccgaccccgccgcggccattgaccagcgacagataatcccgctgaccctggttgtattccgaggtcacgaatgtgtagaccgcggtgaaatcctgcggcatgccgaatttcaccaccgtgtcggcatcctgggcagcggccgatcccgccaccagcgccgccccgagcccgagcgtcagaccaagcccaagcccgagtcccgccatacgactgagcacgcccatgtcgctcctcccctataagatgtagctagatcgtcttttggttgtggatcccgacggcaggccggccatttcaaccgaagtgacggaatggccagaccatcaggtacttgcggatgttgtcgtagatcttcgccagccccagcggctcggcgagcaggaagccgatgatcagcgcgccataggcggccagcgggatatgggcgaccagttcctgcgacaggtcgagcccggcggcctccaccacccccagcaccgccatgttcaggatcagcggtaccgcgaagatgaaggcggcccccagaacgctgcccagcacgctgccgagcccgcccacgatcaccatcgccaccagctggatcgagacgtcgagatggaactgttccggggtgatcgcccggtaatagcagaaggcgaggatcgcgccggcgacaccaccgatgaacgacgcggtccagaaggccgacagcttgtagcggaacacgttcacgccgatgacctcggccgcataatccttgtcgcggatcgtggccagcgcccggccatagccggtgcggcggacattcagcaggaaggaggcggtcaggatcgcgacggcgagcgccacccaccagcgcccggcatcgcctgcgatcgggatcacccccagcagcaccaccggcggcgcctgcagggtcgcctgggcgccgccgctgatcgccggcacatgggagatggcgaaatcgacgatgtactgcatggccagcgtcgagatggcgagatagagccccttgaccctgagcgccgcggcgccgaacaggctgccgatcgccgctgcggcgaggccgccgccgatcaccgccagttcgaagggcagccccgcccgcgccagatggatcgaggcataggcgccgatcgccatcaccgcggcatagcccagatggatctggcccgcgccacccatcagcaggttcaaccccatggccgcggtcgcccagatcaccatcggcagtgcccaggcggtgagatagagcggcgtcagccaccagggggcggcgatcgccagcactgccagcagcaggatcagccggcggtcgaaagccagcggccagagccggcgatcggcggcatagctggtgtggcgcacgcctgcgcgacggtagaacatcgccctcagaccctttcgatatgcacgcggccgaacaggccatagggccggaccagcacggtgagcaggatgatcatggccgccaccacatcgcgggtgccgccgccgaccacggggtcgagcaggccgccgaccaggctttcggcaacgccgaccaccagcccggcgaccagcaggccgggcacgctgtcgagcccgcccaggatcgccaccgccagccccttgaccaggaacagcgacagcgtccagtccaccccttgcaccgagccccagaggatgccggcagaggcggcggtgacgccggaaatgccccaggcgagcgcgatcgcatgctcgacccggatgcccaccgaccaggcggcgacctgatcgtcggaaaccgcgcgcagcacgatgccctgcaaggtgccgaagaagacgaccgccgccaggatcagcgccagcgacaccgcgccaccgacgagataggcggtgttgatcagcatcggccccaggaagaccggatcctggccgatgccaagatccagccgtttgacatcggccccccagatgcccggcaccacgccgcggagcatgatttccacgcccagcgtcaccatgatcaccatgatcggtgcctcgccggtcatccggcgcagcaccacccgttccagcgccaggcccagggcgaacatcgccgccagcaccaccggcacggccgcccagccgggcaggccggccatcgatgccgccgcccaggcgacatagccgccggtcatggccagcgccccctgggccaggttcaccacgccggaggccttgtagatcagcacgatgccgagcccgaccagggcatagaacaacccgaccagggcgccgttgatcgcaagctcgcctgcaaaggccatgtccatctcagccgacctccttcaggcggatgcgccggcggatggtgccttcggcgccggtctcgtaggtgatggcgatctcgatctcgaccgcgtcggcggtgccgtagagcgcgtcgatcagggctgcatagcgggtctcgatcagcttgcggcgcagcttgcgggtgcgggtgatctcgccgtcatcggcgtcgaaatccttgtgcagatcggcgaagcgccgcacccgctgcccgggctccagcccggcattggcctcagatacaactgaagagatcaaatcaacaacttctgggtgctgggacagctcggcataagaggtccaggggatgccctggccctgggcccattgcccgaccgcctgctcgtcgatgcagatcagcgccgccagatgcggccggccgtcgccgaacaccgcggcattgcgcacgaagcggctgaatttcagccggttctcgacatggccggcaatgaagcgggtgccgtcggcggttcggcgcagatcgcccatccggcccagcaccaccaactcgccccgggcgtccagatggccggcatcgccggtgtgcagccagcggcgaccctggggatcggtttcgaccacggtgtcgccgccgcccagatagccgccgaacaccgaccccgccccgatcaggatctcgcccgcctccgacaggcgcagctccacccccggcagcggccggccgacggtatgaggcgaggcgtcgtctccggtctggcagaccaccagggcgcagctttcggtctggccgtagaactggcgcagatcgatgcccagggcccggaagaacagataggtgtcctcgccgatcgactcgcccccggtgtaggcccggccggcccgcgacagccccagatgatccttgaccggcgcatagaccagcggttcgcccagcgcgcgcagcaggcggcggccggcagaggggcggcgtccggccaggcggtcgcgctcgatccgggtcgccagcccgatgaagcggtcatagatccagcgcttgaccggcgtgctctcggccatgccgacctggacccgggtcagcatcagatcccaggccctgggcgccgccagatacagggtcggtgccacctcgcgcaggtcgcgggcgacggtttcctgccgctcgggcacattgaccacgaagcgcagcgccatggcgccggcgatgctgaacacgaaatcgcccacccaggccatgggcagataggcgatgtgctcgtcgccctcgcggaagcagccggcggcagcggcggccgtcacggcggccagcgcctgggcgtgggtgatggggatgcctttgggtgcgccggtggtgcccgaggaatgcagcagcaccgcaacgtcgccgccatcggcccgcccggccagcgccccggccagggccggatcggcatcgagcagggcccgcccgcgcgccgccacatcgtccagcgccaccagcccggcttcggcatagccggtgatgccgcgcggatcgtcgtagatgatgatctcgggcaggccggtcgcgctgcgcagcgccagcagcttgtcggtctgttcctgatcctcggccagcgcgaagcgcggccgggcggtgcgggtgaaatgctcaagctcgcccggcggcacgtcggggaagaccggggcggcaaatccgcccagggtcatcgccgccaccgtgccgaaatagagcgccgcgcggttgtcgcccagcaccgccagcgcctcgccggggccgaagcccagcgcgtccagcccggccgcgatctccatcacccggcggtgatagtcgcgccagctccacacccgccagatgccgcgctcccgttcgcgcagcgccggtcggtcgccatggtcgcgggcattcactgccaggatcgcgggcaccgccggcccgttccggccaggggcatgtccggccggcatggcccgggcgggggcgatgtccgctgtcgccatccgttcaggccgcacgggaccgcccctttcccagataggccgcgaccacggccggccgggcgatcacctcgtgcgggtcgccttcggcgatcggctcgccataggtcagcaccagcagccggtcggtcagggcggtcaccacgtccatgtggtgttcgatcagcagcaccgcggtgccgaaggcgtcgcgggcatccaggatgaagcgggccatgtattccttctcttcctggttcatgccggccatgggctcgtccaggatcagcagccggggttcggcggccagtgcccgcgccagttccacccgcttctgcaggccgagcgggatcacctccaccggctggtcgcgcacgtcctggagctgcaggaaatcgatcacctcttccaccactgcccggtggcggatttcggccggtctggcccagaagggatagaacagcgccggcagtgcccccggccgcatgtgcaggtgacggccgaccaggatgttgtcgagcacgctcatgccccggaacagcgccaggttctggaaggtgcgggcgatgcccagccgggcgatgcggtgcggcttcagcccgcggagatcgcggccggcgaagcgcacctggccggcatcgggcggatagaagccggtgatggcgttgaccatggtggtcttgccgctgccattggggccgaccaggccgaagatctggccgggatggatggcgatcgagacggatttgagcgccttcagcccgccgaaggaccgctcgatccggtcgcagaccagcagcggcgtgggggcggaagacgaggtcgggtcggctggggtcatcggtccgggtggccctctgcgacggccgcggcgggacgggcgttcgggtgacgccgccccccggtggcatgggggtgcaaggacggggccggcggcggcgcaggcggccgtgccggtcgaaggtatgtggcagtcgaaggcgtgccggggtcgaaggcgcgtcgggtgcgatcgaagatcgtgccccggtggggcatggctgcccgggatggcgcacggtttcttcctggtgccggcgcctccctggtgccggtgtgccggttttgcctgtgtttgttgtccggcgaccgttttagtgaacgatactcactttttagagtcaacacgaaagcggctcatgacgccggcatgagtgccttcgtctgatgaattcgtgttattttgcaatgcaagacgatatgttgcggccgcacagggcgggccggcccggcacgatcgccggccgggaacaggtcagtaaatatgactcacttacttggggctgccgcctcgatccgtgccaccaccgcttccagccggtcgagcagcggcaccgcggggtcggtggtgccggccgggcgcatgccctggatcagcacatcggtcagggcatcggcaacggcggcaacttcgatccggccgcggccgctcagcgcccgccaggcgacgtgttccagtgtgccgaacaccagatagcgcaccagccggaccgggaaatccgcccgcacgtcgccggcgcggatgccgtcttccacgatgcgcagggtgatgccggtatagcggcggttggcctccagaagggtcgattcgaaatagtcgtcatggctgcgcgcctcgcgcaggaagaccttcgagatgccggcattgatcagcatcttctgaaggtggaagcccagcacatagcgcagcttctcgcggaagcccgcgatatggggcaggttctcctcaagctcggcgatcagcccttcgtaatagcggcagagcacctggccgagcagatccttcttgctgtcgaaatgcttgtagatcgtgccctcggcgatgcccacccgccgggcgatctcggaaatcgacgccgcttcgtagccgcgttcggcgaaaacgtcatgggcggtttccaggatggtgcgggtccgcgccagggtcttgggcctgggcccacgcttgcgcggcgcggccgccgtctcagggctggtctcggtcatcgggttcgggctctcccccctggacactggccgtgggcggccttcgccttcctagcacgggcgggccgggcttgtcagcgcgacgtgccgatggcgcgacgggcggcggcgatgccgggggcagggagggctcacaattattggttagggatatatccaataagttgaatttaataataagcacattgtaaaaatggttcgggtgcgcggccacaccccgcatcaaccgccgccgcgacccgcatctcagggaggacaggacccatgcctggtggtcccatcgatagaaccgtcatcatccgccacagatccacgggccgcctgctcggcctctcgaccctctcggtcgcagctggccagaaggtctcgctgatcggcatccccgacgagaacggggcgcggagccgggcggaggtgatctggaagctggtcggccagccgccgatcatgcaggagataagcctgatcaatgaagcggccgcagcctatgtcggcgtcgaccgcacgccgctcgacacccacgacatccccgtgctcaatgccgtggggatcggcctgacggcaggcgagggggcaccggccttcctgctggaaatcaccaagaccgggcagctgctgagtctcggccacgcgcagtatctcaatctccgccggctcggtgcggtgacggcggtttgggctcccatcgacagcccggtcgacgaattcgagccggaattcgaatgggagatcgtggcgctcgactgacgaccacccgacgcctgcggcgtgatgcccggcctcaggccgcaggcggcacctcgtccccccacagctcgggccgggcgatcacccgggcgcggaaggccgcttcggcctcgggggtcagcggccggtcggtataggtctgatagtagatcggcagcagcgacaggcggaccgacatcggctcgcgcacgtcgagggcgtaatagcccatctggatgaaatagaaattccgcgcccggatctcggcctggccggcgtcgaagccgtggcgggtgtacatgtcgaccagggccgcgagacgggcctggtcggcagcgcggatcgtgtcctggatggccggcatgccgcgcgcccagtcgcgtaccgcgaaatcgagccgggggtcgaactgccccggatccagccagatctcgaacagcgccagaatgcaggcttccagcgtcggccccgccatcgccgcgcgctggatcgcatcggtgttcttccggttccagacctccagcatcgcgtccagcagcgccgcccgatcctggaaatgccagtagaagctgccgcgggtgacccccagcccgtcggccaaccgggtgatgcgcaccgcatcgaccccgctttccaccagcacctgcaacgccttttcgagccagtccgcccgggtcaggcgcggcgcgcgcgcatcgtcttcgggcatgctcacctgctcgatcagccggcggttcgtcattgacgtctccatacaggtctgtatcgttcaagacataagtgtacggtctcgggcgtggtctgaccagagtctccacaacgaagacgtggcaccacaacgaagacgtgacaccacagcaaagacgacaaccggggggaagagagagatgacggtgcaggcgaaatcgccgcccagggtgatgcggttcgacgggttgagcttcgcgccccgcttcgccttccccgagatggcacgcgtcgtggaagtggcgggggcggaagacggcagcgcgcttgccggcggcttcgcgcgcttcaccggcgcccggattccgtggcagctgcggtatgacgagctgatcctggtgctcgacggccggcttgtggtcgaaaccgcggatggccggctggaggccgggcccatggatacgatctggctgccggcgggcaccgacctggtctacagctcggagaacgcgctggtctggtactgcctgcagccggccggctggtcgcgggacatggatgccgcagggagtggggcatgaccgccatcaccctgctgcccgagaacgaccgcacgaacggctggagcgccgacctgccgccgcgccggccgaagccgccgctcggccgcgacgtcaccgccgatgtcgtggtgatcggggccggtttcgccgggctcggcgccgcgcgccggctggcggaactcaggccagatgcgaagatcgtggtgctggaagcggggcagctgggcgagggcgcctcgggccgcaattcgggttttgcgatcgacctgccgcacaatgtcggctcgtcgctggaagaactggccaagggccaggcctataagcgcctcgcccgcgccggcatcgcctcgctcaaagacacgatcacccgccacggcatcgcttgcgactggagcgcggacggcaaataccacaccgcctcgtcggatcgcggcgcggacgaggtgctgcggccgacggtcgaagaactcgtccggctgggtgagcctcatgaatggctggaccgcgaggcgaccgcccgccggctcggcacccgccatttcgccgccgcggtcttcacccccggcacggtgctggtcaatccggcggcgctgaatcggggtctcggcgacaaccttcccgagaatgtcgacctttatgaaggcaccccggttgtggatgccgcgttcggggcaagcgtggtgctgaaaacgcccggcggcatggtgcgcgcgcccaaggccatcctggcggtgaacgggctggcgatgcgcttcggcttctggaggggccggctgctcaacttcgccgcccatgccagcctgagccggcggctgaccgcggccgaacaggcggcgctgggcgatatcgcaccctggggatcaacccccgccaatgccttcgccggcatcaccatgcgctataccaacgaccggcggatcctgatccggcagaacatccattactgcccgggtctgcgccagtcggatgcccgccgcgcgctgatccgcaccgagcatcaacgcctgttcgaccagcggttcccgatgctgaccggcgtgcagatggagcacacctggaccggcttcatctgcctgtcgcgcaacggcgcccccggcttcggccaggtggcccccaatgtctggagcgccgtctgccagaacgcggtcggcatcgccaagggcacgatcagcggccggctggcggcggccatggcgctgggcgaggacgacccgctgatcgcggacatggtgagcctcggcacccccagccgcgtgccgccgcgtcctttcctcgatatcggcgtgcgcgcgcgcttcgcgctcgaaatctttgccaatcgtcacgaggcctgaggcgtcacgaggcctgaggcgtcggacgcaagaccaacaccacaaagacgatccgcaacaggatcgcacccatgtgatcagggaggataccgacatgaccatcaggacgatgctgaccatgaggacgatgctggccggcgccgcattgctggcgctggccgcgaccgggcttgccgcagcccccgcccgggcggtgacgctgaagcttgcgaccgattccggcgccaagggctcggatgccggcaatgcgatcgaggcctgggcggagaagatcagggccggtaccaagggtgaggtcgatgtccaggtcttctatcagaacgaactgggcggccagcaggaagtcttcgacctgctgatggccggtgatgtcgacctgatgctgaactggccgatgacctcttacgatcagcggatttcgctgatctacacgccctatatgttcaccgactggcccgaggcgctgaaggcctatgggccgggcggctggctcaacgcggccctgggcgacatctatggcgatatcgggctgcgcttcctgggcgcctggcccgagggcttcaacggcgtcgccacccgcggcggccatgccaccacgatcgaggccgccagggcgttcaaggtgcgggtgccgccggtctcgcccttcaccgagaccgtggcggcgatgggctatcagaccgcgaccgtcgattggggcgaactctattccgccatccagaccggcgtcgtcgacggcgaggcggccaatgtcatcttctacgacgtcacctattttggcgacgtgctgaccgattacgtccacacccgccagcagttcctgaccggcatcctgaccgcgaacgaggaaagctggcaggagctgacgccggcacagcaggcggtggtggcagaggccgcgcgtcaggtgatggtggcgcagttcgatgcggcgaaggcagccgacgagggccatgtggcgtcgtggaaaaagctcggccacagctatgtcgaacccacggccgaggagctggcggccctgaccaaagcggtgcgcgccgccgtctggccgggcatggaaaaggtgctgggccccgagctgatggcccgggtgcgcgcccagaccggcaactgaccggctggcaatcctgccccgtcctgcccgctgtctctgggggttgtgcccgtgatcaccttcctcgccgcgctggacggggtgttcgcccgcgtcctgaacctgctcgtgctggtcaccagccttgtcgtcaccgccgccctggtgctgctggtgacggcacgggccgggttcgacctgccgctcaccggtatgcacgaggccagcatgctggccgccatgtggctctacatggcaggcgccacactcgccacccgcaatggccgccatctgacggtcgatttcctggcgaccggcctgaccggccggcgggcgcgggcgatccacgggctgatcatcgccgcgatcaccgcggtggtggcggggttgttctgcttctgggtgtggaagatgttcgcctggggcctgaaacgcccgcagaccatcccggtgctgggcctgccgctctggctggcccaggcaccgctggcgctggccgccgtcaccgccgtgctctatgcgctgcgcgacatggcgcgtgccgtcctggccctggccggacggggggagggcggctgagatggatgcgctcgcagcccttctgcttctgctggtcctgctcggcatcggcctgccggtggcctggtccttcgccgcggtggtggcggcgctcgccgtcatctacgatgccaatttcaacaccctgatgctgcagggcttccgctcgctcgacggggtcatcctgctggccctgccgcttttcgtgctggccggctatctgatgcagtcgggcggcatcgccgaccggctggtcgccttcatcgaactgctggtcggccgccgccgcggcggcatgggcagcgccatggtggtgacctcgggcgtgttcggcgcgatggccggcaccgcgaccgcggcggtcgccgccatcggcacgctgatgatcgacccgatggaaaagcgcggctattcccgcggctatgccgcggccctgctcggcatctcgtcgctgctgggcatcctgatcccgccctcgatcaccatgatcctgttcgcggtggcgacccagcaatcggtcgcggcctgtttcgcggcctcgatcgtgccggggctgctgttgatggtggggttgatcctgttcaaccgcagccagatcggccgccatatccacgagatccgcagcgatcgccggcaaagcccggccgaaaagctgggcgtgtcggtccgcgccctgccggcgctgtcgatgcccgcgatcatcatcggcggcatctatggcgggctgttcacccccaccgaagccgcggccttcgcggtgctggccgccgtgctgatcggccttttcgtctatcgcgacatgacgccggcaaagctccgccaggcgacgatcgatgcggccgagacgacgggatcgatcatcattatcctgctcttctcgttcatcatcggccggatgctggtcgccggccgggtgccgcaggatctggcggcgctggtcgcctcggtggtgtcggatccggtgatgatcatgatcatcgtgaacctcttcctgatcctggtcggcgcgctgatcgacgacgtctcgatcacggtggtgatcgcgccgctgctgctgccgctgatggtctcggtcgatgtccacccggtgcatttcgccgccatcgtcggcacctcggtggtgatcggcgccaacagcccgccgatggcgccgctgttgttcatggcctgccggatcggcggggtctcggcccagcacgccgtggggccggcgctcaggatgatggcctgggtggcgctgccggtgctgctgctgaccagtttcgtgcccgccctgtcgctcagcctgccgcgctggctggggctgctctgagcggcggttcccggcagtctcagaccggatcgcccccgtcccgttcccagcctgttccgcagcgtcgtcagcacccgatatgcggttcgcagctcgtccaggctcaacccctcggccagggcgtcgatctgcggatcgtacaggcggagcgcttcgtcatagaccgcgcggccgcggggggtgagcaccaccagctgcgcgcgtttgtgatgggggttgggcgcgaaggcgacgatgccctctttcgccagatcattgacgatccgctgcacgttctggcgattggcgcccagatcgcgggccagccaggccaccggctgcggccggtcggcatagacgatcgcgcccagaatctgccagcgcgcgctggtcagccccagcggcgccaccagccggtcgccccaggcgagcgtcagattgttcacccggaacagacccaggatcagatcggtcagggccgtggccctggcggcatgctggtcatcggacatgcgtcatcctgcgagtttattgacactctgcgcattaattgacatcatgatgtcaattggtcatgtaagtgacgctagcgcgtctgccgctcccgggcaagccccggatgccggcggcgccgatggggagatcccgtcccgatgaaggccgccctcatgaaacctgccgcgcccatacgccgcgtccacccgatcgccggcaccattgccctgctgacaatcgcgagcttctggctggccacggtcgccgccgaaatctggggcagcgccgccaccgtcaccctggtcaagaccgccatcccctggggtttcctgctgctggtgccggccctggcggcgaccggcgggtcgggtatggcacttgcgcaggggggacgcagcgggctgccggcgcgcaaacgcaggcgcatggcgatcatcgccgccaacggcatgctggtgctgatcccctcggccctgttcctggccgcccgggccggggcggggcggttcgacaccggcttcgtgctcgtccaggcgatcgagctggtcgccggggcggtcaacctcaccctgctctgcctcaacctgcgggacgggatccggatggtgcgggggcgggttgcgtaaccggcgacgaccccgccagcgcctccagcgccatgcggcgataggtggcgaccaggcggtcgccttcctcagggggtacggcgatggcgagccgcatggtcgcctcgcccagatgcatgaccaggaaggcggtggcctccacgtcggccgggtcggcgcccgggcggatgcggcggatggtgtcggccagaaggcggccgttcagccggctttcctcgacctccatctcgcgcagcagcttgtcggcctgcatgcccgaccagatgtccgagatgaccggatcggcccggaacaggccgtaatattcatcgatcagcgcgccgaaggcggcgagcagcccggcctcgtcggccaccggctccagcccggcacggatgcaggcccggctctcttcattgcagcgcatcgccagcatccggatgatcgccgccttgtcgggaaagaactggtaaagcgagccgatcggcacaccagcgcgttcggccacctgcgccatgcgcagcccgtcggtgccgtcggcggcgatgatctcccgcgcggccagaagcatgcgctccacccgctcgcggctgcgctgctgggtgggcatgcgccgtggcgcggcgcggtcggccgtggtcgtcaccggttccggatcctccgtcactttcctgcttgacccagaatacgagtctgcctcatgtttttcaatatgaggattgctcatgtttttgggagggacggatcatgaccacaggcgcgacgacgctggatcagctgccggttctggtcaccggcggcaccggcaagaccggtcggcgggtggcggcggggctgcgggcgcggggatggccggtgcggatcgcggcgcgcagcctggcacccgccgccgatgcggtacgcttcgactgggccgatcgggatggctggccggcggcattggatggagtgggcgcggtttacgtcgcctatgcgcccgatctggcggtgccgggggcggtggacgacatcaccgccttcgccgccgcggcgcgggcggcgggtgtcggccggatggtgatgctgtcgggccgcggcgagccgggggccgaggccgcggagcgtgcgctggcggctgccggcttcgactggacggtgctgcgcgccagttggtttgtgcagaatttcaccgaaggcctgttggccgaggccctggccgcgggcgaactggccctgccggtgggcgatgtgcccgaacccttcatcgatgccgacgacatcgccgaaatcgcggtcaaggcgctgaccgaagacgggctcggcggccgcatcctggagctgaccggcccccggtcgctgagcttcgccgcggccatggccgaaatcagccgactgaccggtcggccgatcagctatcggcagattccgatggccgatttcctggccgggcttcaggcccagggcgtgcccgacgacatgcgcgacttcctggcctggctgttcaccacgctgttcgacggccgcaacagcgccacaacccccgccgtgaccgaggttctgggccggcccgcgcgcgatatcaccgaccgagctgctgccggatggccctgagggttgcccggccatagggcggtttcagcccggcgagttttgcgatgtcgaaccgcgactggcgatagatcgcccgggcatggctgaaggtgcggaacccgtcccgaccgtgataggcgcccatgcccgaggggccgatgccgccgaagggcaggtcttcctggccgatatggaagatcacgtcgtccagcgtcacgccccctgagacggtgcgatccagcacgcggcggcgttcggccgcatcgctgccgaaataatagaggccgagcggccggtcgcggcggttgacctcggcgatcgcgccgtcgatatcgccatagcggcggagcggcaggatcgggccgaagatctcttcctgcatcaggatcatgtcgtcggtgacgtcgcggacgatatgcagcggcatcttgcggctgttggtggcggtgaaatcctcacccgccggattgaccgtctcgatccgtgcgcccttggcccgggcatccgccagccagccggtcaggcgctggtgatggcggtcgttgatgatggccgtatagtcgggattgtcgatcaggcgcggatacatggcgcttgccgcgcgcgtcagcccctcgaccacctggtcctcgcggtcttcgggcaccagcatgtaatcgggggcgaggcaggtctggccggcattcatcatcttgccgatcaccacccgttcggtgctgcgggcgatatcggccgacgcccccaggatcaccggcgatttgccgcccagttccagcgtcaccggcgtcagattgtcggccgccgcgcgcaggatatggcggccgataccggtggctccggtgaacagcagatggtcgaagggcagggcggcgaaggcccggccggtctcgggcccgcccgagacgaaggccagttcgtcggcggcgaaatagcgcgggcaaagctcttcgaacagggcggcggtgcgcggggtgtattcgctggtcttgaccatcgcccggttgccggcggccagcacccccgccagcggcgccatcaccagattgaccggatagttccagggcgcgatcacccccaccacgcccttgggctggtattcgacccggccgcggccgcccagcaggcccagcggaaaggtcaccggccgccgttccggccgcatccagcgccccagatgccggcgggcatggcgcagcggcagaaccgaggccaggatgtcggtgatcatcgactgctcgcggctgcgatggccgaaatcctcgctcatcgccgcacagaaggcctcggcattctcggtcaccagcgccatggcgcgcgtcagtcggtcacggcggatatcggccgcgaccggcagggcggcggtgaaggccgctgtctgtgcctgaaagatggtggtcggatcggacatgtctgatctcctgccgcggagaggggggaggccggaggatgggataagagtgtgccgttgcagccccccacatcttttcctgatcagagacggatggccatatttacttatggttgtggtctggagtgatcgccccgacgaccgggatcgacagcagcgcagatcgggccggcgcggctggatcacgcgcctgcggtcagccgggcgcggacgggcggcaggattgcggtgaccggtgcgcagtgccggcagcaccatagcgcagcccgtcgatcagaaggcccagcatgcggctgacatgggcggcgccgtcctcgccgccggcggtggcaagattgccgatcgcgcgcagcagatcatatgccgcaacgtcgccgcggatcgcgccggccgccgcggctgtgtccagcagggcggtcagcgccggttcgaaccggctgcggaaatggtcgggcagggtatcgaaggccgggtcgccggaatgcagcgccgcggccagccccttctttgtggtcaggaagccggtatagcgggccagccacagcgccagtgcctcggccggcgggtggcttgcggcaagggtggcggcgtcggccgcgcaggcatcgacctcgcgccggaacaccgccgccaccagatcggcgcgtttggggaagcggcgatacagcgtgccgacaccgacgcccgcccgggccgcgatctcgcgcgccggtgcatccacgccggcctcggcgaacagcgccttcgccgcctccagcagggcgtcttcgctgcgctgcgcatcggcgcgcagccgccggctgctgccggtttccgccgtctcgtccccgctcacctgcatctctcccccgccgtgccggcccggaaacgggtctccgggcacgacttgtcgcttgataaacggaacacggttccgtatatctcggtctcagtcggaacgcggttccgtttatagccggatcgcagttccgtttcctgttctacaggcgaagcctgccctcccgccagcccctcccgaccaactccctcccaaccaagggtctctctcccatgaccgatctgatccaggcggcccggcatctgccggcgcgcgcagcccttcccaccctgtcggtggccccgatccacatccccgtgcccggccggccgcggccgctggcgctgcgcgtcacgctgccggtgcccaccctgccggtgcccaccctgctggtaccggacggggggagcgatcctctgccggtggtgctgctctctcacggccacgggccgtcgctttatctgtcgtcgctggatggttatgggccgctggcggggttcctggccgggcaggggtttctggtgatccagcccacccatgccagttcacgatccggcggtctcggcgccgatgcgccgggtgcgccgctgttctggcggatgcgggtggccgagatgaccgcgatcctcgaccggctggacgagattgcggccctgatccccggcgcgcccccacgcctgaaccgggaccgcatcgccgccatcggccattccatgggcggccagaccgtcgcgatgctgctgggggcgcgcctgaccgacccgaccgacccggcggcgcgggatgtgaacctgatcgagccgcgcatccgcgccggcgtgctgctggcagcccccggccgcggcggcgacgcgttgagcgcccatgccgccgccgcctggccggcgctgaaccccgatttcagccacatgaccacgccgtcgctggtggtctgcggcgagcgggacgacaacccgcatctgaccaccatgggccccgcctggcatgccgaccccttccacctcagccccggcgcccgcgccctgctgacgctcgccggcgccggccacggcctgggcggcattgcggggtatgatgcgaaggaaaccgacgacgaagaccccgaccgcctggaagccacccgccgcctgatggcagcctggctgcgctccaccctcgaccccaccgacccggtatgggagcaggcggtggcggcgttgcgcgcgcatgcgccggggttggggtgggtggaggggcggtgacggagagatggccctcagtagatgtatgctgtacaaacatggccattgcgatggagcaacaggggcagccagagacgatggccaggtctttgaacgacaggctgcagcagcttcccgacgcccgccggcaacgcatcctggcggaggccgatcggctgcgtgcggaatgcgtggcgctccacgcgccacaccggaccggcacgccgtcccaggcgacctccggtcgtcgacgggcgtctccccgcgcctccggcaccaccggcccgaccgccggtggcgaacacgggtctgtcggcgggccgcaccggtcatagatcacggctttcacccgtcacctccgccattcctcgtctctcatcgcatcatccccgggagacaaaaccccgtcgccccgttcggccccgccttgcgtctgaagcgccgccctcagcgccgcattctccgcctccagttccgcgatacggtccctaaccggacgcagggcttcggtcagttccgcctcggtgaagcggggggtgatgtattgggggcagttccagtcgaaggcctccagatgcaggcggatgatgcgctcggcctttggggccgtggcgcccggcacccgggcggtcagtgccggatcggcgtccagtgcgacgatctcggccagggcatagatcttcagccgcgcgcggcgcggataatccatcaggaacaggctgaccttgtcattcgtcgacaggttgccgacgcttatgtattgccggttgccgcgctggtcggcgaaggccaggctgcgatcgtccagcacggtcagaaacccttggggtccgccgcggtgctgaacataaggccagccggtttccgaggtcgtggccatgtagaaactgtcccggctggtgatgaaggccgcttcctggtcggtgaaccggtcgaacgcccggtgtcccttgaaatcctgccagagatgggcgacgcccagccggtcctgcgccgcccgcacggccggcgtcatcgcgatgtcgagaaagccgtaccccatggtctgcccctcctgctgcggatggattattctctaccagtcatgaggtaacaggcggcaggccgtgcaacaatcggcagaatacggcgagcatctccccggattttgaggaaatcatggaccgtctggaagccatggcctttctgctggacgcgctggaggccggcagtttctcggccgccgcccgccggctgggcgtgcccgtggccacgctgacgcgacggatcgatcagctggagcaggtgaccggtgccaccctgctgatccgcaccacccgccggctggtgctcaccgatgccgggcagcgctatgtcgagggggcgcgccgcatcgtcgccgaggttcgggatatggaacgcgaggcggcgggcgagttcatcgagccgaccggccggctggtggtcagcgcgccgcgcatgttcggccggctgcatgtccagccggtcatacatgagttcctgcgccggcatgcggcgatttcggtggtgctgcatctgtcggacagcaatgtcgatctcgcggccggcgccgccgatctggcggtgcgcatcggcgtgctgcccgacagcagcctgatcgccacgcatctcggccgcatgcgcatcgtcaccgtcgccagcccggccctgctcgaccgccatggcgagccgcaccatccggaggatctggccggcatgcccggcgtggtgttcgacatgccgccatccgaccgcctggcgcatgccccggggcgcagccggggacaggatccgggaccgcgtgtgggcacccggctgatcgtcaccggcgccgaagcggcggtggatgccgccgtggcgggtgtgggcgtggtgcgtctgctgcattatcaggcagcgcaggccctggcggatggccggctgcgcctcgtcctggaggcattcgaacccgaaccggcccccgtgcatgtgctgcacgcaccgctcgcccagctgccgcagaagacccgctatttcatcgatgtcgccagcgcccggatccgggcgtcggtgcaggcgctggggcaaaccacgcagcacaccgcgtgcgaaaactgacgttgggcctcaggggctcctgttggcgcgcgcctgtatgtcggcacatcgggccatcagcgtgtcgaacggttctgcatcgtcgaagagcagaccgtcctcgaccattctggcgtagtcctctttcagggccttcgcagcgtcccccgtcggcaccagcttcagaccgccattgatggcggcgtcatagtcgatcggtgtccgatcggcggccttttcagcaaagaacatccctttgtgtcgtgcaacactgccggccaggtctcgctttgcgaaggcagcctcggccagtccggcatcatccagccggacgatatcgtgccaatgtcgcgcgaagcgatctccacgcagtcgttcttgcagacagaacacatggattgccgtcgctttctcccagaacgtccgttcggcatgcatgacgcgggggcgcgctgtgggaaatgtcagttcggtgatcagctccgaggcatcgcagacgacgtcgcgagagcttgccggttcgcccgtcgagcgtgcgccgaattccagcatgacgctgggggcgacatagcccgatccggtgctggtcgggtcatagtcaatgaagagcttctcgccgtcgatccggacggtggcggcaagatcttctgccgtcaatgcggccgtgacgatcggtccgacgacggtctccacccaatgtggcagtcgtcggcggacctcggctgaccaacgcctctcctcgctccgggtctttggcagggcttcgccatcttcgcctgccagatctggcgcaatcgcccgaatgtcgtatgtcaggtcgacgtcctcggaaaaccggcggatggctcgatagactttcgacagcgatgtgccgcctttgaacaccagatccgcgccgagcggcgtggtgtagagtgcgtgcagtgcccagacgacccagacatccttttcgagaagatgcgcaggccgccccgactgttctgccgcgacacccagggcgtcgcggcggtcccgggtcgacagctgcagaaaacgctcagccatgagccaccttccccacatgctgcgcaagccatgtcggcagctgtggtgcggccgcgaccagttcgccgaaggtgccgggcggcatcttccgtttcagggttctgagggccgcttccgctttctccgggccgagccaggccagcgcccggacggcttcccccgccggccggtcggccagcaccagttgccagcgcggcgcatgccgcagttccaccacctgtttgcccagctgcatgttccggctgcgccccgaggtcaggtagaccggccggacgggaacctgtgtcgtcagccccagggcgtttgccgccgcggcaccgttggaggcgatgatctccccgttccgggctgcgacggcccggaccgtctgttccaccgagggggggcgggtgccgaaccggctgacgacgggatgaagataaatgccccgactggcgcggatcagacgaccccgggcggccaggcgcgacagagcctggtccaccgctgcccgatttccgagatgaagcaggcttttggcggatacgggggtgccttcgggcaagcccgctgcatgggccagaatgcgttcgctcagctgggtcatgacgtgcctcctgtcagaaaaataggcaagtttctgacaaaatgcaaaaggcacgcccggcgcccaccccggaaaaaacaccgccgcaacccgaaggctgcggcggtgtctgatcgtccgacggtgcgggcagggcaggcggttacggctgcccttcggccgcatcctctttcatctcgaaccacatcgcgttcagcacggcgaaggcgcaggcgagcggcaggccgagcagccaggcgaagtaccacatggggttgtctccttcgtgatgcttgcgatcaatagtagtggccggcttcgtcgcggatcgcctcttcttccacctttccccacatgatgcggtaggcccaggcggtataggccaggatcagcggcaggaagatcacggtcacgaccagcatgatgaacagggtgaggtgcgaggacgacgcgtcccagaccgtgaggctggagcgcgggtcgatggaggagggcaggatgaaggggaacatcgagagcccgaccgtcgagatcaccccgaagatcgacagccccgaggcgatgatcgagaggccccggatccgggcacgaagcccgatcagggtgacggcggcgcccgcaaagcccagcaccggcgcgatcagcatccaggggttgttggcgtagttgacgaaccaggcgccgtcgccatggacgacgtccttgagcagcgggttcgacgggccgtcggcggccatcggtgccgccagcgcatagccgtccacccagttggccagtgccagcccgcccagggcaaagagggcgatggtggcgacggcggcgacggtgccgaaattccgcgcccgttcacccaccacgccgccggccttcagggtcagccagaccgcgccgtgcatggccagcatggccaccgacatcagcccgcagagcagggcgaaggggttgagcaggccgaagaagctgccctcatagaaggcgcggagcgtgtcgtcgagccggaagggcaccccctggagcacattgccgaccgcgacaccgaagatcagcgcgggcacgaagccgcccacgaacagcgcccagtcccaggacgaccgccagcgggcctcgatccgcttggagcggtatttgaacgccaccggccgcaggatcagggccgccagcaccacgaacatggcgaggtagaagcccgagaacgagaccgcgtagagcggcggccaggcggcgaagatggcgccgccgcccaggatgaaccagacctggttgccttcccagaccgggccgatcgtgttgatggcgacgcggcgctccacatcggtcttcgccacgaagggcagcagcaggccgacgcccatgtcgaagccgtcggtggcggcgaagccgatcagcaggatgccgagcagcccccaccagatcaggcgcagcgtgccgtagtcgataagctcatgcaggatcatggctggtcactccgccgggaagggccgggcggcgccacctgcggcaggcagatgcgtcgcagaggggggcgtcgagggcgggacagggtcgtgatcgggctgcggccccttgcggatggcgcggagcatcagccccatctcgatcacgaacagcacgctgtagaacagggtgaagccggcgatggtcagcagaagttcacccgcccccaggctggacaccgccatggccgtgggcagcacgccttcgatgatccagggctgacggccgacttcggccacgatccagcccatttcggccgcgatccagggcaacgggatcgccagcaccgcgatcttcagcagccagcgctgttcccccagccggttgcgggccgactgccagaagaacacgccggtcagcaggatgaagaagaagccgagcccgaccatgatccggaaggcccagaacagcgtcggcacatgcggcaccagatcccaggcggcctggtcgatctgggcgtcggtggcaagccgcgggtcgtcgacatagcgcatcagcagcagggcatggcccatattgccgccattggcctcgaaggcctcgcgcacctcggggccgaccgcctcgatgctgcgggcggcacggatcttctgcagcgcgtcataggcgatgatgccgctccggatccgctccttgcctttttcgaccagatcgttgatcccgggcacttcggtgtcgagcgagcgggtggcgatcagccccagcgcataggggatggtgatcacgtgatgggtctcgcgcccctcctgatcggggaagccgagcgccgtgaagccggccggggccgcctccgtctcccacatgccttccatcgccgccagcttcatgcgctggtgttcggtcgccatgtagccgctctcgtcgcccagcaccaccaccgacagcgaggacagcaggccgaacgaggccgccaccgccatcgagcgcttggcgagcagcacgtgccgccccttcagcatgtaccaggccgagacgccgagcacgaagatcgccgcggtcacatagccggccgagacggtgtgcacgaacttggcctgggcgaccgggttgaacagcacctcgaagaagttgtcgacctccatccgcatggtcgcggggttgaaggcggcgcccaccgggttctgcatccagccattggcgatcaggatccagagtgccgagaagttcgacccgatcgccaccgcccaggtggcgcagaggtgctgaaccttcgtcatccggtcccagccgaagaagaacaggccgacgaaggtggcttccaggaagaaggccatcagcccttcgatcgccagcggcgcgccgaagatgtcgccgacataatggctgtaatagctccagttcatgccaaactggaactccatggtgatgccggtcgcgaccccgagcacgaagttgatgccgaacagcgtgccccagaatttggtcatctggcgccagatcgcgcggccggtcatcacatagaccgtttccatgatcgcgatcacgactgacaggcccaaggtcaagggcacgaagaggaagtgataaagggcggtcagggcgaattgcagccgtgacagcgatacgacgtccagttccattcgaacaactcccgccggccggaccggcattatccttggccgcatccccgggggcggacgataccgtccggggtggtgcggctgtcgtcaatccgggcggagcctgtcgagcgccgcctggaatgccgtctcaccacgcctgagatcgccggtgatccgaccgtcttccaggatcagaagccggtcggccagggcggcctcccgccgcagatgcgtgacgacgagtatcgtctgcgtctgcggcaattccttgaccgttgtcaaaacgtcagcggccgtccgggcgtccagcccgtcggtcggctcgtcgagcagcagcagcggcgcgtcacgcaggaagatgcgcgccagcgccatccgccgccgctgcccggaagagagcccttctccgccctctcccagacgctggccgagccccgccttgtggtcgcggacaagctgccccagccccgcgcggtcgagtgcggccagcatgcggtctgatgtcgcagccgggtcggccagcagcagattgccggccagatcatcggcgaacagctcggtcgcctggccgagcaggctgtgcggcagcgcccggatccggccccgatcgggccggcgttcgcccgcgatcagctcgaccagggtcgatttgccggcaccgctcggccccagcagcgccacccgctcgccgcgggcgagcgcaagcgacagcccgtcgaagagcggcgcggtggcaccttcatgggcgaagcgcagatcctcgatcaccagcgccgagggtgccggcggcggatcggccgcgggcaggggcggtgcgggttcaggcgtgagcatgggcaaaagccggcgcgccgcgatgaccgtgcggcccaggtcgagcacgccgcggcgcagcgccgcgaaaggttccatcagtgccagcgacaccagcaccaccagcgccgcctgcggcaccgtcgcgatgccggcctggaccagcccgcccgccgcggcaaggctgccggccagcagcagcgcgctcgccgcaccgaagccggcggcggcggtggtgtccagccggttcagccggtcgtcggccagggccagccgggtttcggcgtcggcggcatggtcgcgcgcggccgcgatccgcccggtcatcagatggtcggtctggcccgccaccagatcgaccgtgcgcatgcgcagggcttcgagcgccgccgcccgccgccgggccggccggtcggcggcccgggccagcgcgagcggcagggcgatgccggtgaccgccacccccaaccccaccccgaccccaagccgggtatcgatcagcgcgagcgcgagcgccgcaagtgctgcggtgatcacggccgccgccgccggcagcagcacccgcagataaagattgtcgagggcatccacctccaccgtcagccggtggagcagtcttgccggccgggccttcagcgcccgggcgcgatcggggccggcatgggcgcggaacagccgctcgcgcaattcggccagcaggcccagcgtcgcgtcatggctcaccagccgctcgccatagcggccgccggtgcgcagcagcgccagcatgcggatgcccgccgccggccggaacacgtcaaaggcgagtgcggttgcagcggcacttcctgcggctgcggtggcggtgatgaaccagcccgagagcccaagcagcgccaccccggccagcacggtcagcgccgccagcgcgatgccgcccagcagcggcttgcggcgcatgcggaagaacagcgccgcggtgtcggcgagcgcccgcattctgccctgtccgtgccgtgtccggttcatgccgccccctccagccggatcacccggtcgagtgccgccgccaggtcgggatcatgtgtggccaccaccagggtgcggccggcggtggcctcgatcagggcggtgcgcacccgggcggcggtgtcgccgtccagatgcgcggtcggctcgtcggccagcacgatatcggcggcggggtcggcgatggcgcgggcgatcgccagccgcaccgcctcgccgcccgacagcccgaacccggcctcgcccacctggcgggcggggtcgacgcccggcagcagccgggcgagcggcgggccggcctccaccgccctgccaaagcggacattcgccatcaggctgccggcgatcatatgcggccgatggccgatccaggcgatccgccggcgcagatccgcccgggtcgatgcgtcgagcggcgtgccgccgatgatgatccgaccgccatcgggcagggccagcccggcgatcagcgccagaagggtggatttgcccgaacccgaagggccgaacagcgccacccgttcgccgggtgccacctccaggctgaagccctgggggatgccccggccgctcgccggatgggtgaaggaaagcccctgaagcgagagcgacggcgggccggagatggttgcctccgccggggagggggccggggccgggtctgcggcgggggccgtccccagcgccatgagcgcgtcatgcgccgcctcgcccgaggcgcggtcgtgccagaccgccgccagctcgcgcagcggctcgaaaaacgccggggcgagcagcagcacgaacaggccctgggccagccccatccgtccgccccaggcgccgaaattcaggtcgcccagcaggtggaagccgacatagaccgccaccatcgcaacccccagcgccgagaacaactccagcaccgccgaggacagaaaggcgatgcgcagcaccgccatggtccgctgccgcacgctttcggccgcggcgcgcaggcgcccggccgtcacctccaccgcatccagcgcccggatggtggaaagcccgcgcagccggtccatcagcaccgcgttcatggtgccgagttcggccagctgcgcctcgctcgccgccttggcgcggatgccgaccagggccatgaagaccgggatcagcggggccgccaccagcaggatcagcgccgccgcccaggatatcgaggccacagccacaagaagaacgaagggaacagtgacaaccttaagctgcaccggccggtagcgatgcagccagggcagcacggcttccgcctgttccgccaccaccgatgccgcagcccccgatgccgtccgacccgggtccagcgggtcgcgggcggccagcgccgccagggcctggcggcgcaactgccccacctccgcccgcgcggcccggaacaccatccgcgtgcccagcgcctccagccccgcccgcagcagccccagggccagaaccgccagggcggcgggcagcacggccgccgtcccggcatcatccgccagctgccccagcgtgcgggcgatgatccaggccatgggcagccagaccagggcggcggccagctgcaccaaacttccggtggttgtggcgcgcggaaaacgtctcgtccggtttcgcatatccgcctcgtggaatccttgacgtcaagggcaccacagattgatgcgacatggaagggggcatggctgcgacctcatgccccggcaggcgtgaccgctcacatccggcaagggattgctcctgccgacgattaattcaatcttcatcaaattgatgataaatgacccgaaacggcctagccgccacgccggcctgaatctttccgaaagggcgaattttggcgggaattataaacaaaacggtgtatggggggattctatgtttctgcgcaactggatgcggcgccgtctggccgtaaagatcgtcgtgccggtgctgctggtcctgaccctggggctgggcctgtcgacctggttcggcgtgtcgcgcagcggcgagaccatcgaacatctgagcgaaacggtggtcgaaggcgtggccggcgaggccaaggagcaggtcgccggcatcatcgacggcgccttcggcgtggcccggggtatcggtgccacggcggcgggcgcgatcgatgccggcaaggccgatcgcgaggccgttgtcgccatgctgaaactgttgctgcaggacaaccccaacctggtcggcacctggatcgcgtttgaacccgacgccttcgacggcgccgatgctgcccataaggaccagcccggccatgacgcgaccggccgtttcatcccctatgtgtcgcgcagcggcagcaccatcaatctcgaaccgctgatcgactacgagacgccgggggcgggcgactattatctgctggcgcgcaaaacccgtcgcgagcagatcatcgagccctatttctacgagattgccggcaagcaggagctgatcaccagcctggcggtgccggtggtgcgggatggccgggtgatcggcgtggccggcgtcgacctgaagctgccggtgctgaaccagatcctgggcgagatgaagcccttcggcaccggcagcgtgtcgctgatttcgaccggcgggctgtgggtcgcctatcacgacgcggcgcagctgggcaaggccgcggccgatctggagccggacctcgccgcggcgatcggccggtccgacggccgtccgatggccttcgaggcggcatcccaggcggtgaccggcacgcccgtgcaccggatcgtgctgcccgcccgcttcggcaaagtggaggcgccctggttcgtgaccgtcgacgtgcccgaggccgaaatcagcgcgccggtggtggagctgaccaacggcctggtcaccaccggcctggtggtggtggtggccatgggggtggtcgtggccctgctgatccagcgtctggccgcggccccggtcggccggctgaccgccgcggtgcgccggcttgccgccgacgagaccgatgtggtggtgccgctgaccgggcgtgccgacgagctgggcgtgatggcaggctcgatcgactatttcaaggaccggctggtcgaggtgaagcatctgcgcgaagagcaggaggcggccaaggaacgcgccgccgccgagcgccgggccgagatgatgcgcctggcggggtcgttcgaagccgcgatcgccggcgtggtcgacggtgtcgcgcgcgccgccggcgatcttcaggccaatgcgaccgagctgtccggcacggccgacgatgccagccgccagtcggcggcggtggcggcggcgaccggccaggcctcgtcgaacgtggccatggtcgcaggtgccggcgaggagctttcggcctcgatcgccgagatcagccgccaggtggcggaaagttcctccgtcacccggtctgcggtagaggacgccgaggccaccggccgcacggtcgagggcctggccgaggccgcccaccgcatcggcggcatcgttcagctgatcagcgacatcgccgcccagaccaatcttctggcgctgaacgccacgatcgaagcggcacgcgccggcgatgccggcaagggcttcgcggtggtggcgagcgaggtgaagagcctggccgaccagaccgcccgcgccacccaggacatctcggcccagatcgccggcatgcagcaggtgacgaagggggcgaccgaggcgatgacccagatccgcgccaccatcggccgcatcgacgaaatctccaccgccatcgcggcggcggtggaggaacagtcggccgccaccagcgacatctccaccaacgcccagcaggcggcccgcggcgtcgacgaggtctcgcgcagcgtgaccggcgtcagtcgggtggcctcggatgtcggcaccacggccggccgcgtgctggcggcctcgtccgatctctccacccagtcggatgcgctccgccgcgaggtgggggcgttcatcgagggggtgcggcgggcctagacctttaccccgtcaggtggcgccacctcctgacggggatctgctttgcccgccccttgcataccggccgggcggctggccgacatggcggctgaacgcgatgctgaacgtgctggccgagccatagccgacccgccgggccacctcgtcgagcggaaggtcccggcggcggagaaggtccctggcgacggccattcgccaggcgagcagatattccatcggcctctgtccgacgatgcgggtaaagcggtcgaagaaggccgagcgggacatgccggctgcgcgggcgaggtccgccaccgtccagtgccgttccagatcgccatggatctgccgcagggcatgcgcgatccgcagatccgccagtccgcgcagcaagccgggcggcatatccttccccggcattgcgcgcagcgcctcgatcagcaacaggtcgaccaggcgggtcagcaccagttcgcggccgggcctgtcgtgcgccgcctcgtcgcggatcagccgcaccagcaccgaaagctgcggcacgccgcgcaaatggagcatgcgcgggagaagcgacaccagcagcagggcgtcgggggactcgaagacgacatggcccccgaacagccggacgtccggcgcatcgccgtgccggccgtgccgacgctcctccgtcggcgccggtgccgcgtcgggcacgatcagcgtcggcgtcgcgggcagaaggcccgacatcgtgaaggcgggggttgcggggagaagcacgaaatcccccgcgtcgagggtgacggtatcctcgccctccacggccaggcggcaccggccctccatcaccacacagaagccgggccgcccgaaggcttcgtaacgcacggcccagggttccacgccggtgatccccttcgagaacagggcacggggacgcatgagcgtgatgatctgtgcgagggggtcgctcatttccggacggatgccaacgaaataccgacgcctgattgatgttggtcctgattgtcgagggtagatctgctgcgtcaacctcgaacacgggagtttcgcgatgaagaccgttctgatcaccggctgttcgtccggctatggccttgaaaccgcccaccgcttccacgccgagggctggagcgttgccgccaccatgcggactccgcaggacgggctgctgcccgcctccgaccgcatccgcgtgctgccgctggatgtcaccgatcccgacagcatccgatgggccatcgatgcggcggggccggtcgacgcgctggtcaacaatgcgggcatcggcatcgtgggggccttcgaggccacgccgatgctgcatatccgccggttgttcgagaccaacaccttcggcgtgctggcgatgacccaggccgtcattccgcagttccgcagccgccgatcgggggtgatcgtcaatgtgacctccagcgcgacgctcgccccgatgcctctggccgccgtctatactgccagcaaacaggctatccagggttttacggggtcgctcgcccatgaactggcggtcttcggcatccgcgtcaggctggtcgaaccgggctacgccccgtccacccgctttgctcagaacatcccgctgccggtcgacgcgcttgtccctgaggcctaccgggccttcgcggcccccgttttcgccggcttcgcgacgcctgcgatggtaacccgggaaagcgatgtggccgaagcggtctggcaggccgtcaacgacgtctcggaccggctgcattttccggccggcgccgacgccgtggcgcttgcccgggcggcctgccgggccgattgatcacctcttgcgcggccgcctattccggcggccccaccagcagcagccgggccggcgtttcggccgccgcctcgtgaatagtacccgccggcacgatcagatggtcgccggggccgagcagatgttcggccccgtccgtccgggcacggaggcggccgtccagcaccacgaccagctcgtcggcggctgcggcatggggcgggatggcgccatcgacccgggcctcgaccaccagcagcggcgcggtggccgggcccaggcggccggtgatccggccgtggaagccgggcatggtgatctcggcaccgatcgacgccggcatcgccggcttgcgggcggtgatcagatagccgacctgtcggacgggcttcacctcgcccgggatcaggccggcatcggccatccagccggccaggctgtccggcgcatccagacgcatgcgcgcggccaccgggccgaaccagcgtttcagcatcgccgcctggtcgggcggggtggtcacgatgccgagccgtccgccgggggccaggacccgggccatctcggcgatggccgcctgcggttccggaaaaaagaagaaggcgttgagcgaggtcaccagcgtgaaggcaccgtccgcgaagggcaggcgggccacatcgccctggtgcagctccagccggccggcggccagggctgcggcgttgcgccgccgggtttccgccaccatgtcggggctgtggtcgagcccggcggcagaggcgccccgcgccagcacccgttcaatgaagacgccgccgccgcagccgagatcgagcaggcggtccccgggccccggatgcagggcatccagcgtcatcgcgaaactggtctcgtgaccggcggggtggcggtagatcaaccggccgatcagcccgccgggacggcgggcgatgcgatcggtcagtcggtccatgaaggtcgcgctcatggggatatggccttgttgaggggcagggatcagggggcggatcagtcgtcgagccgtcgcagcgccgggcgggcgagcatggcgcgggtgacgacgaggcccgccagcccggcggcgagcacggcggccagcgcgccggcatagccggttccggcggcgatgccggtggcgacgccgccgctcagggtctcgcccgccacctgcgccgcctgggggatggtgacgtcggtgccggcctggttgccccgtgcggcgaagcgcatcatcagcgtggcggccgcggtggtggcggccccgccggcggtgccgagcaggatggatgccggcagcacgaccgccagatcgggggccaccagccccgccacgggcaacagccacaggccgagggcggcaagcgtgaggaccagggccgagacgagggtcgggccggtgccgtggcgcccgatcatccggactgccagcgggcagccgatcagaatcatcgccaggctgccggcgatgccgatgaggccgatccggtccagcgccatgccggcatcggtcagatagagcttcgagagcgcgagcccgcccgaatagggcagggcgaagccgatgccggcgatcagcaccggccaggcccccggccggcggaaataggcgcggagccgtgcccgcggccggtcgtggcgatcggggtccgccggcggttcggcccagcccagcaccggcagcagggcggcgagcagcagcccggccagaccggcgagtgccgcctgcacgccgagatggcccgaggcccagagcagccccgacccgccgagcatgaagcccgccatcatgccgccgctctgcagcgcattggcgcgggtgagccggccgccatgcagccgttccgccgcaagcccgtcggtggcggtatcctgggtggccgaggcgatcgaggcgatcagcgtcagcaccaccaccggcagggccgccgcctgccagtcggcgatcatggcgaggcccgccatggccgcggccaggatcagctgcatggggatgatccaggcgcgcctgcggccgaggcgccggccgcccctgttgtccaccagcggcgcccagagcggtttcagcacccaggggagccctgcgagcgatacccaggcgatcatctccagcggcacgccggcccggcgcagcagcaccggcagggcttcgaaggcgaagccgatcggcaggccctgcgcgatgtagagcgcgccgatcagcagcaggcccggggccgtgtgcggctcagcggtggcggaggtcgtggttgtggcctgaccggtcatggcgctcaccaccgcccggtcagggtcaggcccaggctgcggccgcgcccggcgacgccgacatcgctgccgcccatgtcgtaataataggtcagatattcttcgtcgaagaggttgcgggcccagagcgtcgccgcccaggcgccggtatcgaagccgatccggccgtcgaccagatgggtttcgccctggcgataatccgaggcgggggtgaagctcatcgacgagcgccaggaatagtcgacgcctgccaccagatcgacccccggcgccaccggccggttgaggtccagccccagcgccagggtgtgttccggggcatagggcaggtcctgccccgaataatccgccccctggatgctgtcgacgaaatcgtcgaaatgcgcgttcagatagccataggccaggcgcagccccagaccttcggcgatctgcgcccgggcctcgatctcggcaccttccgaggtggagcgggcggcattgcgcagcacccgggtcagcgggctggtgtagatcaccacctgctgatccttccagtcattgcggaacagggtgaggtcgatcgccagccggtcgtcgagccacagggtcttggcgccgatctcgaaggtggtgacggtttccgggtcgtagcggttgatgctgccgtccagctccggataggggctgatgccgccggatttgaagccgcgggcgacgcgggcgaaggtggtgatgccgtgcgccaccggccgccagcggatcgtcatctcgggcgagacgtcgtcgaaatcggcatcacccgacacccgcatcggcgcgcccatcatcatattgcccgaggggctggtgatctccgacgtggtgtctttccattcgcgggtataacgcagcccggccgtcacatcgaccgagggcagcacctgcacccgtgcctcgccgaaggccgaggcggtgtcggtggtctggtcgaagccgctgcggctccagtcggcgcggggcacggtggtaaaatcgtagaactgcgccgccttgaaatcctcgcgcatgtagaacagccccgtgctccagccgaagcggcggccgtcctcggggctggacaggcggagttcctgcgagacctggcgctgttcctcggtctgggcctgaacgtaatagggcagggccatgaaatcgccgtcgagcacatggtccaggtcatggccgcggatcgcggtcaccgaactcagcaccaccgcaccgaaatcatgggtcagcttcgccgacaggccggcggtgtccaggctgcgttcgccctcggtatcgtgggtggagcggtggtcgaaggcgagcggcaggggggcataggcgagcccgccatcatcgcgatcacgtgacagatccgcccggatcatcacctcggtcgcatcatccagcatgccaccgatcgcgagtttcgccgccatgcggtcggtgcggcccaggcgatttcccgacgcatcgtcgcggatgaagccgtcatcgcgggtgaggccgatcatggcccgcaccgccagatcggcggccgcacccgcctcacccagcggcgtgtcgagcacaccctgcatctccagccgccggtcgctacccaggccggccgtggcggtgatccccggatcggcgcccggcaccggcgagaccagattgaccgcgccgccgatggtgttcttgccgtagagcgtcgactgcgcgccgcgcaccacctccacccggtccagatcctgaaacgcggtcggatagccgttgggccgggcgatatagacgtcgtcgacgaacaggccgacaccgggctggcggtccaccccgccgctcatgcccagagagccgatgccgcgaatggtcagcggtccgccctgggggctgtaggtggcgttgggcacggcccgcgcggcatcgtccagatcgcgcacccccgcctcgcccagccggtcggctgcgatgacggtgacggcgaccggcgcgtcgcccgcctgctccgcccggcggcgggcggtgacggtcagcggttccagggtgacggcgccgccggtcgcagcctcgctcgccacctcttccgccagagccggggccggcatcaacggcagggcggccgcaagggccgcgctggtcagcaggcggcgggccaggagggggcgggccaggagggggcgtctcggaagggggcgcgtcgggatggggcgtgtgagggcaggcggcatcggcgaggtcatggctggcatcccgcaggtcatatgcgaatgagacgcattaacgaccatatggctgccgaaatccatggcgccggctttcgcgatccggactcagtcttgcgcgttttgtccgccgccggccggcgcctgccgcgggcggtcagcgcctgccgcaggcggcgccgggcggcaggccgtggcgcttgcggaaggcggtggagaaatgggccgggctgtagcccacccgccaggcggcctcggcgatgcccagcccctcgtcctcgatcagccggcgggcctcgtccaggcggcggttcttgacgaaggcatagaccgggctgccgaacagggcctgaaagccgcggcccagcttgcgggcgttgaggccgaccgcgcgggcgagatcgggcaccgggggcggggcggccaggtcgcgcagcagcaggtcccgcgcggcgtgcagccgctcgatatcgccgggggaaaggaccacgtcgccgcgggaacgggccacggcatcacgtccggaaccggtgccgccggcatcgcccgcctcgaccacatggcccagcagatgcagggctgccgcggtcagatgcagccgccgcgccgtgcccgtgccggtcgtgccgagcatccgccagaccagccccatggaaaccggcacgctggccgcttcccgcccggccccgccggccagccgcgcgccatcgggccccagcagatcctccaccgcctcgggcagcacgcgcaggaacaccccggcaatggtgccgtcggcccgggcggtatgccggctctcgaacccgcgggcggcccagaaccgcgccgccatccccggcacccagtcggccggcgccgccggctcatccgcctctccggccccgccgaccgccacccgcccggccgccagcgtccccagccacaacccgggcgccacgaccgacgaccagcactcgccctgccggatccggctgcgatagaggtaaatctccagcccggccgcggtgacggtttccatcctggggccttttctgggaggggagggatccggggatgatggggagggtaggggtggggtgtcaatctggatgaagagcggccccgcttccgggtgatccgctcaacgcctgaacaagactgcgggcaatgccgggcagtgcggcggtctccagcctggcagctgccgcatcgacggccaggagatcatcgtcgagcagatggtcgaacttgttttgaatcttgttgccgatccgttgcgccaggatcagcggatccggtggcggagcgtcggcgatccggcatagcgccttcagcacattcccggggtcggcgcgcagatcgagcgcgacgccgtcaccggtccctcgaatgccttcggcatcgagtgcgagcagcagtgccaacgcccggcaggcggcccgcggcgtcgccaaccacgacccgggcgccaccaccgacaaccagcactggctttgccggattcggctgcgatagagataagcctccatcctgagatcttcgttgaaggatcgatcccgggactatggggagggggggcaatcgatatggtctggtagttctccggtcctgaggtactggccctcccagaacatgagcttgtcgagcaggcggcgggcgatgaattcgtcggagatgttcccactgcgggacaaagggccctcacggcgccgcaattcatcgatcagcccggcagttgcggtctggaaatcctggcgctggttttcgagggcgaagtggacggtacaggcgctatggtaggtgggatagctggccgtgccgcgcctgagaatcacctgatcatcctgtgacaggaggcctgggttctctagttcaattcgccgtcgcgcccgggcggccctgcgcgccatggtgtcccaaatgaatatgcaaagatttggccaggaaaatacggcgatcttactggcagctgagatgtggctccggttttgcgcgtcggcctcttgtaaggccttcgccagcgactctatcaaattatttgggtctgcatctccatatttggactgacggaagtccataatgactttggcaacagccgcataattccaggttcctgtccgggcaagtcggaaggtcacaaggaaaagacgtgcatcgctctcgctaatttcatatctcgatgtcgaactgaagatggtcaaccagtactgatccgatgggaagcgaccaatgttgataccaggagcggcgcaccacttgagtacatctttacgagccatttccaataaacgagaccgtaaagttccacacaggaaattcggttccatgatcgtcctccaataattttggttggaattcgcccgagacgttggctggtttcctgctccttgcgattctccgcatcataattcggatcatcgcgaggcggaggactgccagagccatccgaagggccgttcgatgatcctgcgtttgggcaggatctgaaagccgtttgcggtagccgccatcggtgaagatgcgctcgatgaaggggaacaggcggcggatctccgtcagcaccgacaatgcaccgtcccgatcctggatgtcggcaggcgggatcagcggctccaccggcgaccattcttcatcagcccgccccgcgcatggggcttatgaacggaatgccggcgaagtccttctcgttgtccgtcaccaccagacagtcattggcgcgggcggtggcggcgatgatcatgtcgagaccgcttcctggcctgccggcggccttgccctcggccatcaggtgggcccagatgaggccggctttgtcgtcgaagggcaggacgcgaccggcgaacagcgactgcggtccctcggggccggcaaaccaggcctcaagggcgtcacgcttcctgccgcggggtttttccagaatgccgcgacggatttcggcgatcgtcagcgaagagatgaacagatcgtcgtcccgctgttccgcccaccaggcgagcaacagctccgagggctctggcttgacgacattgctgatgatgttggtatcgagaagatagcgcgtcacagcctgaccttgcgcccgtcttcgcgcgggcgggcaaggtcgagatcggcgccgacgaggggcgatctgcgaagagcagccaggatgccgcctttcccgggcgtgtcaccggagagggcctggccgaccatcgcgcgcagtctggacgcatcggcgccatcctcggccagacggcgcgccagcgcacggatgagatcgcgatccatgtcgcgcccgagcacttcgaagcgcgccagacctctctcgctcaatcgggaccggtagttctgaacggcgcgcttctgcgagtttcccatcggcgtctcccctgcgctcccctgtaatatatccggtaagtcgcggagggacaaggcggaggggcgcgcggcttgaggcagccccctccgttcaggtcgtaccggcggggcccctcacagatgccccacccactccgcccgcgccttcagcgcctcggcatagcgccggccgatccgggcgatccgctcgggtgcgaagttctgctgggcgagcgccatgccgcggtcgaagacttcggaatagcggcggatcaggccgtccggtgacaggtccagccaggcgatgccgtcgaagcagacgcgggtgccggcggcttccggggcggtggatcgatagctgaagcgatagcgggcacaggcgcggccggggccggccagcacgtcgtggaactgccagcggaaatcgcggccgcccttgtagaagcccgccaggatatgggcgatgccgtcggggccctgttcggggccgaagaaatagtcgtcatagatgccgtcgggggtgaagcaggcggcgagcgccgcggcgtcgttcgcctcgacggcggcggcgaagcgggtgagcagggcttcggtggcggtggcggtggcggggtcggttgcggtggtcatgggggcggtcctcccggggcggcgctcatgatccggcgccgtgtcatccgccagtatgcccgccgtcggctctctgcgtcacctcgtcgtctgccgccgcgaagcgacggtggaacaggtcccaggaaggctggccgatggcggcaatgcgggcggtggccgtctctatggcggcctgatcgccggccccggccgccgcctgcagggcctgccccgcctgcatcagcgcggtcagcccgcaattgccggcgacggagatcatgtcgtggcccagccggcgcaaccggtcctgatcgccgatcgtgagggcggcggccacctcactgagctgctggcggccggtcgattcgaagctcaccaccatcgaggccagcgtttcggccgagatgatgccgcggagcgtggtcatcggcgcctcgtccagaaggtctgacatgtcgtcggccgccgccgccgccgcgggcggcgggggcgcgatgctggcggttatgggagcgacccggtccctccacgccgtccagcgggcggccatggccagcagcttttcggcgcggaagggcttgggcacgaagtcgtccatgccggcggccatgtattcctcgcgcatgccggccatggcgttggcggtcatggcgacgatcggcgtccgcggccggccgctctctgcctcggcggtacggatgcggcgggtcgcctccatcccgtccatcaccggcatctgcacatccatgaacaccaggtcgaaatcatcggcccggcaggcctcgatcgcctcggcgccgttttcgaccaccgccacccgatagccctgtttttccagaatggtcgaggcgaccgcctggttgacggtgttgtcctcgaccagcagcacacggcgcccggccgtgaggggggcggatggcggcgcctcggccgatgccgccggcggcggcgacaggccgaagctgcgggcaagggccgtgatcagctccccccgccggatcggcttggtgatcaccgcgtcgaagacccgcgccgcctcggccgagggcggggaggaggcggccaggatcgtgcgcaccgtctgaaaccgtggatgcagcctgagccaggtgccgaggatcgcaccatccatgccccccagattgagatcggtgacgaccagatccaccggcgtgccggtctgggcggccttttccagcaggtgcaggctttcggcgacgtcggtggcctcgctgatctccatgcccagctctcccaggtgatgggccagaacccggcggttgagcggcagatcgtcgacgatcagcgcccgccgcccgcgcaatccggcctccagcccctcgccgccctccgggggtgcgggcagcgtcgtccgctccagcgggacctcgaagcggaagaccgatccccggccgggctcgctgtcgaccgagatcgtgccgcccatcagctcgaccagtttcaggcagatgacaagccccagccccgagccgccgaagcggcgggtgatcgaggcgtcggcctgggcgaatttatggaacagctttgcggtctggtcggcgctcatgccgatgccggtatcgcgcacctcgaacagcaggcgccggtggtcggttcctggccggtcggcccctccggaccggccttcgcaatcttcgccactttcgttgccaacatcttcgcaatcttcgcaagccaccggacccaggtcgcgcacggtgacggcgacatggccgcgttcggtgaatttcaccgcattgccggccaggttgagcaggatctgcctgagccgcgtgggatcgcccagccagccggtgccggtgtcgggttcggccatgcaggcgatctcgatgcccttatcgcgggcccggggcgccaggatcgcggcgacgccatccagcagcccggtcagatcgaagggcaggtgttccagctcgaccctgtcggcctcaagcttcgagatgtcgaggatgtcgtcgatcaccaccagcagggcttcggcgctgtcgcgcacggtttcggcatagccgcgctgctcgtcgtcgagcggggtgccgagcaggatctgggtcatgcccatcacgccgttcatcggcgtgcggatctcgtggctcatattggccaggaagtcggatttggcctggcttgcggtctcggccatgaccttcgcccgttccagcgccgtggcgagcgaggcgagttcgctggcctggcgttccagctgcgcattggcctcgcgcagttcgacgatcgcccggttgcggatggtgagatctgtgatcgcgccgacgaacatccggccctgatcggtgacgaactcacccaccgacaattcgatcgggaagctgctgccatcctggcgccttccctgcagctcgcggccgatgccgatgatcctgggcgggctgccggccacatagcgggcgacatagccgtcatgggcggcagccagttccggatccatcagcatggccacgttctgcccgatcatccgatcggccggccagccgaacagccgctcggtggcggcattgaccatggccatgcggccgtctgcgccgatcaccacgatgccaacgcccagcgtgccgaacagcgcctgcagccgggcctcgctctcgcgcagctgtgcttcgccgcgccggatttcggtgacgtcggagaaggtcaccgcgcagccctcgcccagccgcaccgcctgaacgcggaaccagcggtcgccgctctcccgccgggcggcatggtcgaacagggccggctcgccgctgtcgaccaccgcggcatagcgcgccaccagttcgggcccctcgcggctgcgcagcgtcttcagcgtgttgccgatcgccttgtcgagcggcacgccggtcttgcggacgaaggcggcattggccatgacgatgcggaaatcgtcgatccgtcccgcctcgtcgcggacgggttcaatggtcatgatcgcgttcagcgaggcatgcattatgcccgacagcatgtcgcgggcgcggacgatttcggccgcgtgcccgcgctcttcggtcacgtcggcgcagctcgtcaccagcccgccgcgctgcatgcgcctgacccgggtttcgatcacccggccgtcttcatgggtcgtctcgaagggctcggtcaggatggcgtcgtcggcggcgatcagatcgcgcagccgggccagatcggccgccgtcccccgggcgcaggcgatctccaccacgcccagatcctggcccacgaccagccggcccggggcgatgccgtgcagatcctcgaaccgggcattccaggccagcagctgcagatcggggccgaaggcggcaatgccgttgtcgatggtctgcaacacggcatccagcagcgcctcgcgctcggcaagcgcggccttggcctgcatctgctcggtcaggtcgcggccggatccgcggaagccgcggaagttgccggcatcgtccaggatcggctcgccgttcatctccacatggcgcagccggcccacaccgtcgaagatgtcgtagcagaggttgcggaaggaccgccgcccggccagggcctcggcataggcccggaagcccggctgcgcggtatccgccaccagttcgcgccgggtgcggcccaggatctgcgccgggtccaggccgattttcagcacccccggcgacatggcggtgaagcgcccgtcggcatcggtttcccagtaccagtccgatgacagctcggtcagtgccttgaaccggatctcgcgttcggccagctcggccgtgcgggccgccacctggcgctccagatcggccgccatgcgctgcgatgcctgcgccgacaggcgctgacgctccagccgcgccagatgcatctgcaacagcgccgcgagcagcagcgcgatgacgctcagcgccagcgtggtgtagagcggatgggccaggttcagcgacgcgacgaagggcgcgcccgcgccgatggtcaccagccagttgcggtcgaaaacccggatcggcagggtttcggtcagcacctgactggtggcgaaaccggcgctgcggtgaaatgcctcggcctcggggtcgtcggtgacgtcgcggatcgacagctccaccggcctgtcgtcgtggccggtcccggccagaacatcgtcgatcaccagcggcgcataagtccagccggtggtggcggccatccgttcggcgacggtgccgagcggcatgcccggccgatagaccggcagcagcagcaggaaaccgcgatcgcgggcgcccgtcgcctggaccagggtgatcggcgcggtcagcgcagcctcgccgctgatcatcgccgcccgcgcggcgccggcgcgggagatttccgaggcgatatccagtcccgccgcgccggcattcggggctgtgggctcgatatagcggatgatccagctttcgccctcatgcgcggtcaggcggcggatggcgaaatcgggccggccgtcggcacgctcacgcgcgatgaaggactgttcctcgcccgggcgcagccgggtgatgaccccgaagcccagcgcgccgggaaattcccgggcgatgtcgcggctggcggcataggttctgaaggcggccagcgtcatgtcgcggtcgccgcccaccagcagggcgccgcgggccccctgcagcccgtattcataggtgtggatgcggtcggcgatgcgacccgccatatcggttgcggtcaggcggaaccggttgccgatcaccgtctgattggtctgatgctgccagaccccgcccagtaccgccgcgaccagccccaggatcaggagcagcgccgcagccggatacggccgcgcgctgcggccgggccgggcggatccggacaatgggggcgtctcccgcggggcgggatctggctgttcagtggcgttgtgcacgcgcgggattccggctgttggatcggctctgttttgcaaagtgtagatccgaaacgtcacaaagtccttaacggcccgccagatgaagaatacctctccgggtattcagtcatgatgtggggtaagggcagatacttagttttcatatatttgaagaaccatgcagtgatcatgcgggtgcgcgggttattcatgcgcatgcaggcggctcccggcgggcttgcatttcgcggcgcagcacgataaaccaggatcatgctgcaacgcggcagccggcatccgtcttcaggatgtgcccctcttcggaatgtagcctgcgaccgatgtagacccggaccggtaccgcccgagactgacgtggcccgcccgcctggcttccgcccggccgcggggcctgctcgtgcgtatcgttgttccctggtccatcgcgccccgcggccccgaacccccctctcatcttccgcaagaatcatcttccgcaagaaactgtcccgaccgcgtcgccggccgcccggctgccgcagtcgcaaaccgtccggagacgtccgtcttgaccacgcaatcctccccatcggctggcccgcgcggccggcttcgcgccgaatggttcggcaatatccgcggcgacctgctttcgggcctggtggtcgcgctggcgctgatccccgaagcgatcgccttttcgatcatcgccggcgtcgaccccaagatcgggctctacgcctcgttctcgatcgccgtcgtcaccgccatcgccggcggccggccgggcatgatctcggctgcgaccgccgcgaccgccgtgctgatgggctcgctggtccgcgatcacgggctcgattatctgctggccgccaccgtgctcgccggcctgctccagatcctggccgggctgctccgcttcgactatgtgatgcggttcgtgtcgaactcggtgatgaccggcttcgtgaacgcactcgccatcctgatcttcatggcccagctgccggaactgatcggcgtgccctggatcacctatccgatggtcgcggccgggctcgccatcatctatctcttcccccatctcacccgcgcggtgccctcgccgctggtctgcatcgtggtgctgacggtggtggcgctgtcgatggggctggagctgcgcaccgtgggcgatatgggcgagctgccctccagctggccggccttcctgatccccgacgtgccgctgacgctggaaacgctgaagatcatcctgccctattcggccggcgtcgccgcggtcggcctgctcgaaagcctgatgaccgcccgcatcgtcgacgagatgaccgacaccagcggcagccgccgccgggaatgcttcggccagggcctggccaacacggtcacgggctttctgggcggcatggccggctgcgcgatgatcggccagtcggtgatcaacgtgaaatccggcggccgcggccggctgtcctgcttctgcgccggtgtgttcctgctgttcctgatcgtcgttaccggcgatctggtggcgcagatcccgatggcggcgctggtcgcgatcatgatcatggtctcggtcggcaccttccgctggtcgtcgctgaaggaactggccacccatccgcgggtgtcgagcctggtgatgctggcgaccgtggtgacggtgatcgccacccataatctggcgatcggggtgggcgtgggcgtgctgctctcgggcctgttctttgcctggaagatttcgcgcatcgtgcgggtgacctcgacgctgtcggaagacggccgcacccgcacctatctggtcgaaggccaggtcttcttcgcctcggccgagattttccagtccggcttcgataccaaagaggatctggagcgggcggtgatcgacgtctcccgcgcccatatctgggacatttccagcgtcgcggcgcttgatgccgtggtgctgaaattccgccgccacggcacccgcgtcgacatcctgggcctgaacgaggccagcgcctcgatcgtcgaccggctggcgctgcacgacaagccgggtgcggccgggcggccggcggggcattgacggtggggcattgacggaggccgggcggcccgccgcggccgcccggcccgatcacccgccgccgaccgatcaagggcgacgtgaggcgggctgcacggaatcgacagggagtgcagatcggtaccagagttggaaaaacggagggatccgatccttacggaaagagagggacgaccgtcatggcgggtgcagtcaaacgctctatcggtctgtctccgcagcgcgcggccttcgtcgaccggttgctcgccacgggcgcctatgccgatgtggatgaggtgatcgatgcagggctccgcgccctgcaagatcaggatgcagagatcgagcgccggctgcgagaggatgttgccccggtctatgatgccgtcgaagcggatcctggccgcgtcatccctgttgatgacgccttcgatcgtctgcgcgccttgcatgccagttgcgtgaaggccggcaagtgagccgtggcgttgccctcgcgggccttcaccctggtcgatgcagggaccgcctccgcagacccaccacaaatctgcccccgtctcgcccgcgaaccccaagctcccgtgaaaatcccgggaggttcgcgaaaagaaattgtcccgtttttcaattggttaaatttcacaatttattcatgttcatactatggaatgacttccagaagaggttcgcgcggatcgcctttttccggcccccgattcaggctattaagagggggtgggtcgcacccttgcgggtgcgtggattgaaacgcggggcaccggtacagcgtggaagcccgcgcgagtcgcacccttgcgggtgcgtggattgaaaccggatcagtgccccgggggcggcggcgctgacccgtcgcacccttgcgggtgcgtggattgaaacgaaatcgactttgtcgaggtggcgcgatctggcgtcgcacccttgcgggtgcgtggattgaaaccgccaaaacgcgcgtctgacgattcaccgtggcgtcgcacccttgcgggtgcgtggattgaaaccctgagtgtgtaaccgcactcacgaatcaaatcgtcgcacccttgcgggtgcgtggattgaaaccactggagcccggcgacgctcaaaaaaaccttcgggtcgcacccttgcgggtgcgtggattgaaacacgcccgaggccgatcctggcgatggtgccgccggtcgcacccttgcgggtgcgtggattgaaactggccatcgccgcggccctggaagcggagggccgtcgcacccttgcgggtgcgtggattgaaaccgtacttccggaacggcgaggccgtgaacgtaaagtcgcacccttgcgggtgcgtggattgaaacagctgccgcggcgcccgcgcccggaccatcccgtgtcgcacccttgcgggtgcgtggattgaaactggttggttgatgtcaggctgcatcaggggtctcgtcgcacccttgcgggtgcgtggattgaaacgcggcgcgctcgaccaggtattccatagccgcggacgtcgcacccttgcgggtgcgtggattgaaacgacgcctgcgtggccttcgcaggtcacgatctggtcgcacccttgcgggtgcgtggattgaaaccatgcccacgatattcgcgcgagcaggcgggcgcgtcgcacccttgcgggtgcgtggattgaaaccgggtcggatcttggctggaggaggcttcctgatggtcgcacccttgcgggtgcgtggattgaaacgactcggacgcactggccgccgcggaggacaaccgtcgcacccttgcgggtgcgtggattgaaaccgtcggcgtcggcgaaggcggacatcaagcccgagtcgcacccttgcgggtgcgtggattgaaacacggccgagcgcccaagctatgccgagcgacgcacgtcgcacccttgcgggtgcgtggattgaaacacggcatcggatttgatgccgtcgaaaggagcggtcgcacccttgcgggtgcgtggattgaaacttcggctgcccgacggcacgccgtgcaccacggtcgcacccttgcgggtgcgtggattgaaaccgaggccgagaccgtatggatcggcgccatcgcctcggctttcccggctcatcgaccccgggtcacccccttctcccgccccatcttcacccgccccacccgccgcaccaccgccggcgtctccaccagccccggcaggggggccggcatgcggcggcgccagttggggtgttcgtggatggtgccgggcaggttgggctggtcgtccagcccgaccaggtcttccagcggggccagcaccaggggggcgcggctgcggcccaggaagtcgagggccgcgtcgatcaccggggcgggcgtgtcgggggcgggttcggggccggtggcggtgccggcattggtgaaggcggtccagagccgggtgcggtcgcgggtgcgggtctcctgcgccagtgccgcggtctcaccgggcccgaacagcgagaggcgctcgcgccaggcgatgtcgagcccctgccaccagccggcggtggtcggcaggtcgtgggtggtggtggtggcggtgatgccgtcctcccaggcctccggggcgcggaaaccgtccgtcccgtcgcgttcgaaccacagcacccgggtgcccatcaacccgcgggcggccagcaccgcgcggaagccgtcgggcaccgtgcccagatcctcgccgatcaccaccgcccggcggcgctgcgagacatccgccaccacatccagcatctccgccagcggatagcgcagataggcgccttcggccggtgacgcgccgtcggggatcagccagagccgcatcagccccagaacatggtcgatgcggatgccgccggcggcggcgagggtcgcgtccagcatctggcggaagccggcgcaaccggtttccagcatcacccgcggcgacggcgccgccagcccccagttctggcccagcgggttgaacagatcgggcggcgcgccgatgctcgccccggtcaggatacccgccccgttcagatcgccggcgcgctcgctccacgactgcgcgccgctgccgtcgacaccgatggcgaggtcggcgatcagccccacccccatcccggcatcggtggccgccctctgcgccccggccaggccgcggaaggcgagccattgccgcagccgcgcccgatccaccgcctccgccgcgcttttggccatattggccacagatgagccatgtggatcgcgaaagtcttgtggccaggatggccatccgccggtcagcccctgctcccgaaaccgggcatccagcacctcgaagaccgcatgatcgtccagcgcgcggccgcgtgcggcccggaaggcctgccagtcggcatcggcggcaagccgggcgccatgggccttcagcagatggtcgatcaccgcccgtttgaccgccgccacctcgggccagtccaccagcggcgccgccgcggcggcacgggcgcgcgccgcaagccccagcgtctccagcgcccgcgcggtctccgcggggccggcgatgtcgtcggggtcgatgatcagctcgttcaggaacagccggctggacggggcataagggctccagcgatgcggatcggcgccgaacagggcatggaccgggctcacccccaggcagcaggccccggctttgcccaggctgcgggcgagcccggccagcgcggtggtatcgccgcagcccggatcgcccgatcgccgcagcccgtaaagctgcgccgtcgccccccaggcccgcggaggccggccgggctggcccagggccgcgtccaggccgaagcagcgcgggcccattgccgcatccggccgcggcggcggcaaagcggccgcccgctccaggctctcgcggatctgtgccgggctgtcggccggcaggtccagcaccgccagcagcgcgcgcagcgtgtcgggggtcacactgtgtccctggcccgcggcatcggtccagctggtggcgatgccggcggcggcggccagggcctgcaactgttgattaaaatcattaccgcctgtggttgcagattgatcggttgtggctcggttaattatagtccttccggttgtattcgggctcatggctcgggctccctcagcaccgccgcggtggtcatgggcgcaagcgcgcccgtctccagcgcctcgattgcctcagggggcacgaacagccagcggccctcgggctttccgtccagcggcaccgggctgccgtccagattgcagaacagggtcagcacggcgccgtcgcccagccgccaggcggcgcgcaccgccttgggaccgatggccgccgccccctcggacacggccccctccagccgcggcacgatctcgcgctgtcggagcgcgatcagcccggcaaccagggcggcccgggcgcggcccggctcacgcgccgcctcgtccgcttcggtccgcgaggtctcgaaggtcagcgccgcattggggtcggggatgcgggcccgggcctgatcgtcggcgaaccgctcgaaccgggcgaattcccgccgccggccctcgcgcaccagcggtgccagttcgtcgtgatgatcggtgaagaacaggaagggccgggtgctgccccaatcctcgcccatgaacatcagcgggatggcgggtgcgagcaggatcagcgcggtcgccgccgccaccgccgccaccggcgccaggctggtcagccgctcgccgaaggcgcggttgccgatctggtcgtggttctgcaggaagttgacgaaggcggtgggcggcagatggccgctcggctcgccccgcctctcgccgccgcgataaggcgacggatcgccctgatagacgaacccctcggccagcgcccgggccagacgctccgccggcgcctcggcataatcggcgtaatagccgtcggtctcgccggtcagcagcacatgcatcacgtggtgcatgtcgtcgttccactgcgcgtcataaagccccggtgccaaatggcgggcggcattgccgtcatgttccagcaccagatggatatggcggccgggctcggtttcgctccggatccgggcggcggtctcgtccagccagtcgggatcggggatcgcatggacggcatcgaagcgcagcccgtcgaagcggtattcgttcagccagtagagcgcgttctccgtgaaatggcggcgcacctccggccggcggaaatcgatcgcctcgccccagggggtctcgatgtcggtgcggaagaagccgccggcatagccgtggatatagttcccgtccggcccgaaatggttatagaccacgtccaggaacaccatcagccccagcccgtgggcggtgtcgatcagggtcttcagctcttcggggctgccataggcatggtcgggggcatagggcagcacgccgtcatagccccagttgcgggcgccggggaaatcattcaccggcatcagctcgatggcggtgaagccgcgggccgcaatctcggccaggcggcgggtgacgccggcaaagccctcccacaacccggcatgtacttccaggatcaccgcctcgcgccagggccggccgcgccagtcgccatggcgccagaggaaggcttcggggtcgatcacttccgacggaccgtggacatcctcgggctggaaacgcgacaccgggtcgggcaccaccagatcctcgcccatgccatagcgatagcgggtgcccgcgccgcattcgaccgtcgcctcgtgccagccttcgcccagtgccagcatgtcgatcggatcgcgcccctcgatcagcagccgcacccggccatgatccggcgcccagatccggaaccgggtccgccccgacccgaccggttcggcaccggccgacagtggctgatggaagcggcggcccggtggcggatcggccggcagggatgccgccagcacttgcaggctgcgggcccgcaccgtcacccggccgccggtcagcggcacctcgtcggtctcgccgtcgcttgtgtccagaatgcgggtccaggccaggccgtggcgggcaagcgggcgcagcggcaggatgaaatcctgatcctcggccccggtgttgaacagggtcagcacgacgtcgagcagttggtccggcgcccgatccgacggacctatatccgatgggcctgtgcggaccagcgccagcgcccgggtggccgggtcgttccaggtttcggccggcaccggcccgccatcgaccccgaaccaggcgatatcggccagatcgaaggcatagcgccggtcgccatgcagaaagcggcggtcgcgcagcaccgcgaagcgccgccttgcggccgccacagcggcggtgaaccgggtcagcgccgcgccctcgggccgttgcagcgccgcccaatccacccaggatatttcgttgtcctgggcataggcgttgttgttgccctgctggctgcggccgaattcgtcgccggccagcagcatcggcgtgccctgcgacagcagcagggtggcgatcatcgcccgttgcagccgggcacgggtgtccaggatcgccgggtcgtcggtctcgccctcgacgccccaattcgccgacaggttgtcgccatgcccgtcgcggttgtcctcgccattggcctcgttgtgcttctcggcataggacaccaggtcgcgcagggtgaagccgtcatgggcggtgatgaagttgaccgatgcctgggcgccgcgatggcggtggtcgaagatgtcgcccgatccggccagcaccgcggcaaagccgggcaggctgccgtcgtcgccgcgccagctgcggcgcaccgtgtcgcgatagcggtcgttccattccgaaaacccgggcgggtgattgcccagctgatagccgccgggcccgatatcccagggttccgagatcagcttgacgcgtgacagcaccgggtcctgcaggatggcgtcgaagaaccccgacccggggtcgaaaccggtgccttcgcggccgagcgtcacccccagatcgaagcggaagccgtcgacatgatagacctccacccagtggcgcagggaatccagcaccatctgcagcacgcggggatgcgacaggttcagcgtgttgccgcagccggtgtcgttgatgcaatagcgttcctcgcccggcaccagccggtaatagctggcattgtccagcccgcggaaggagagcgtcggtccaagctcgctgccctcggcggtgtggttatagaccacgtccaggatcacctcgatcccggcggcgtgcagccggcgcaccgcgactttcacctcgtccagctcggccgtcgacagatagccgggttcgggggcgaaaaagccgatgctgttatagccccagtaatttctcaggccccggtcgaccagatggcggtcctgcacgaaggcatggacgggcagcagctccacggcggtcacgcccagccgtagcagatggtccacgaagcgcggatcggcgagggcggcgaaggtgccgcgctcatgcgggcggatgtcgtcgcgccgcatgctgatgccgcgcagatgggtctcgtagatcagggtctcggtccagggcacctccgggcggcgatcgtcgccccagtcgaaggcatccaccgtcaccaccgccttgggcatggccggcgcgctgtcgcggcggtcgaacgacagatcgcgccgggctgagcgtgtgctgtagccgaacagatgatccgaccagcgcagccgcccggcgatccgccgggcataggggtcgagcagcagcttgttcgggttgaagcgatggccgcgcagcggctcgtaggggccatgggcgcgatagccatagaccagccccggcccggcatcgggcagatagccgtgccagacctcgtcggtacacgccggcagcggcatgcaggcgatctgccggcggccctgccggtcgaacagacacagatccacccggctggcattggccgagaacacggcaaaattgacgcccagcccgtcccagcgcgcaccgagcggccagggacgtccgggaaacaggcgatcggccgggatgggcatggggtggaactaccttccctgtctcaacatcagtgtggaaagcggcggcagcgtcagggtgagagaggcgggccggccatgcgccggggtttccaccgccagcgcccggccgccattgcccaggcccgaaccgccataggcggtggcgtcggtgttcagcacctcgtgccagatgccgggggccggaaccccgatacgatagccctcgcgcgggaccggggtcagattggcgaccacaagcatgccagaggacgggggggcgggctcggtcgcctcttcccccgtgcggcggatccaggcgaagacgctgttggcggcatcgtcgcccaccacccactgaaagccgcccgggtcgtcgtcgcgggcgtgcagcgccggctcgtgggcgtagagccggttcagatcggcgaccagcgcctggatgccctgatggccgggatcgtcgagcagcccccagggggtggagccgtcatggtcccattcgcgcgggttgcccagttcgccgccggcaaagatcagcttgcggccgggatggccccacatgaaggcgagataggcgcgcagattggcgcgtttctgccagtcatcccccggcatgcggccgagcagcgagcccttgccgtggaccacctcgtcatgcgacagcggcagcacatagcgttccgaccaggcatagaccaggctgaaggtcatggtgccgtgatgccagcgccggttgatcgggtcctcgcccatatatttcaggctgtcgtgcatccagcccatattccatttgagcgtgaagcccagcgcggtctccgatccttcggccgcgaccggcgccgtcacccccggccaggcggtggattcctcggcgatggtcatggcgcccggcacgcgcgcctcgatcacctggttcagccggcgcagaaaggccaccgtttccaggttctcgcggccgccatggatgttgggcacccagtcgccggcctcgcggctgtagtcgcgatagagcatcgaggccacggcatccacccgcagtgcatcgacatggtaatgctccagccaatagagcgcgctcgcgatcaggaagccggctacctcgtcgcggccgtgattgtagatggcggtgttccagtcgcgatgaatgccctcgcgcgggtcttcatgctcgtaaagcgccgtgccgtcgaagcggaacagcccgtggctgtccatcgggaaatgcgccggcacccagtccaggatcaccccgatcccggcggcgtggcagcggtccacgaagcgcgcgaagccgcgcggccggccgaaacgggcgctgggggcgaacagccccagcggctgatagccccaggatccgccgaaggggtgctccatcaccggcagcagctcgacatgggtgaagcccagcgcccggacataggggatcagccggtcggccagcccgtcccagtccagctgcgggtgggcggcatcgcggaaccacgacgccgcatggacctcgtagaccgagaccggcatcttcagcagatcggtggtggcgcgccgggccatccagctgccgtcggtccaggggaagggggtcgggtcgggcacgatgctggcggtgccgggcggcatttccgtcgcctgggccatcgggtcggccttgtgcagcacggcgccgccgcggctgcggatctcgtagcgataggcccggcccgggccgatgccgggcaggaacagctcccagacgccggccgtatggcgtagccgcatcgggtggcggcgcccgtcccagccgttgaaatcgccggtcaccgagacccggtcggcattgggtgcccagaccgcgaacacggtgccggcgacgccgtcgatctccgttgcccgcgcacccagcacccccggcaggtcgggatggcggccggtgcggatcagctgcagatcctcgtcggtcaggatcgggccgaagcgatagggatcttccaccgtttccgtgccccggccggtggtcaccaccagccggtagggggcatcctcgatcgtgccggcgaagatcccggccggatgcacccgggccaggatgcccagcggccggccatcctgttgcgccgctgcccccacctcgtcggcatcggggcggatcaccaccagccggcgccggcccggtccggagatgggaaccggtcccaggatggggccgggacccagcaccgcgaaggggtcgccatggcgggcctcggccagggcctcgatcgccccccggtccaggccggggggccggccggttcatgcgtcgggtgcgacatcgtcggtctccggtaccagtcgttcggccagccgggcaagaccggccgccggcagcagcagccagtccggccgcagctcggcctcgtaggcgacctcgtaggccgccttctcgatcaggaacagtttcagcagcgccggcaggtcgggggcggtggtggtggcctcgtcgccggcatagccggccaggaaggcccgctccatgtcgccgcgcagccgcagcagccagtgggcgggatcgtcgggctccagccctgcaccggtatccgatgccggggccgccggatggggcagggcggtcacgtaatcgatcgagcgcaggagccccgccacatcccgccaggggctgtccttcgcccggcgcagtgccagcggccgggtcggctcgccctcgaaatcgatcagggtgacatcgccggtcgacaccagcagctgccccagatggaaatcgccatggatgcgggtcagcgtcgcgccggtccctgcctcggccagtgcggccacggccgcggccagcccccggcgccgggtcagcacgcgccgcactgcccgggaaaggggggtatcctcccccgcggcggcatgatcggccagaatatcgaaggccgtttccagcgcttggccgattcggctattccaggcgttaatcgtagccggatcggctatctccggcgcaaaattcacgtcctccgacggccgcgccagcacctcgtgcagctccttcagccggcggccgatggtgcgggtcagcgcgcggatcgtcgccgttgcatcctccagccgctcgtggtcgtgatggtgcagcgcgtccagcgcccgggccagctggtcgccggtccagtgccagccatcgccctgattgcggatgaagcgctggatcaccgccaggctggcggtttctgcggagccctccccaaccgggccctcccacgccagttcgcccaggaattccgccaccccggcatagccggccccggtcagatggcgggccatttcgacctcggggttgatgccgggctggatgcggcggatcagcttgatcaccgcggtatcgcccacgatcaccgaactgttggtctgctccgccgtcatccagcgcacctcggccccgggcggcagggcacccgcgatcgcaaccgcctcggccgatccgggccgcagcgccagccgcgcccctggtgccgcctctgcgccgccatcggccagcgccctcatcagcgcccggccgaaaccttccagcgcaaaaccgtcggtcagcagccccacccgcgcggtctgccgcacccgggcgagcgccaggcgcaccggcaaagccggggtgtccgggcggtctgcctcccacagaatgcccagcggcagggcgtagcgatcctcgctgccgtcgtcgcgagcgaccgcgacgccggtcagcaggatctcgccgtcggtgccgggcagcgggtcggcgaaatccagccgcgcggttgccgccgcatcccggccgcccgcaaaccagcggcgcatggccagccaggccggcagcaccgtcttcgacagccggtcgcgatggggttcttccaagagctgcgccagcccccggcgcagcacgaaggtttcatgctcgggcaggggttccggcgccggcaggtgccagaccggcgcccggccttccggttccagcgcaaaggcatagaagccatagggcggcagggtcagcagatagggcagctggccgatcggcggaaaggcggcaccgccgaccagttccatcggcacccggccttcgaaccgcgacaggtccagctccaccgcctgggcggtgcgcgacagattggccacgcacagcaccgtatcgctgtcgtcggcgcgcagataggccagcacccggcggttgcccgggaacaggaaatccagccgtccccggccgaaggcgcggaagcggcggcggacctgaagcatgcgccgggtccagtgcagcagcgaatgcggatcgcggctctgggtctcgacattcactgccgcatggccgtaaagcgggctcatgattgccggcaggatcagctgttccggatcggcgcgcgaaaacccgccattgcggtctggcgaccattgcatgggggtgcgcaccccgtcgcggtcgcccagatggacattgtcgcccatgccgatctcgtcgccgtaatacagcaccggcgtgccgggcatggtcagcagcaggctgtgcatcagctcgatccgccgccggtcgcgatccagaagcggcgccaggcgcctgcggatgcccagattgatccgcgcccgccggtccgaggcataggtctcccacaggaaggtgcgctcggtttcggtcaccatctccagcgtcagctcgtcgtgattgcgcaggaaaatcgcccattggcagttttccggaatgtccggcgtctggcgcatgatgtcggtgatcgggaaccggtcttcctgcgcgatgctcatatacatccgcggcatcagcgggaaatgaaatgccatgtggcattcgtcgccagcgccgaaatattcctgggtgtcttccggccattgattggcttcggccagcagcatccggtcactgtaatgttcgtccagatgggcgcggatcttcttcagaatatcgtgagtctcgggcaggttctcgttgttggtgccctcgcgctcgatcagatagggcacggcgtcgagccggagcccgtccacgcccatgtcgagccagaagcgcatcaccttcagcaccgcgtccagcacccgcgggttgtcgaaattcaggtcgggctggtgggaatagaagcggtgccagtaataggccccggccaccggatcccaggtccagttcgacttctcggtgtcgaggaagatgatccgggtttcgggatatttccggtcgtcatccgaccagacatagaaatcgcgctgcgccgagccgcgcctggcgcggcgggcgcgctggaaccagggatgggcgtcggaggtgtggttgatcaccagttcggtgatgacccgcaggccccgggcatgggcctcggccaggaagcgcttgaagtcaccaagcgtgccataggcgcggttgacgtcgcgataatcggcgatgtcgtagccgtcgtcgcgcaagggcgaggggtagaagggcagcagccagatcgtgtcgacgccaagtgccgcaatatagtccagccgcgagatcagcccgggaaaatcgccgatgccgtcgtcattgccgtcctgaaacgacttcacatgcagctggtagatgacggcgtccttgtaccagagcggatcgcccggtgcatgatcggcgccgcggatgatccggccttgcgcgccggttggggacgagacggttggggatgagacgggcgtcgtgggtgcaggcatgtggctcaacctctcaccggcggcagcacccgccagatggcgaagggaaggtgggcggggtccaggcgcagccggtgatgccggccggtccaggtggatcgctggccggtgaccagatcatccatgacgacgtgggcatcctcgggcagaccccagcggtccagcggcagctcgatcgccgcctcctgggcgtggtgggggtccaggctcaccgccaccagaacgatgtcgtcgccctgatcggtcgtcttgctgaacagcagcacctggtcgttccaggcggtgtggaaggcgaggccgcgattctgatgcagagccgggtgttcggcgcggatgcggttgagcagggtgatctcggcgcggatatggcccggccggttccagtcgcggggccggatctcgtatttctcgctgtcgagatattcctcgcgccccggcagggctgcgccctcgcacagctcgaagcccgcatacatcccccagaggcttgagagcatggtggcgaggcaggcgcggatcaggaaacccggccggcccgaggtctgcaggaaataagggttgatgtcgggggtgttgacgaagacatgcggcccgaagaactccaccgccggcggcgtgctgagttcggtgaaatagtcggtcagcccggccttgtcgtcgcgccaggtgaaataggtgtaggactgcgcgaagccgagcttggccagccggtacatgaccttgggccgggtgaaggcctcggccaggaacacggtgtcgggatggtcgcggcggatgtcggcgatcagccattcccagaacggaaacggcttggtgtgcgggttgtcgacccggaacagccggacaccttccgccacccagaaggccaccacatccctcagcgcctgccagagcgacggcacggcgccttcggcatagaagtcgacattgacgatgtcttcatagcgcttgggcgggttttcggcatagcgcatggagccgtcggatcgccaggcgaaccagtcgggatggtccttcagccagggatgatcgggcgagcactggatggcgaaatcaagcgccacctccatgccctgatcggccgcggcggcgaccagggcccggaaatcctccagcgtgccgagttcgggatggatcgcgtcatggccgcccgcctcgctgccgatggcgtaggggctgccgggatcgtccgggcccgccgtcagggcgttgttgcggcccttgcggttggtgcggccgatcgggtggatcggcggcatatagagcacgtcgaagcccatcgcccggatctcgggcaggcggcggatcacgtcctcgaaccggccgtggcggccggggtcgtctgtttccgagcgcgggaacagctcgtaccaggcggcaaagcccgcgcgcagccgctcgacatcgaccgggtagtcgcgcggcgtggcgctggcgaaggggcgcgggtcgaccagcgccatggccgcgcgggtttcgtcgtcgagcaggcggcggaccttcgccgcatcatcgcaggcctgctccacctcctgcacgatgtcgtcgatgccatgggcacggagcagggccagaccatcggacagatccaccggccggaccacgccggccgcctgcttcttggccagatccgcccggtaggagccccaggcatcgcgccaggccatgatctcgaaccggtgccggcccagccggtccagcggcacccggccccgccagcggtcgttgaccatcggggtcatcggcacctcgcgccattcggtctcgtcctcggcgcgcagccggagcacggcgcggatcacgtcatggccgtcggcgaagatgtcggcctcgatctcaagcgtgctgcccagccggcggcggatggcgaaccggccgtcatccagcaggggggagacggcctcgatcgcgatccgcggcagcttcgccgccgcctcggccggcccggcctctggcccgcgcacagggggggccgccgcgatctccagaaccgccaccccgccgggcgccagatccagcggcgtgcccggcgggtgatcgaccagccgccgcgcggccatgtccggcccgcgggccagcagcggctgcggatcgaggcggaggggggcgtccagcacccgggaggccaccaccagccggtcgtcgccggcgcggaaggcgagcaccgggccgctctggccggtcagaatgtcgagcttcggccggccggcctgcgccatccgctcgaaaccggcattggcgaccctgagcgcgggggagaggtcataggccggccgttccggccgggcgggggccacggtatccgggcgcagcggatccggtgcgccccggtcgaacccggcctgaaccacgatcccgtcgaagaggaagggggcaagtttcaggctgcgccgtccggccgcctctgccgcctcgggcccgcccaggatctcgggcaggcgcggcccgaagggcacttccgggcaggccagcacgctgccgatgcgcgacagccgcgcgatctcgtccagcatccagggcgccgccagatcccaccaggcatcggaggcgaccgcggcatcgaagccgcaggcggcgagcgcgtcgatccgctccgccgtcagcccatgggtccagagcagcagccggcaatcggcggcgcgggcacagagccgcgcccagatctcgggcgtcaccgcctggggcaggggcgcgcggaagcccgcgacgcaggccgccatggcggcatcgaccagcccggccagcgtcgcttcgtcctggtcattttcagggatcagagcctgccggcgcggatcgcggcccgcccgcgcttcgcgcgccgggtcgggttcgggcagcagatcgaccagcagccggatgccgtgatcggcggcgctgcggcaggcggcctcgatccgggccggctcggccgggcccgccagcagcagatggtcgaagcccagatcacgggcatgggcggcggcggccgccagcgtcgcaccctcgcgggcggttgcggcgggcaccatcaggatccgcgggtgccagggggtgcgagagggctgcgcgttcatgcatcccccgccggccggggggtccgggaacgggtggccggtttcgtgcccgctttcttcggcccctcggcggtcggcgtcggtgcggcatcggtgccgcccttggtgcggtgcgttccggccccggttgccctggtcgcacccgcactcgccttcgtctcagccgtcttcgcggccgccagacgccgccgggtgcgggtctccggcgccgcggggccgggttcggcggcagagggcgcgggggagccggggacgggtgggccggggacgggtggcgtcgggccggcctcgtaagggccatcctccgggccgggtgcgcgtccggtttccggcaccgaccggttggccgcctccagcgcctcaagctcggcttccgctgccgcccagtgttcgcgatcgcggccatggggccggccttcctccacccagatgcggtgggcgatcttttccaggcggcgggtgcggtccgtgggggtgtcgtcggatgtgtgcatcaccaggcgtcctcgggcatcgatgggccgtctgctggctcaacacccgcggggcgtcctggttccccatcctgccgcccatgtcacggttcaggcgggccggttcaggcgggccgggttgcggctgcctcttcctgccgggaaccctcccgccggtccggggttgtgcgggacgacctcaccgctttgttccaaggagccttcccccatggcgacccatactgatcacggccaccacaccccgaatgtgcatcccgcagaacagctcgcctcgcttgtccttggcgcctgcatggtgcgtcatggcctcaaatccgaccatctgggccatgccggcggcctcctgtcgctggcggccggcggcctgctgattcagcgcggcctgcagggccgctgcatgctctatgaacgcctcggcatcgacaccaggggcgagcaggaggtgaacggccgcaacacctctgaaatccatgcctcggtgaccatcgaccgcccggcggcggagctgtaccgcgaatggcgcgatctggagcatctgtcgcgcatcctctctcatgtccacagcatccgcgagatcgacgacaccacctcgcgctggatcatcgacggcccggcgggcgagagcatcggtttcgtgtcgcgcatcacccaggacattcccgaccgccgcatcgcctggagcacgaccgaagaggccgatttccagaatgccggcatggtcgaattcatccccgataccgaaaccggcgacggccgcaaccgcaccgaggtggcggtgacgctgcgctacgaggtgccggccgggctgctgggccgcatcggccagtggctgatgccgcgccaccccaagcgccagctgatggacgatctgcgccgcttccgccggcggatggaagagaacggctccgccaccggcggtgctgccgccggatcgtcgggcggcttcggcaccgaggtcggcggcggagcgcccggaaccacgggatcgggcaccacgggatcgggcaccacgggatcgggcacggcccaggcctcggcgcccttcacccccggcaggcagccgggcggcaacggcaagtcgaccggcccgggccagtgaccgtggcggcgctgcggctgcccgaccccaggcccgactgggcgctgtttctggatgtggatggctgcctggtcgacatcgccccaacccccgatgcggtggtggtggaaccggggttgccggcgctgctcgaccgcctggcggtccggttcggcggtgcgctcgccctggtcagcggccggccgctggcggaactggagcagctgttccaccccgcccgtccggccgccgccggccagcacgggctggaatggcgcggacggccgccgctgccccggcctgagggcttcgaggcgctggacgcgccccttcaggcctttgccgaggcccatccgggcgtgctgctggagcggaaatcccacgggttcgccctgcattatcgcgcggccccggccgcgggggccggcgcgctggcgctggcccgccggctggcggcgacgacggcgccggaattgcgggtgatgccgggcaagatggtggtggagcttcggatggcgggtgccgacaagggtaccgccatccgcgccttcatggaggcgccgccgtttcgtggccgggtgccggtcttcgcgggcgacgacgtcaccgacgaggacggtttcgccatggtcaatgccatgggcggccactcgatccgggtcggacccgatatcgggtccggacacggggctccacctgccagcgccgcacgctggacggtgcctgatgcgcccggtttccgccgctggctggccgggcttgtggtgatggacgagccggcgggtgagggagccggcggccccggaacctaaccccccctctgcgggttatcgcgatgaatgagtgtcgcgacgacggcgccggccagggccggccccgatcggagcctggagggacggatcttgaagcgacttgtggtgatttccaaccgcgtggcccgcgcagatccgcggaccaccgaggatgcgggggcgagcggcggactggccgtggccgtccgcgaggccctgagcgaaaccgccggcctgtggttcggctggagcggccagttgtcggagacgccggccctgcacggacccgagatgcagcccggcggctaccgcatcgccaccgtcgacctgacgccggccgatcatcgcggctattacaacggctatgcgaacgaggcgctgtggccggtgctgcacagcgcaccgcatctgatgcaccacgatgccgaccgctacacggcctatcgctcggtgaaccgccagttcgtcgaccggctgctgccgctgctgcatcccgacgacatgatctggatccacgattatcacctgctgccggcggccgaagaactcaggcgccggggcctgcgcaacccgatcggcttcttcctgcacacgccctttccggccgcggatgccttcgcggccctgcccgaacaccgcgccctggtggaggggctggtccatgccgacctgatcggcttccagaccgcatcggacctgcgggccttccaggactatatccgctgggaggcggggggcagcgtctcgatggacgggcggatggaggccttcggccgccatttccgggcctcggttttcccgatctcgatcgatccggccgcctttgccctgacggccgaacgcaatgccgacagcgactattgcctgaagcttgcccgcggcacggggcgcggcgcgctgctgctgggcgtcgaccggctggactataccaagggcctgccgcaccggatgctggcctatgaacgcctgctggagctgcagccggatctgcgccgccggatggctttcgtgcagatcgcctcgcaatcgcgcagcaagctgccggaatatgtcgccatccggcgcgagctggaagagatcagcggccggatcaacggccgcttctcggaacccgactggacgccgctgcgctacatcaatcgcggcatcccgcgcgaaacgctggcaggcgtgctgcgcatggcccggatggcggtggtgacaccgctgcatgacggcatgaacctggttgcgaaggaatatgtcgcggcccagaaccccgaagatccgggcgtgctgatgctgtcgcgcttcgcaggtgccgcgcaggaactggacgccgccctgatcgtgaacccgctcgaccacgacgaaaccgcgcgccgcatgcatcagggcctgaccatgagccttgaagaacgccgcgagcgctgggaggcgatgatggcggtgctctcggccaacgatgtcagccgctggtggcgcagcttcgtccgcgcgctggccgacgccgccaaccccaccgcccaaccccccaccggccgcctgctccgccgcgaccacccgcgcctcgccgccgagggcagcgctgtggcgaagcgcgaaggcttcgtgcgggaaacgggggccgcaacctccggacgggcgcataacgggttgttgatgcgggcaagtggcgacgcctgacctgtccgcgacccctgccacctgcagaaagccccgccctgcccgaagggcagcggcgggcgggatgaggcctgcgtgtggtggcggcgcgctaccccgccaccatcagcttcggtagccacagcaccagttcggggaaggccgcgcagaggcccaaccccaccagctgaagcaggacgaaggggatgatgccgcgatagaccgtgcccatgccgatgtccggtggcagcgtgcccttcagatagaacagggtgtagccgaagggcgggctgatataggcggtctgggccgagaccatgaacaggatgccgaaccagagcgggtcgaaatccaggagctggatcaccggcaggaagaccggcacgcagagcaggatgatgccgatctcgtcgaggaacaggccgaggaagaccagcacgcccatcatcgctgccaggaccagccagcggttggcgtccaggtcgcggatgaactccagcaggaaatcggcgccgccggtgccggtgaagatcgccacgaacgccttggcgcccatggtgatccacaggatcatcgcggtgaccttgatcgtgtccatgccggcgccggacagcatggcgaggctgagccggcgctccaccgcggccgagatgaccgcaccggccacccccaccgccgccgcctcggtcggcgtggcaatgccggcatagatgctgccgagcacgccgatgatgatcaggaagggcaggatcagcgcgcgcagcgagcggatgcgcgcgccccaggcgacgggggaggggtcgcgtggcgcgatcgacgggtcgatcaggctgcggatgatgatgtaggcgacatagagcccggccagcagcaggcccggaatgatgccgccgatgaacatctggccgatcgagacctgggcggtgacggcatagacgatggtcaccaccgatggcgggatcaggatgccgagcgtgccgccggcgcagatcgtgcccagcgccaggcgctggtcgtagccgcgcttcagcatcgagggcagggccaggatgcccatggccgcgaccgcggcacccacgatgccggtcatcgccgccatgatcgtgcagataatcaccgtgccgatcgcaagcccgccgggcaggcggttgaaccacagctccatcgccttgtagagcgattcgatgatgcccgagcgctgcagcacgctcgccatcatcacatagagcgggatcgacatcagcgagtccgagcgcatggtgtcgaagatctgcagcacggtgatggtcagcgccgccggatcccagagcagcaccgtgaacaggatcgcaagcccgcccagcacgaaggcgagcggcagaccggtcagcatcagcccgaccaggcccgcaaacatccagatcaggacgccttccgacgcgatgccggtcatgccacacctgcccggggccggccggcaccgttcatcgggtcgtcaccgccgcagagctggatggcggcgcgcaggaattccgccacggcctgcaggaacagcagagcgagtgcgccgggcaggaagaatttggtccaccagatctcggggttccaggacgagaagctggtctcgcccagctcccaggaattgaccgcaagcggccaggacaactcgatcagcacccaggagaagcccatgatcaccagctggccgaaggcatcgaagacgagctgaagccgccggccgaccgatttgtggaggatgtcgatattcacatggccgtggatgtgcagcagccagggcccggcggtcaggaaataggggccgaagaccagcgtggcggattccatcgcccagttggtcggcgcatcgaagaaatagcgcgagaccacctcgaacaggatcaccggcacgaccacgaacatgacgagcgcggccagccgggcgagaagatggttgaaggcggtgacggccgtgcaatagccgcggaccaccccgacaagggcggacatcaggatcctccgcaccggaaccggacgaaggcggcgggacaaaggccccgccgcccggcgatgttgtgttgtgggggcaggccgccccgatcgccgccgccgccgggacatcatacagccgcaccttgtcggtgcggctgcaagccgccattgaggcggcggccaagggcacgggagtgcccgcccggcgagggactgacaaaccccaagccgccattgaggcggcggccaagggcacgggagtgcccgcccggcgagggactgacaaaccccaagccgccattgaggcggcggccaagggtgcggcagcacccgcccggcgaggggctaaaaaaaacctcccctcaacccagcaggcccagttccttcatgaacccgacctggctgtccaggatgcgggtggcgagcgcatcgtccttggtggcgacgcgccactgggcctcggccttcgggcgattggcgcggatgtcggccgggtcgagttcgacgatctccacgcccgcctcgcggtatttggccagcgaggccacgtcctgcaccacgatatgctggcgcagcgccgccgaagtctcgcgggccgccaccgccagcaccgccttgtattccgccggcagggcctcgtaggcggccttgttcgccacatagctggtggcggtggtcggctggtggacgccgggcaggatgatgaatttggcaacctcggccaggccggcctggaggttggcggtcaggtcgccgcggtcggcgatgtcgatcacgcccttttccagcgccgaatagacttcggccgtcggcagcggcgtcaccgcgacacccatggcgcccatcacgctggaggcgaggccgacgaaacggcccttcttgccctggaactcttcgatcgacgagatcttcaccttcgaatggatcggctcctggccatagacggtgggggcgatatacatcagcccggccttgccataggcctcgcgcgccatgtcgagaccgcccttttcatagaaccaggcttcgtactggtcgctttcggggaagccgaagggcacggtggaggtgaaggcgaaggccgggatcttgccggcctcgtagccgtcgaaggtcttcatcatctggaaggcaccggcgcggaccgcgtcgaaagcctggttggccggcaccagctgaccggcggtgaaggtctggatttcgaagccgccgccggtcaactccttcacccggtcggcgaagagctgctcgaacttcatcggcgtggtgttggcgtcccacagcgcctgcatgcgccacttgaccggctggccggcggcgcgggcgacatggggtgcggcaaaggtgccggcaccggcggccacggcggcaccggcggcggcgatgccgccggcgcgcttcagcaggccgcggcgggtggtctggtcatggctggtcatcggttttctccccaggatcgtcagccggatgtgactggctgcttgtgattggcgccggggatcaaccccggcgcagcgcgtcgagaagttcgcgggcgcggtcgacgcgcacgtcatgggcggcggccagctgcttcgccacggcctcgatctcggccccttcggctccggccaggatggcgatgttgcgggcgtgcagcgccatatggccgcgctggatgccctcggtcgcaagtgcgcgcagggcggccatgttctgggccaggcccaccgccaccgtcacctcggccagttcctgcgcggtttcgaccttcagaatgcgcagggcggcctgggcgagcggatgggtcttggtggcaccgcccaccaggcccagtgccatcggcatttccagcgtgccgaccagattgccgtcgcggtcgcgctcccaggtggtgagcgaggtatagcgcccgtccttcaccgcgaaggcatgggcgccggcctcgatcgcccgccagtcattgccggtggcgaccacgaccgggtcgatgccgttcatgatgcccttgttgtgggtggcggcccggtaggggtcgatcgcggcgaattccgccgcctcgacgatgccggtcaccatgtcctcgcccgagacggttttcgttgcgagtgcggcgggcgagacccgcacactggcgcgggccaggcgcagatcggccaggttcgacaggatgcgcagccgcacccggccgccggccgcctgctccaccagcggtgccaccgcttcggccatggtgttgaccgtgttggcgcccatggcgtcgcggacatcgaccagcaggtgcatcaccaccatcggcccgacccggctttccgggaagacatggacctcgatgtcgcggcagccgccgcccaggctgaccagcttggcatccttggcattggcggcggcgatgatcgcctcgcgtgccgccaggatgcgcagccgcgcgccccaggggtcggtcacgtccaggacctggacctgcgcgcgcatgatcggggcggtgctggaggtctcgaagccgatgtcgttgctgcgggcgatgcgcgccatatacgacgccgccgccaccaccgacggctcttcgaccaccatcgggatcaggtagtcgcggccgttgatgcggaaattggtcgccacgcccatcggcagctggaaggtgccgatcacgttctcgatcatgccgttggcacgatcgacggcaagcgccgcggggtcggccagcagggcctggtcggcggcatcgaggccggccgcgcgggcgagttcggccagccgctcggccggggtgaggttgcgatagttttcgaggcgcgaattgagcgcgctgccgcaggcctgcatgtttcctccgtgtgtccggcgtcccggccttcgccggccccggaagcatggcgcatcgcagggcggggaaggattgtgacttgggcaatgattgtcctatgatccgggggacggacaagggacggtcggacggttcatcaccatgactgtcccagtcgtcttcatgggacagtttggcggacggcttcaatatggcagacacacccccgcgtcaacccggtcgtatcgaccagctggtcgagctgattaccgggcagatcaccggcggcctgctgaaaaccggcgagcgcctggcctcggtcagggcggcggcgggagatcacggggtgtcgaagaacacgatggccgaggcctatgaccggctggtcgcggccgggctgctggaatcgcggccgggatcgggcttctatgtcacgggcggcaaccgccggccgctgccgcggcagaacccggatgtggaggcggcggtggatgtggtctcgctgctgcgcgaacagctggaccagcattacgaggtccggcccggcgacggccgcccgcctcaggcctggatggaaggctctgaaatcgggcgttttttcggccggttcaaatggccgaagggcgaggcgatcgaccatggctatggcagttcctggggcttcctgccgctgcgcgaacgcatcgccatgctgctggcggaacgcggcatcaaggccggggtgggacaggtgctgctcacctacggtgccaatcacgcgctcgacctgatcatccgccatcatctggagccgggcgatacggtcttcgtcgacgaccccggctactatccgctgttcggcaagctgaccctcgccaaggtgcggatcgtcggcatccgtcgcggggccgaggggccggatctggaggatctggcggcgaagcttgcccatcaccggccgaaactgttcttcactcagtcccagggccacaatcccaccggccatggcctgaccatgggcacggcctacggtctgctgcaggcggcggagcgccacggtttccagctggtggaggacgacgccttcgccgatgtgatgccggcctccgcacccaggctggcggcgctcgatcagctgaaccgggtgctctatgtcggcaccttctccaagaccttctcggcaagcctgcgctcgggctatgtcgcggcctcggcaccggtggcggcggcgctgcagggcatcaagatgctgacggtggtcgcgacctcggattatgtcgagcgcttcatctacaatttcatcgccgacggccattacgtccgccatctgcgccggctgcgcgcgcgggtgggggaggcggcgagcacggcggccggcgcgctttccgagatggggctggacgtagcgacgccggcccatgccggcttctatctctgggtcggcctgccgtccggcaccgacgaactggcgctggcccgtgccgcggcagaacgcagcatcttcctggccccgggccaggttttcgcccccgaccgcgccccccgggcacccgccatccgggtgaacgtcgcccatgccgcggatccgcggttcctggcgttcatgcgcgaggtggcggccggtcggtgacagcgctccggccttgtccggccttgttcatgacagtctggcaggggctgtcaccggcgtacggacaatgtctatattggttcagcacggaagttctcgggagaaacgtaccgtgtctaagtgtccgtgcgggacgttatctatgatgtccggctccttgcgattctgcgcatcatgatccggatcatggcgaggcggaggaatgtcagagccaccagatgacgcgaaaatcgctctaactcgacgcggcgacgatgcgcagaccgttcttgcgatagttcgagggtggcaccccggcgacccggcggaagaaccttgagaagctggccatttcggcgaagcccaagcggtcgctgatttccgacatcggcagatccgtggtgtcgagcagttcgcgcgcgcggcgcagccggacattgtcgagcgcctgacgatagctggtgccggtctcggccagtttgcggtgcagcgaacgttccgagacgttcagcgcctgtgccgcctccaaggcattcggaaaagcgccgcgagactgcatcagcaactgatagaccgatttcacgatgccggcatgcgtcgggctggtgtcgagcatgttctggcagagccggcgatagttctgggccagcgacgggttcgcgagcggcagcggcagggcaccgacgccgtcggcaaaatgaaagcagctccgcggcgcgccgtagacgatatcggcctgccagcggtcttccaggcccatccagcccctgggccggtcgagccggctttcgatcaggcgaatcggcagatgtgcctgtcgcatgtcgcgaaagaaggtcagcgccgagccgagcaggcgttcgtgcaggaattccgtcagcccggcgggcacatagtcgtcattggccacgaaggcgacggcgatatcgtcctgtgtcacgatgtcgtattcgaacagcgcatatcccaacccctgcatcgcggcgaaagtgcacaagccctcggtgacatcgcgtgacaccagcacggccaacccgagcgggccataggcgagcaggctgtagcgcaggccggtcaggaagccgatgcccggaatctgttgcgtcgcacgccagaacagccgctgaaacgccagctcctgatagccgttgagggtaccccaggggtcgtgcaggatgtcacgggcaagccccgcctcgctcagcagcggcaccgggtcgatgccgtgttcggtcagcattccggccatgatctgaatactctggctcggcaggcgtatgctctggatcagaccgaccttcatggcatgctccgaccatgtcacaccggtgcccaagatgacggactggcagtaaaagtcaaattattggcatgcccgaacattctcaatcgggcggaagcccgtcatcctgtcttctgggagacaagatgtcggaaggctcatctcgttgaaaaacggatggtttgacgcacacggcgccagccgggagaccgggttgcacgggtgacgatcaattggccgaaactgacaactcctatcatgcctgcgcagagatcgacgcggacgcccgaggatgaccccgggcgccggctctcgctcatgcctggcggatcgttcgagggttacatccctgggaggaaacatgaaacgtcgagactttctgcgcatggccggtgcggcggctcttgcgagcacactgcctgtgccgatgctgcgcgccaagacgatggacgagttccatatcgccgccattctcgccttttcgggggcctatggtctgatcggcaacgacatgcgcaaaggcgccgaactggccgttgcgcagcgcggcggcaaggtgctgggcaaacccatccgcttcacctgggaggatgacgaaaccaagccgcagccggcggtgcagaaggccagccgcctgttggcggaaggcgcgcagatgatgttcggcgcggtcggctcggcctcgacattggcgctgcaaagcctgtcgacccagcgcaaggtgccccatctcgtcaccatctcggccgacgacgcgatcaccaagccgggcggcgcgccctattccttccgcacgtcgaatacgctcggcatggaaatcaagatgacgatggagttcgtcaagtcgcgcgggctgaagaagatctatgcggtgaccgccgactatcaggcgacgcgtaccggctttgagcagttcgccgagatggccaaggccgccggtgtcgagatcgtcggcaacgactatgcgccgctgggcaatcgcgacttctcggtgatcatcgacaagatggcgcgatccgacgcggacggcatcgcggtcatggccaccggcaatgacgggatcaccttcgtcaagcaggccggccaggtcgcattgggcaaggacaaggtgatcttcggccccgtgttgcaggacgatgtctttgccgccgcgaccgggcccgccgcgctgggcgtgaattccggcgtgcgctatcactacagcctcgacaacccggcgaacaaggccttcgtcgaggcctatcgcgacgcgtatggcgtgtttccgtcgagcttcgcgggtgaggcctatgacgggctgcgctggtggctggacgtggtggagcagaccgacagctgggatgccgatgcctgggtcaaggccttcgcgaacagcgtctatgagacctcgatcgagggccgcaaggagatgcgcgcctgcgatcatcaggcgtcgcaggtcgggctctggggcgaggtggtcaagggcgaggcgccgatgccggaactgaccatgaagatcaccgaaatcttcccggcggaccgtctgttcgacgcctgttgaacggatgggcgcatctgtacggcggcggactcaaggtccgtcgcctgccggctgtttcgggccggctgtttcgggatggtgcggatatgtccacgatcattatcgggttgagcctgagctttcttctgtttctgctgtcggcggggctgacgctgatcttcggcatgctgggcgtgatcaacttcgcccatggcgcgctgtacatgctgggcgcctatgccagctttcagatcgtccagaccaccggatcgttctggctggggctgctgatcgcgccggtggttgtcgcggggttgggcgcgctgatcgagatgtcgacgctcaagcgggtctattcccgcgaccacatcttccaattgttgctgaccttcggcctgatcctggtgatcgacgacgcgaccaagctgatctggggcctggactacaagcaggtgccggcgcccgatctgctgtcggtgccggtcgcgctgttcggcagccagatcccggcctaccggctgttcgtcatcgtcttcggcgccgtggtgtcgctggggctgttccttctgctggaccgcagcaagtggggcatgatcatccgcgcggccagcgccgaccccgacatggcgcgcacactgggcatcgacgtgaaccgggttcgcaccggcgtcttcgcgctcggatcctatctcgcggcgcttgggggggtgatcacagcacctctggtgccgatcgagctgggcatggggttcagcgtgatcatcgactgcttcgtggtcgtcatcatcggcgggctgggtaatatccggggcgcgatctttgcctcgctgctgctggggatgacccgggccgccggctatacctatgccaccgaatgggtcgaacttctgaccttcgctctgctgatcggaacgctgatgttccgccccgcgggcctgttcagctataaggggcgcgcggcatgacacgcagagccatgggccgcatgctgatggccctgatcatcgcggcgatgatcgccgtgccgttggttctgcccggcgagcaatgggtgaacctggtcagcctgatcctgatctgggcgctgttcgccatcggcttcgatctggtcttcggcgtgaccgggatgctgtcgttcggacatgcggcgctgcttggaaccggcggctatacgatgaccgtgctgatgctgagctatcaggtcagcttcctgcccgcgctggccgccgccgccctgggcggcgcgctgctggccttcgccatggggttgttcgcgcttcgggtatcgggcctgttcttcgcgctgctgacgctggcgctggcgcagatgatgtacatcctggcctcgaacaaactgcgcgccatcaccggcgggctggacgggatcgccggggtgccgcgacccgatctgttcggcatcgatttctacgacaaccgcaactattacggcttcatcgtcgtggtcttcctgatcggccttgcgatcatggccctgctgcgggccgcgcccttcggccgggcgctgcgggcggtgcaggccaacgacacccgcgcggcacagcttggctataacgtgcacgccctgcggcagcaggccttcgtggtgtcgggcgcctatgccggtgtgtcgggcgcgctgctggcctcgctgatgttctatatcagcccgcagatgctgcattggagcacgtccggcgacgtgctgatcatgaccgttctgggtggcaagggcactctgctggggccgatcctgggtgttgcggtattcgagctgctgaaggaggaactgagccaggccacgcaatactggtacggcatcctgggggtgatcttcatcctggcgacgatcttcctgcgcaatggcatcgccgggctgttcgacggcgcccgcgaccacgacgaggggggcgcgccatgaccgggggggcgctgagctgcgagaatatccaggtgtccttcggcgggctgaaggcggtcaacgacgtcacgtatgatttcgagccggggcggctgtacgggctgatcgggccgaacggcgcgggcaagaccacgctgatgaacgcgctctcgggccatgccgccttgagcggcggacgtgtccggctcgacggccgggacgtgacccacctgtcggtgcatcggcgcacgcgcagcgggctggggcgcagtttccagatcaccaagatcttcgcggggatgtcggtgctggaaaaccttcagatcgcggcctttgcccatcgctatcggttgcagcccttctggctgccggccagccgttttgcggcggtgcgtcaacaggccgaacgggtgctggaagaggtggggctgactgcgctggcgcatcggccggccgaatatctgtcgcatggcgaccagcgcgcgctggaagtgggcctgtcgctgttgagcgagccgcgggtgctgctgctggacgaaccgctggcgggggttgggcatgatcagctcgaccgggcgatcgacctgatcaggcagatcgtgaagggccgcacggtgctgctgatcgagcacaacatggatgtggtgatgcaggtctcggacgagatcgtcgtgatggtgcaggggcagttgctggcctcgggcagccccggggatatccgggccaatgcggcggtgcgggcggcttatctgggagacgaggcatgacgctgctggcactggaagactgcgatgtcttctatggcaaggcgcaggccctgcaccgggtgtcgctggagatcgggccgggcgaggtggtgtcgctgattggccgcaacggcgcgggcaagagcaccatcctgaaaaccatgatcggcctcaaccgcgcgaccggagggcggcggctgtggaagggcggcgacgtgaccgcgctgcgcccggaccagctcggccggttgggcatcgcctatgtgcccgaggaccggcggatcttctcgaatctgtcggtggacgagaacctgcgcatcgccacggtgatgggccggaagggcggctgggacgcggcccgggtccacaagctgtttccggtcctgcgtgagcgggccacccagcccggcgacacgctgtcgggcggcgagcagcagatgctcgccatcgcgcgcgggctgttgaccaaccccgaggtgctgctgctggacgagcccaccgaagggctggcgccgctgatcgtcgatcaactggtcgaggcgatgcggctgatcaacgccgagggcatggcgctgttgctggttgaacagaacctgcgtgtgccgatgaagctggcccaccggcaatatgtgatcgatcacggcgccatccggtggaccgggacgacggccgagttgcaggccagccgggacgagatcgaaaaactgatcagcctttgagggaacgatatggaaaagacgtatatcgtcgggatcgggatgtcgcatttcgggcgtttcctgaaccgcggcctggccgatcttaccggtgaggcggtgaccgaggcgctggccgatagcggtcttgcggcccacgacatcggggcagcctatttcgccaacgcctcgcaaggcgtggtcgagggccagcatcttgtgcgtggccagcttgccctgcgcaggctggggtttcagaacctgtcgatcaccaatgtcgagaatgcctgcgccagcggcagcaccgcgctgaacgcggcggtcgcctatatcgcctcagggcaaggtgatgtggcgctggccgtgggcgccgacaagatgaacgcccccgatcgtgccctgtccttcgccatcttcgacggtgcctgggatgtcggcgatgtcgagggccagatcgcgcggctggagcggctggggcaggcgatgcagccgccggaacgcgcggtggagccgggccagcgcagcgtgttcatggatgtctatgccgcactcgcgcggttccatatgggcaccttcggcaccacccaggcggatatcgcgcaggtcgcggccaagaaccacagccattcggtgctgaaccccaaggcgcagtaccgccatgcgatgacggcggacgaggtgctggccgcgcgcgagatttcctggccgctgaccctgccgatgtgcgcgccgatcagcgatggcgcggcggcggcgatcgtggtgtccgagaagaaggcgcggcggatgggtctgacccgggcggtgcggatcgcggccagcgtgcaggccgccggatcggaccgggcagctgaggatctggaccgccatatctgccggcgggcggtggatcgggcctatgagctgtcggggatcgggccggaggatgtctcggtggtcgaggtgcatgacgcgaccgccttcgccgagttgcaacaggccgagcttctgcggctttgcccgatgggcgagggcgggcggctcgccacttcgggcgcgaccacgcttggggggcggatcccgatcaacgtgtcgggcgggcttgagtcgcgtggccatccgatcggggcgaccgggctggcgcagatctatgaactggtcacgcagctgcggggcgaggccgggccgcgccaggtggagggcgcgcgcgtcgggctcgccgagaacggcggcggcttccacggatacgaggaagccgtggccgtgatcacactgttgcagcgataggagggcctcatgcgcctgatcgactttttcgaccggggtgccgcgatcaaccctgacggcgtctgtctggaggatgacgaggtcagccgaagctatcgctgcgtgcagacgcgcagctttcgctttgcaaatgccatcgcggccgaggggttcggccccgggcggatggccggcatctacagcccgaactgtgtgagcggtttcgaggcgatgctcggcctgttccgctccggcaccgcctgggtgccggtgaacgccaagaacggcgtcgacgagaacgcctatatcctcgatcacaacgacgtcgaaattctgttctatcacagcagcttcgaagctgccctggaccggatcaaggcgctgtgcccgaagatccggcggttcatctgcctcgatcgggcggggtcggatggcccctggctggaagactggctggccgatgccgccgacaccgatccggatgtgacgctggggccggacgatctggtcggcattctctcgtcgggcggcaccacggggcgccccaaggggatcatgctgacccagctcaactggggcacgatgatcgccaatttctatgccggtgtggatcccggccccgcgccggtgcacctgctggtcacgccgatgacccatgccgccggggtgatggcgatcgttctgatggccgccggcgcgcgcaacatcatcctgccggggttcgacgcggcacgggtgctcgacacgatcgcgcgcgaggaggtcacccatcttttcctgccgccgacggctatctacatgctgctctcggagccggggatcgaggatcgcggctttccgtcgctgcgcggcttcatctatgcggcggcgccgatggccgtcgacaagctgcggcaatgcctgaagatcttcggcccggtgatgatgcagagcttcggccaggccgaatcgccgatgttctgcacgctgttgatgcccgaggatcatctggtgctgggcgatccggcgcgcgaacaccgcctcgccagctgcggacggccgacattgctgacgccggtggcgatcatgggcgatgacggcaagttgatgcccaggggcgagcgcggtgagatcgtggtacgcggcaatctggtgatgaaggggtattacaagaaccccgaggcgacggccgatgtctcgcagcatggctggcatcataccggcgacgtcggatatctcgacgcggacggctatctctacatcgtcgatcgcaagaaggacatgatcatctcgggcgggttcaacgtctatccgtcggaggtcgagcaggtgatctgggcgcatcccgccgtgcaggactgcgcggtgatcggcgtgcccgacgagaaatggggtgaggcggtcaaggctgtgatcgaactcaagcctggtgcccggctcgaccccgacgagatcatccgcatctgcaagcagcaactcggcagcgtgaaggcaccgaaatcggtggcgatctgggacgagctgccgcgcagtcccgtgggcaaggtgcgcaagaaggacatccgggatgtcttctggcaaggccagacgcggaagatctgagggtgcgacatgaatatctccgagcttctggcgcaatccgcccgaaccttccacgaccggcccgccgtctgcctgggcgatgccaccgtccttacctatgccgggctgcgtgatcgcggcgcggcgctggccgccggtctccgcgcgcgcggtgtgccccggggcgggcgtgtcgtcatctacatgggcaatcggccggaatacttcgagatgctgttcggcatctgggcggcgggttgcgttgcggtgccggtcaacgccaagctgcatccggccgaggtggactatgtcctgtcgaacagcggcgccagcctgctgttcaccgacagggccggggagatggccggcttcgccggaacggtcgcggtggatggcccggcctatgcggcattgatggccgggccggcggccctggttccggcgcgggtcgcgccggaggatcccgcctggatcttctatacctccggcaccaccggccggcccaagggggcggtgctgagccaccgcaatctctgggcgatgacggcaagttttctcgccgatatcggcccggtcacggaaggctcggcagccctgcatccggcgccgctgtcgcatgcggcgggcctgttcgcgctgcccttcgtgcggcgcggtgccgccaacgtggttccggaaagcggcgggttcgaccctgacgaactggtggcgctgctgcaccgctttccgcgctcgtccttctttgccgcgccgacgatgctcaatcgcttcatcgcctgtccggcgctggacgcgcgcgcgatcgccggtctcgatctgatcttctgcggcggcgcaccgatctatgtcgaggatctgcgccaggcgctcggcctgttggggtcgcgcatctggatcggctatggccagggtgaggtgccctgcacgatcagctatctgccgccgcatgttctggggctgaacacgcccgagagctggctcggctcggtcggcatcgcccgcaccggtgtgaccgtccgcgtggtcgacgacgccggcgccgactgcgcgcccgatatgccgggcgaggtgatcgtgtcgggcgacgtggtgatgaccggctattggcggaaccctgaagccaccgcctcggcgctgcgcgacggatggctccataccggcgatatcggcagcctcgacgcacacggcgtgctgacgctcaaggaccggtcgaaggacgtgatcatctcgggcggatcgaacatctatccccgcgaggtcgaggaggtgctgctgcgttatcccggcgtcagcgaggccaacgtgaccggccggccgcatgccgattggggcgaagaggtcgtggccttcgtcgtcgccgaggacggggtgaccgccgaggcgctggaccggttctgcctggaccatatcgcccggttcaaacggccgaaatcctatcgtttcgtcccgtcgctgccgaagagcagctacggcaagatcctgaagaccgaactgcgccgcatgctggtcgagagcgagccggccccgaagacgttttgacccaaggaggcgtgacatgaccacactcattgccggcgtcggcatgattcccttcgcgaagcccggcgcctcggcgccctatgatgccatgggcgaggcggcgatccgtctggcgctcgacgatgccgggatcggcttcgaggccgtggagcaggcctatgccggatatgtctatggcgacagcaccagcggccagcgggtgatctatcgcgtcggcatgaccggcattcccatcgtgaacgtgaacaacaactgttccagcggctcgaccgcgctgttcctggcgcggcaggcggtggaaagcggcgtggccgactgcgtgctggcggtggggttcgaacagatgacgccgggcgcgctcggcgcggtgttcaccgaccggccctcgccgctgggtgaattcgacgcggtgaccgatgcgttgatcggcgcgtcggatctgccgatgacgctgaaatatttcggcggcgcgggcaaggcgcatatggaccgccatggcacccggcttgaaaccttcgcggccatccgcgccaaggccagccgccacggcgcgcgcaacccgctctcggtgttccgccgggagatgagcgtcgaggaggtgatgaacgcccagaccatctggcccggcgtcatgacccgccccatggcctgcccgccgacctgcggcgccgcggcggcgctggtggtgtctgaagacttcgcccggcgcaacgggctggacgcgacggtgcgcatccgggcgcaggcgatgaccaccgaccgccccggcagcttcgacagccgcgacatgatcgaggtggtcggcgccgatctgacgcgcaaggcggcgcggaaggtctatgaggcggcgggtatcggccccgaggatatcgacgtgatcgaactgcacgactgtttcgcccagaacgagctgatcacctatgaggggctgggcctttgcggagagggcgcgggcgaggcattggtcatggacggcgacaacacctatggcggccgatatgtcaccaacccctcgggcgggctgctgtcgaaaggccatccgctgggcgcgacgggcctggcccagtgctatgaactgacgcagcaattgcgcggccgcgccggggaccggcaggtcgagggcgcgcggctggcgttgcagcacaatctggggctcggcggcgcggcggtcgtgaccctctatgaggccggcgcatgatggcggggggaggcgggatcatggaatatggcgttgccctggtgacgggggccggctcagggatcgggcggggggtggcgatacggctggcccggcttggcgcccgggtcgccgtcaccgatgtttccgaggccggcatcgacgagaccctgggtctgatcgccgcggagggcggcaaggcgatgggccagcggctcgacgtcgccgacgcggcctcggtcgaggcggccttcgccgccgccgaggcctgggacaagcccgtcgacgtgctggtcaacaatgcgggcatcgcgtcgctgcatgcgttcctcgatttcccgaccgaggactggacccgggtgatggcggtgaacgtcaccggcactttgctttgcgcgcaacgcgccgggcgcgcgatggtgcggcagggctatggccggatcgtcaacatcgcctcggtcagcggtatccgggccggggtggggcggacggcctatggcacctcgaaggcggcgatgatcgggctgacccgccagatggcgctggagcttgggccttacggggtcaccgccaatgccgtagcacccggcccgatcgtgaccccgctgacgcaggcgaattataccgaagcgacggtcgcggcgtttctgccgatgatcccggcgcgacgcatgggtcaacccacggatatcgccgccgcggtcgcctatctcgccagtcccgaagccggctatgtcaatggtgacgtgctggtggtcgatggcggctatgtcgctgccggggtgagccagaccgggcatttggacatggccggcggcggcggatgacaagcggccatgcgccgcgaaccgcctggggatttcctgtgtccacaggcgttcgcggagcgggcggggccggcgttaccgcgcctccggatcctcgaccggtgccgccggcaagcagggccgccgggtcgtgtcggctttcattgccacggcattcgcccggaatgatgccggcgccaccatccacctctttttcggtttcgagacggcctctaaggaagccgtctttacgatgaagctggatgccgagctgcccgcagcattcatggccgaggctgcggcagaagatcgcccggcatctcaggtcgttcgcgaattgatgcgcgactatatcgaacggcgtcgtcagagccgtgacgacgacacctatctgcaccgaaaggttgaagccggacgcgcgtcgatacgtgccggacaaggtcggtccaatgacgaggtcaaagctgatttcgcggcgcgtcgggcggggctggcagggtctgacgcgtgatcgtgctctggtactacccccccccccgccctgcacacctctcgccaatggcccccgctgatcaccccaccccgaaccgatcgatgatcgtcaccccggtgccggggaagcggtccatcatggtcagcaggcgggtgccttcgtccaggtcgacgcgggcgccgatcagcttttccggctgaagccggccgacgtcgaatgcgatggcaccagggtactgacaacgtctatactttttcagcacagagatcctgggggagacgttccgtgcctaaagaagccgtctttacgatgaagctggatgccgagctgcgcgcagcattcatggccgaggctgcggcagaagatcgcccggcatctcaggtcgttcgcgaattgatgcgcggctatatcgaacaacgtcgtcagagccgtgactacgacacctatctgcaccgaaaggttgaagccggacgcgcgtcgatacgtgccggacaaggtcggcccaatgacgaggtcaaagctgatttcgcggcgcgtcgggcggggctggcagggtctgacgcgtgatcgtgctctggacgcccgaggcggagcaggaccgggcatcgatctgggagtacatcgcgacgggcgacccgcatgccgcccgacgtctcgacgaactgttcgaccgtgcagcagaccacctgacagcatatcccgagatgggcaaagccggcatcattcccggcacgcgtgagttgatcccacatgaaagttaccgcctgatctacgagatccacggcggcgccgtctggatcatcgccctggtgcacacctctcgccaatggcccccgttgatcaccccgccccgaaccgatcgatgatcgtcacgccggtgccggggaagcggtccatcatggtcagcaggcgggtgccttcgtccagatcgacgcgggcgccgatcagcctttccggctgaagccggccgcggcggatcatctccagcatcgccgggtagcgatgggcctgcatgccgtggctgcccagcagttccagctcccaggcgatgacgcggtccatggggatggcggggcgggcctggtcggcgagcagcaggccgatctggacatgccgtccccggcggcggagcgacagcacggaattcacgcaggtcatcgggtggcccagcgcgtcgatcgacagctgcacgccgccggcaccgcggtgctgatggggtctctggtccgtgatcatgggcttgattatctgttggcggccagcgtgcccgccggcctgcttgaaagcctgacgaccgcgcggatcgtcgacgggatgaccgtctcgcgctccacgacaagccgggtgcggcggagcggccggcggggcatcgagtgggacaccgttaacccttcgaccataactccggctatactgttctccgattccgttcgtaccggccagagggcaagccgttgtcgttgcagaaggcgtcgtccaaggaagatcatgcccgcccgcggcgcaggcccgggccatggacgatcagtatcgtcgtctgcggcctggccctggcgctggtcgcgggcgtcctgcaggaccgggccaaccggcaggcggcggatgcgcgcttcgacgagatcgcccgatcgatcgccgatgacgtgctggataccatccggatctatcagtacggcctgcggggcgcccgcggggtgttcgtggtccatggagcggataccgtccggctggaggatttcaagcgctatgcccgaagccgggatgtggatgcagagtttccgggcgcgctgggcttcggcttcatccggcgtgtgccgcaggacagcgtcgacggcttcgttgcggcccagcgcgcggacggccgccccgacttcgccatccgccgactgagcgaacatcccggcgaagactacatcattcaatacatagaacctgaaggacccaacctgggtgctgccggtctggacatcgcgtcggaagccaatcggcggaccggggcgtttgaggcgatgcggaccggtcaggttaccctgaccgcgccgatcaccctggttcaggccaccggcgcccgcaatcgcgggttcctgatcctgctgcccacctatgagagtgacaccatgccggtgtcggaagcggagcgcctggccatgggcgtgggctggagctatgcgccgctgatcatcgacgatgtgctggcgaccgtcaggcggccggaggccgtcgaggtggcgatccgcgacctttcaggcgacgggagtgtcgacaggttctatgagaccccgggcttcgatgcggcgacggcgttcgacacttctgtcgccaccgacattttcggccggcgctgggcgatcgacgtcagggcgcatccggcctttgtcgcggggctccagcccacatcgccctatctgacgagcggggccgtggttctggcaatcattctgcttgccggctttgcccaggcgcaggccaatcggtcgcatcgccgggcgatgcgggcacaggagatggcacggctggcacagacgctggagcgggaggtcgcggaccggaccgaggaactgcgcgagcgggaggcccgtttcaaggcgctgaccgagctgtcgtcggactggtactgggaaaccgatgcccagggccgcttcaccgacgcctctgccggcgtcggccgtatcgggctggacccggagggcatgatcggccaaacccggctggacctcgcctccgggagcgaacagccggggctggtggattatgccgaggccctggcacaaggtcgggctttccggggcatcacctacgacctccgggatctgacggggcgtctgcgccatgtcgagatcagcggcgagccgatgctcgacgaggagggccgggtaaccggctatcgcggatcgggacgcgacctgaccgatcaggtcgaggcggagcgctccgccgccaaacagcgggcgatgcttgcggcggttttccgctcggtgcatcacgcggtcgtcgccgtggaccggaacaccgggatcattgtctggaatgagcggttcgagaccttgaacggtatcgcacccggccagttgacgccgggcatgtccatccgcgaggtctgcgcgctcagcaccgacaagggcgaggatctgttcgagacgatcgcatctgaagacggcgcgctggacgccgccggtttcccaggccggcgcgagatcacgcttgccgacggacgcatcgtcgaaatcttcgtcgagccgctggacgaggacggccaggtcatcacctgtaccgaagtgaccgaggcccgccgccgcgaggcggaggttgtctatgcccgcgacatgctggccggtgtcatggacgcctctctggatggggtgatcagtttccgggccgtgcgcgacgaggagggccggatcggcgatttccgcttcgagctgatgaaccggtctgccgagcgcttgatggggcgcagcgaggccgatctgcgcgggcgaaccatgttggtggagctgccgggcaatgccgaagacgggttgtacgaccgctatgtcgaggtggtggagacggggcaggcacagctgttcgagcactgctatacccacgacggcattcacgcctggttccggatccaggcagtgaagcacggcgacggcttcgtggtgaccttctccgacatcactgaggccaaggcgcgggaggcccgggttcaggaaagcgaagcgcgcctgcaggccgtgttcgagacggtgggggtgggcatcatagtgatcgatgcctcgggccggatgacgctggtcaactctgccacggagaagctgttcggctggccggccgaccagatgatcggtcgcaatgtgtcgatgctgatggatccggatctggcggccgttcatgacgattatatcgaccgctatatcgccggcagcccgctgcggatcatcggggtcggccgcgagctggaagggctgcggcaggatggcagcagcttcccgatcgaattgtcggtgggcgaattcgcggcagaagacggacgcatgttcgtgggcgcaattgccgatctgtcgacgcgcaaccgctccctggtcgatcttcgcgaagccaatcagcagttggagcagcaggcgagcgaactggcctcgctcgcctcggcactcgaactgtccaagatcgtggccgagaccgccaatcaggccaaatccgacttcctcgccaatatgagccacgagatccgcacgcccatgaacggtgtgatgggcatgacccatatcctgctgggcacggatctcacgccggagcagcggggacatgccgagacggtgcgggaaagcgccgaggccctgttgggggtcatcgacgacatcctcgacatctccaagctcgaagccgagcgggtcgaactcgaacacattccgttcgtgcttggcgacgtgctggaaggtgtggcagccatcctggcgcccagggcgcgcgacaaggggatcgagatcgcctgctatcccgacgaggatgcgggcggcgtctgggtgggagatccgacgcgcctcaggcagatcctgctcaatctcgccggcaatgcggtgaaattcaccgagcgcggccatgtgacggtcggtgcttccgtgggggccgggctgaatgacgggcgttggcatctgcgtttcgaggtgcgcgataccggcatcggcatgacggccgaacaggccggccggctgttccgcaagttcagtcaggccgacgcctcgatcacccggcgtttcggtggtaccgggctgggcctggcgatcagccagaaactgatggacctgatgggcgggtcgatcacggtcgaaagccgcatcggcgaaggatcggtgttccggttcgacgtcgtcctggaacgcgggaccgaagcgccgctccgcccgaccgaagaaatcggcgatcatctgcgcggcatgcgggccttgatcgtggatgatctggcggtcaaccggcgcatcctggcccatcatctggttcaactgggcatgatcgtggatgaagccagcgatgtcgccagcagtctgagcgtcatcgaagagcagcgtcgccgcagccagatgatcgatctggtgatcacggactacaatctgggcggcatgaacggcgtggagcttgccgaatggctgcgcatgaattcccatttcaggggtgttcggctgatcctggccgcgtcggagctgcccacggtggacaagcttcagtccttcgatgccgtcgtcgccaaaccgatcagaggccgcgagctgatggttgcactggcgcgggccttcggtattcgggatgaggagacggcgccgtcgtcatccgcggcgacgcaggagcgggctctctccggcgacggccggcatgtgctgctggtcgaggacaatgccgtcaatcagaccgtcgccagaacgatcctgagcgatgcggggtatgtcgtgaccatcgtcggcgatggcgaacaggcggtctccgcctgcgccacgacgcagttcgacatcgtgttcatggacgtccagatgccggtgatggacggtatggaggccacacgccgcattcgtgccgccgaagcgcgggagggcagggaccgggtcgcgatcgtcgccatgaccgcgaatgccatgagcggcatgcgtgaagaatacctggcggtcggcatggatgatttcgtgccgaagcccttcgctgcaccgcagcttctggaggcggcggcccgctggtcgtccggtccggcgtcggccggggcggccgtcgatgacgcagtgtcatcggcggaagatctgccgccgatcctggaaaccgggccgatggagacgttgaaggggctggtgtcgcgggacgccttcctcgacatggtgcagaatttcgcgacgctgggccgcgagcaggtgtcggcggtacaggaagcctgggctcatggcgatgtcgaccggcttcggcaggcgggccatgacatgatctcagtcgccggcaattgcggcctgctcaggctgctgacgatcgcccagcgcctgcaaagcgccgcgaaagcccgggatctggcgacgatcgagacgctggttgctgaggtggcgaaggtcgggccgatctcgtgggagaggttccacgatcacttcatcggctgacggcgccgattccggcgtcgtcagcctgcccggcctccgtcaggcgatttcgaaccgatcgatgatcgtcacgccggtgccggggaagcggtccatcatggtcagcaggcgggtgccttcgtccaggtcgacgcgggcgccgatcagcctttccggctgaagccggccgcggcggatcatctccagcatcgccgggtagcgatgggcctgcatgccgtggctgcccagcagttccagctcccaggcgatgacgcggtccatggggatggcggggcgggcctggtcggcgagcagcaggccgatctggacatgccgtccccggcggcggagcgacagcacggaattcacgcaggtcatcgggtggcccagcgcgtcgatcgacagctgcacgccgccgcgggtgatctcgtgcacctggcccggcacgtcgccgttggccgtcgtggtggcgtcgatggtggcgacggcgcccaggctccgcgccagatccagcttcgcggggtcgatgtcgatggcgatcacctgcgcgccggcggcggcggcgatcatcaccgccgacagcccgaccccgccgcagccatggaccgcgacccattccccggcccgcacccggccctgatcgatcacgccgcggaacgaggtgacgaagcggcagcccaggctggcggcgacgtcgaagcccatctcctcgggcagggctaccaggttgacgtcggcatgatcgatggcgacatggtcggcgaagctgccccaatgggtgaaacccggctggaactggttttcgcaaacctgatgctggccggcggcgcattccccgcaatggccgcagccgccgacgaagggcaccgtcacccggtcgccctcggcccagcgggtgacgccggcgccgaccgccaccaccgtgccggccagctcgtgccccggcacatggggcaggcagatatcggtgtcatggcccatccagccatgccagtcgctgcggcagagccccgtggcccccaccttcagcaccacaccgcccggccgcggggcggggtcgggcagggtggtgacggtgatcgggccctgaaacctctcgaaaatggcggcgcgcatgggggctccctcgggaacggtgtggttgcccggggttttagcacggccgggagatggtgtagcccgcaatcgaccaggcgggcgatcagcccgggcggtctattgaccctgtacgccgggcacccgtgccggttcccgcacggtcttcggcgggtcgaccaccggtgttgtggcggcgtggccgccgctggccgcgcgcgtggccagatgggtcagcagctgctgcaggacgatgaacaggaacagcaggatgccggtcacaatcttgatccaccagctggacaggctgccgtcgaaggtgatgtaggtctggatcagcccctggatcagaatgccgatgaaggtgccgaacatgctgccggcgccgcctgagagcagggtgccgccgatcaccactgcggcgatggtgtccagctccacccccacaccggtcagggaatagccggaggcggtatagaacgagaagacgatgccggccagccccgccagcaggctggacagcgtgtagatggcgatcgtcgtccggccggtgcggatgcccatgagggcggtggtgtcgcggccgccgcccagcgcgaagacattggtgccgaagcgggtgtagtggagcaggatcccgcccaggacgaaggtcgccagcatgatgatgccgatgatccgcaaccggccgcccccgggcaggcggagggagaaggccgccacttcctgataaagggcgtcatcgatcggcaggctgtcggtggacagcaggaaggccacgccccgggccaggaacatgcccgccagggtgacgatgaagggcggcacgtcgaaatgatggatgatggcgcccatggccgcgccgaacagggcacagatggccagcaccaggcagaaggcgagaagcggcggcaggccccagctgccgatgccgagcgccaggaagaccgtggtgaaggcgaccaccgatccgaccgagaggtcgatgccgcccgagatgatcacgaaggtcatgcccaccgccaggatgccgaggaaggcattgtcggtgatgaggttcatcaccacccgggtggaggcgatattggggtattgcagggcgcagaacaggaagccgagcaggaagacggcggtggtgacgatgacgggcaggtggcggcgcatcaacgcgtctcccgaagcaggcggttccgggggtggcgtccccgaagcaggcgatcccgggccgcggcgaggcgcggggtctgaagcagcagcacggccagaaccactgtcgccttgatcaccaggttcagctccggctgataaccgctgagcaggatgccggtgttcatggcctggatgatcagcccgccgacggcggccagcaccaggctgaaccgcccgccgaacagcgaggtaccgccgatcaccaccgcgaggatcgcgtccagttccagccagagaccggcattgttggcatccgcgccgcggatgtcggcggcggcgatcacgccggcaagggcggcgcagaagccgcaccacatatagaccgccaggatcatcagccgggtgtcgatgccggccaggcggctggcccgggcattggcgccggtggcctcgatcatcaggccgagtgctgtgccgcgggcgagcagcacggcgaccagcagggtcgccgccgccagcaccaccggggccggaatgcccagcagcgcgccgctgccgagccaggcgagatcgggcgaggagaaggtgacgatccgcccttcggtgatcagctgggcgatgccgcggccggcgaccatcaggatcagggtggcgacgatcggctggatgcggagcacggccaccagcagcccgttccacagcccgcagagcagcccggtgccgagcgccgcggccaggcagacggccagcgactggctgtcggcgaggctggcggccaccgcgcccgagatggccatgaccgcgccgaccgacaggtcgatgccgcgggtggcgatgaccagaaccatgccggtcgccagcagcaccaccggcgcgccgcgattgaagacgtcgaccaggctgccgaacaggcgcccgtcctgaaggcgcaggtcgaagaactggggcgacaccatccagttgatcagcaggatcaggatcagggcgccgatctgggcgccgcctttcctgggataggcgatggacactgtcttgctccccccgtccttgtgccggataccgtgttcttgttctgaagtggcccgtctctggattggccgctcagtctgcggcgatggcggccagcacccgctgttcgttgaccgccgcgccggtcagatgggcgacatggctgccgtcgcgcagcacggtcacccggtcggaataggacacgatctcctccacctcggacgagatgaccagcatggccagcccgctgtcgcacaggctgcggatcaggcggatgatctcggcatgggcgccgacatcgatgccgcgggtcggctcgtccaggatcaggatccggggttcggtggccagccagcgagccaggatcgccttctgctggttgccgcccgacaacaggccgatgggcttgtccggatcggccggacggatgtcgagcgccttgatgaaatggtcggcgatctctttctggcgtttgcgcgacaggggccgcgtccaccccatacgggcctgcagggcaaggatgatgttctcgcgcaccgacaattcggcgacgatgccctcggtcttgcgttcctcggggcagaagcccagcccctgtttcagggcatcgcgcggccccaggatccgcgccgggcggccgtccagatgcagcctgccgccatcggcccggtctgcgccgaagatcaggcgcgcggtttccgtccgccccgaacccagcaggcccgaaagccccagaacctcgccgcgccggagcgtcagatcgaagggcgccacggcccccttgcggccgagcccttcggcgcggagcagcggcggggtgtcgtcctggtcctgggtggcgcgcgcgcgttcctcttccacgccctgaagctcgcgccccagcatcatgccgaccagctccatgcgcggcagcccggcgaccggccgttcgccgaccagacagccattgcgcagaaccgtcagccggtcgcagatctcctgcacctgatccaggaagtgggtgacgaacaggatgcccatgccctggtcgcgcagctggcgcatcaccctgaacagcacctccacctcgcggccgtccaggctggcggtgggttcgtccaggatcagcaccttcgccgacatgtcgacggcccgggcgatggcgacgatgtgctgaaccgccaccggaaagtcgcccaagggcgcgccgacatcgatccggaggccgaagccctgcagaagatcgcgggaccggcggcgcatctcgcggtcgcggaccaggccgaaacgggtgggctggcgaccgaggaacaggttctgcgccacggtcagattgggcagcagcgccacctcctgatagaccgtggcgatgcccgcggccagggcctcgtcgcccgatcgggggcggatctcagcacccgacagccgcacctcgccggcatcgcggggcgtgatgccggtgaccgtcttgatcagggtcgacttgccggcgccgttttcccccagcagggcatggatctcgcccgcgcgcagggtcagatccaccgatttcagggcctggaacccgcccggaaaggtcttggacaggccgcgcacgcacagcagttccggcgcctcgttcatgagtctctccctcccaggcatcagggatcgtatcgcccgccgggccccgggaagccggttcccggggccggcgggccggcggtcagtagccgagcgacttgcgcgcgtcgtactggcccatcggatcatcggccttggtatagagcttcgattcggtctggatccatttcggcggcgccttgccgtccttgtaggcggcgagcgcgtcgaaggccgggccggccatgttcggggtcagctccaccgtcgcattggcctcgccctcggcgatcgccttgaagatgtcgggcaccgcgtcgatggagacgaccaggatgtcggtgcccggcttcagcccggcttccttcatcgcctggatcgcacccagcgccatgtcgtcgttatgggcatagagcgcgcagatcgtcttgccgccgccttcggccttgatgaagctctccatcacctccttgcccttggcgcgggtgaactcgccggtctggctgcggatgatcttcacattgtcggccccggcgatgcccttcgcgaagccttccttgcggttggtggcgaccgaggcgccgaccgtgccctgaagctccacgacattgcagctcttgccggcgacggtgtcgaccagccatttcccggccacctcgccctcgtgcacgctgtcggaggtgacggcggtcagatagagcgagggatctttggtctcgatgctccggtccagaagcacgaccgggatttcggcatccttggcctcttcaaggacggcatcccagccggtggccacgaccggggccaggaagatcgcgtccacgccctgggcgatgaacgaccggatcgccttgatctggttttcctgcttctgctgggcatcggcgatcttcagcgtgatgccccgcttttcggcctcgaccttggagaccgaggtctccgcggcgcgccagccggattccgaaccgatctgcgaaaagccgacggtcatgtccgccgcgatggcgggtgtggcgagggcggtgaacagaacgcctgccagcagccgggttttcaatgtcatctccgtgatctccctagatgccgccccgtctgatcgggggcggtcatgccgtgatgagcgagcggtgccgatgcgcaaccggcagaggggggccgcccgcgcacccccgccggttcaaccctgtccgttcaccgcatatcggtgaaggccagggccgtatgctgttcatagacctctcccggccgcagcagggccgggggaaagcccgggtgattgggggcatccggccagagctggggttccagcgccaggccggcatggggggcgaggggacggccgtcgaggccgggcatgccggcggcgatcatcgccccgtcatagacctgcagccccggctcggtcgtctccacggtcagggtgagcctgccctcgggcgccgtcagccaggccacgggccggatcgggccccgggcgtcggcgaggcagaaattgtggtcgaagccgccggccggtgcccctgggatcaatgcctcctgcatcaacgttacaccccggcgcagatcgaagggggtgcctgtcacggggcggcgttcgccggtcgggatcaggtcgtcgtccaccggcagatagctgtccgccgcgaccttgaggcgatggccggcgatggtcgggcggcctgacaggttgaggtaggaatgatgggcgaagttgcagagggtttcggcatcgctggtggcccggacatcgatccggagcaccgggccgggggcgatgctgaaaccgacctccacctccagattgcccggaaagcccatatggccgtcgggcaggcggtcggtcaggctgacccggtcggccgccaccgcccggatgcgccagttccggcgggaggatccgtccgctccgccatgcagcaggtgccggccccggaaattggcatccagctgcacgatctgcccgccgaccggcgcccgggcgtggccgatccggttggcatagcgcccgaccatggcgccgaaatagaggtcgggatgggccagatagccctcaagacgatcgaagcccagcaccagcgggtgctgcacgccgtcgagccgcagatcctggaggatggcgccgagggtcaggaagcgggccgtcagcccgtgggccgcgatttcgacccgctccacgatctcgccggtgggcagtgctccgaaaccgctcaacagacatcctccgtcaggatcacccggggttcgggcaggccgggcacggccgtctccgccgccagccaggtcaggccggcatcgggggaggggtcgccatcggcggcgctggtgacataaaggctgcggaagtcgggcccgccgaaggccgggcaggtggtctgggcgaccggcagggtgatggttgcgatcacgtcgcccgcgggcgaataccgcaccacctggcccgtaccccatcgggcattccacaggcagccttcggcatcgatcaccgcaccatcggggtggatgccgtccggccgcagatcaaggaagacctcgggcgcgcccctgggccagccctcggcatcgagcggctggcgccagatgatgccctcgcgggtgtcggcgtaacaggcgacggaacggtcgggtgcgaagcagatcgcattggggatgcctatgccgccgcgcagccgtgccagccggcccctgtaccatcgatagatggagccatgccccggcgcaccggttttggccatggtgccgatccagaacccgccccagggatcggcccggccgtcattggagcgggtgagcgggttgtccgcctccagcgccgccagatccgtccgcgtactggtctgaaggtcgaagacgaaaagcgcccgttccgaggcgatgagcaggcggtcgtcatccacccatcccgccgccgagaccatgtccggaaacagccaggacaggccgtctcccgccgggctccgcgacagcaggcggcggtccaggatatcgaaccagaacagctggccgcggcgcggatgccagagcggcccctcgccgagccggcagatccgggcgtcgtagatacgtgcgtcctggctgggcgcggtcatgatggagaccccgtcatctggcatcgggcggcagaagatcaaccggaaggttctgatagcacaccggccgcaggaagcgccggatggccagcgtgccgaccgaggtggcgccgaaattggtgctggccgggtaggggccgccatggaccatggcatcggccacctccaccccggtggggaagccgttggccaggatccggccggccttgcgctccagcaccggcagcagcgcggccgcgagcccggcatcctctgcgtccatctgcagggtgcaggtcagctgcccggccaggccccgggccagcctgagcatctcgtcggcatccgccacccgcaccagcagcccggccggcccgaagacctcgtccgccagctccggacgcgcgaaccaggtggcggcgtcgacctcgaagaagccgggtgccgcctggcgcgtggcgttgtcgcccaggacatgggtcgtcacccccgcgatgccggcgatccgcgcgcgtccacgcgcataggcggcgccgatgccggcggtcagggtggtctgcggcccggtggcggtcagcgcttcggtggccctggcgacgaagccgtcggcatccggcccgtcgatcgccacgaccacgcccggattggtgcagaactgccccgcacccatggtgagcgaggccgcccagccccgggcgatctccgcgccccgtgcggcgagcgcattgggcagcaggaagaccgggttgatcgagcccagctcgccgaagaaggggatcggctccggccgcgcggcgcagaggtcgaagagcgcccggccggcgccgagagagccggtgaagcccacggcgcgcacggtcggatgggtcaccagcgccgcgcccagatcatgggtattgccctggatcagcgcgaagacgcccgggtcgatgccgccggcggtgatcgcctccaggatcgcttcggcgacgatctcgcccgtgccgggatgggcggggtggcccttcacgatcaccgggcagccggcggcgagcgccgcggccgtgtccccgccggcggtggagaaggcgagcgggaagttggaggcgccgaacacggccaggccacgggacccagaggacgctggatcatgcgcagttcgggccgcggcagcggcgcgcggtcgggcagggcggcatcctggcggcggtccagatagtcgcccgcgcggatatgtccggcaaacaggcgcagctggccgaccgtccggccccgctcgccctccagccgcgccgcgggcaggccggtttcccggctgccgatcgcggtgatggcggggccgcgggcctcgatcgccgtggcgatggcctcaagaaagcgggcgcgctcgtcccgtgtgctggcgccatagctctcgaaagcccgctcggccgcagcggcggcgcggtcgacctcggccctgccgccgatggcgaaagcctgggcggcaccctcggtcggctcggacaggaacgtcccggaaccggccagccaggcgccgtcgatgaggtgctgtccccggggtgtaaaaccgggggatgaaacggtggatgcggtcgaggtcacgccggacgatcctttgccatgaaggggcccctcactcgatgaagggatcggtggtcaggcggcggcccagcatgaaggcatcggccacatgtttcagcggcgacaggtccacctcgctggtgcgggttgcgatcagccgggcgaagcgggcatagagcccgtcatattccgatccgagcgcctcgccctgcgacaggttctgcccgccggccgatacggtggcgccgccatcggcaagcgacagcacgccgtcatcggtttcgaattccatggcccagctttgcgggccttcctggcggaagtcgaaatcggcggcgatgggggcggcaccggtcaggtaggacaagcgcgcggcgatgggggtttcctggttttcgggaaattccagctcggcaccggtcagacgaagcggcgcgggcaggatctcggtcaggatcgagagggcgttgatccccgggtcgaagaccccgagcccgccggcctgccagatccagcgctgccccggatgccagcggcgcacatcctcgcgccaggtgatcgtcccgcggaggatctgccgcccggcgagccaggccttcgccgccggcacgccagcggcgaagcgggaatgccaggttgcgaacagcacccgtccccgcgccgccgccaggtcggtcagggcttcgacctcggcgatcgtcgccccgggcggcttttccagcatcacatccagccccgcctccagcgcctcgcgcgccatggcatggcgcacctggggcggtgtgcacagcgagaccgcggtgacctcgggctggttgtcgagcagtgcggcgaggctggtgtaagccgggatgccgtccagcccggcattgcggctgacggtcgcggccagccggaaggccccggatttcaggatcgagggatggtgctggtcgatggcgatcttgccgagcccgaccagggcgatcggcgttccggtcagggtgtcagtggctgtcacggggcacctccttgccgcggcagccgcgcaggaaatcgaagtcgacgccggtatccgcccccatcacatgctcgtggaacaggcgcacatagccgccctctggcggggagacggggctggtccaggcggccaggcgccgggcgatctcggcttcgggcacgtccagatgcagggtgcgggcctcgacatccagctcgatcatgtcgccgtcgcgcacgatcgccagcggcccgcccaccgccgcttcgggcgaggtgtggagcaccaccgtgccataggccgtgcccgacatgcgggcgtcggaaatccgcaccatgtcggtgatgcccttgcgcagcaccttgggcggcagccccatattgcccacctccgccatgcccggatagccgcgggggccgcaattcttcagcaccatcacgcagctctcgtcgatatccaggctctcgtcattgatcctggccttgtagtgctcgatggtttcgaacaccaccgcccggccccgatgcttcatcagatgcgggctggcggccgagggtttgatcacggcgcccaagggcgccagattgccgcgcagcacggcgatgccgccatggggggtgagcgccttgtccgccggccggatcacatcctcgttccagttccgggcgtccttgacctcgtcccagagcgtctcgcccgagacggtcaggacatcgccctgcaacaggccatcctcgcagagccgcttgatcaccaccggcaggccgccggcatagaagaattcttccatcaggtatttgcccgacggcatcagattgacgatggtcggcacgtcgcgccccagccggtcccagtcgtcgagcgtcaagtcgacacccacccggccggcgatggccagaagatgcaccaccgcattggtggacccgccgatggcgccgttgacccggatggcattctcgaaggccggccgggtcaggatgtccgacggcttcagatcgtccttgaccatctcgacgatgcgccggccggtcagatgcgccatgacccggcgccgggcatccacggccgggatggcggcattgccggacagcgccatgccaagcgcctcggccatgctggccatggaactggcggtgcccatggtgttgcaggatccggcgctgcgcgacatggcctgctcggcctccaggaagtcttcccgggtcagcttcccggccttgatgtcttccgacatctgccagagcgccgtgcccgagccgacccgctcgccccggaaccagccgttcagcatcgggccgccgctgaccacgatcgcgggcaggtcgacgctgcaggcccccatcagcaaagcgggggtggtcttgtcgcagccggccatcagcaccacgccgtcgatcggctgggcgcgcagcgcctcttccacatccatggccgccagattgcggtagagcatggccgtgggccgcaggctgctttcggccgccgagaagaccggaaattccaccggcagcccgcccgcctcgtagacgccgcgcttcacccgctcggccagatcacgcagatgggcgttgcagggggtcagctccgaccaggtgttgcagatgccgatcaccggccgtccgtcgaacagatcgtagggcaggccctgattgcgcatccatccgcggtgatagatgttgtcccggctggtgccgccataccactcctgggaacggagccggcgcggccatggtgccttggtgaatgccatgagcgatggcctttcccgtcagagtgatgccacgcgaagcgcgccgccaccggcgacgggatccggggcgatggccaggcggttgcgcagcggcaggccgaaaccgggcacctcgatctcgaacacatcgccgggttccgtgcgcagcccggccgcaaaggagagcgtggcggtcccgaacatgtggacatgcacatcgcccggatggcggaacagctcgtatttgaagtggtggtgctccagattggcgaagctgtgggacatgttctcttcgcccgacaggaagggggcatcgaacagcacctcgtcgccgcgcagcacccgggaccggccctcgatgctcgcgggcggcgggccgatccgcaattcggggccgaaggcgcagcggcgcagcttggaatgggccaggaacaggtaattggtccgttccgtcacatggtcggagaattcattggccaccgcgaagcccagccgccagggcgtgccgtcgggcccgatcacatagagcccggcgatctcgggctcctcgccgccgtccagcgcgaaggcgggtgacagcagctcggcctcgggtgcggccacgctctcgccattgcccttgtagaaccattcgggctggacacccacctgacccgcggccggcttgccgcccttcagccccatgcggaacatcttcatggaatcggtcatgccggcctcatcgtcgccgccgccatgcatgctgttccgtgtggaggccgagcccagatgggtcagcccggtgccggtgacgtaaagatgggccgggtcgggatggtcgatcggcggcaggatccgcccttcgcggccggcctgctccagatccaccgcccggccgggggtgatctggccaagcgcctcggccagtgtccgcccccggtccaggcagtgcatcgccagggcataggtggtgtcgaagccggtgacctcgtgggcctcggtgccgtcgcgcaccaccaccgcccgtgtgccgtctgtccgcacgatctgggaaagcaacatggcctcagcctttcttcttgttgtagacgtcgaacaccaccgcggccagcagcaccaggcccttgatgacctgctgccagtcgatgccgatgccgagaatggacatgccgttgttcatcacgcccatgatgaaggcgccgaccacggcaccgaccacggtgccgacaccgccggccatggacgcgccgccgatgaagaccgcggcgatcacgtccagttcgaaggacacgccggctttgggtgtcgcggtgttcagccgggcggcgaagaccaggccggcaagggcggccagcatgcccatattggcgaaggtcaggaacaccagcttctccgccggaatgcccgacagcttggccgccttctcgttgccgccgatggcatagatccgccgcccgatgaccgtgcggttggtgatgaaggaatagaccgcgatcagcagcgccatcacgatgaacacgttcggcaggccccggaaggtcgccatcagatagctcatatagacaagtgcgatggtgatcagggcgtatttgccggcgaagaaggcgaagggttcttccacaagcccggtcgcggcctgtttgcggcggctgcgcaccgccatcaccaggatgcccgccgccacgacgatgcccgtcaccagcgacagggtgttgaagcgtccgctgccgaagatgtcgggcacgaagcccgaggcgatcagctggaaattggcggggaacggacccacggactggccggccagcagccagagcgtcagccccttgaagaccagcatgccggccagcgtcacgatgaaggacgggatcttgaagaaggcgacccagaagccctgggccatgccgatcagcgcgcccacggccagacagatcagcccggccaggacatagggcacctcccactggacgatcatcaccgcggccagcgcgcccacgaagcccagcaccgatccgaccgacaggtcgatatggcccgagacgatcaccagcagcatgccgaccgccatgatgacgatatagctgttctgcaggatcagattggtcaggttgaccggcttcagcaggatgccgtcggtggcgacctggaagaacaccatgatgacgatcagcgccagcaggatgccgtattcccgcatgtgcttgcgcagataggcgcccatggtgagcccggacgcgggggcggtctcacgctcggatggtttcgccaggtccatgggtctggtctccggaagtgacgatcatcgccatgatcttttcctgggtggcatcggccgtcggcagctcgcccacgaaacgcccctcgttcatgacgtagagacggtcggtgatgcccagcagctcgggcatttccgaggaaatcacgatgatcgatttcccctgggccgcgagcgcggcgatgatcgaatagatctcgaacttcgcgcccacatcgatgccgcgggtcggctcgtcgaggatgaggatgtcggggtcggcgaagagccatttggacagcaccaccttctgctggttgccgcccgacaggttcaccgtctcctgctcgatcgaggcgcatttgatgttgacccgcgcccggtagtcctcggccacgccggcttcgcggtgctcgtcgaccacgccggcacgggccaccgcatccaggttcgccagcggcacgttgcggcggatgctgtcggccagcaccagccccagacccttgcgatcctcggtcgcataggcgagccccgccctgatggcgcgggggatggtcgacagatcggcgggccggccgtggatcctgaccgtgccggaaatgccctggccatagctgcggccgaacaggctcatcgccagttccgtgcggccggcgcccatcagcccggcaatgcccagaacctcgccctgccgcaggtggaagttcacacccttgaccaccagccggtcccgatgggtggggtggtgaacccgccagtcggcaacctccatcaccgtgtcgccgatgcggggcgtgcgcggtggatagcggtcggacatcgaccgtcccaccatgtcgcggatgatttcgccctcgccgtaagagctgtcggacatgtcgcggctggcgacggtggtgccgtcgcgcagcaccgtcagactgtcggccacccgcgagacctcgttcagcttgtgagaaatcaggatcgcggtcaggccctcgcgcgtcttcagctccaccagcaggtcgagcagggcctcgctgtcgcgttcgttgagcgaggatgtcggctcgtccaggatcagcagccggacttttttggacagcgccttggcgatctccaccaactgctgcttgccaaggcccagatcctcgacccgggtgtccgggttttcccgcagccccaccttggcgagcagcgatgcggtgcggcggcgggtctccggccagtcgatgaccccgtatcgggcgatctcgttgccgaggaagatgttctcggcgatcgacagttcgggcaccagggccagttcctgatggatgatgatgatgccccgggcctcgctgtcggcgatgccccggaaggccatgggctggccttcatacaggatctcgccctcatacgacccggccgggtagaccccgctcaacaccttcatcagggtggattttcccgccccgttctcgcccaccagcgcccggatttccccgcgccgcacggcgagattgacgcggtccagcgccttcaccccaggaaattccttggtgatcccgcgcatctcaaggatggcgtccatccgttcctcccaaggggtctcgcccgaagccgtcctttgccccgggcgagggatcccgccggttactcgatctcggacgccttgtaatagccgctgtcgatcagcaccgaccgccagttggccgcggtgaccggaaccggctccagcaggtaggagggaacgaccttcttgccgttgtcataggtggtggtgtcgttgatttcgggctcgccgccgcccatcacggcatcgaccatgccgaccgtcacccgggcgagttcgcgggtgtccttgaagatggtcgaatactggtcgccgcgcaggatggccttgaccgaagggacttcggcatcctggccggtgacgatgggcatggccatgtcgcccgagccgtagcccacccctttgagcgacgagatgatgccgatcgacaggccgtcatagggggagagcaccccatggaccttcttgcccgtgtagttggccgagagcagattgtccatgcgcgcctgggcgaccgcgccgtcccagcgcagcgtgcccaccttgtccatgcccatctggcccgaggggatcaccaccgagccgtccttgatcagcgggtcgagcaccgacatcgcgccgttgtagaagaaataggcgttgttgtcgtcgggcgagccgccgaagagttccacgttccagggcttctggtcggggaagcgttccttaaggccctcgaccagggtggtggcctgctggacgccgaccttgaaattgtcgaaggtggcgtaatagttcacatgctcgctgtcgcggatcagccggtcataggcgatcaccttgatgccggcggcatcggcgttggcgagcacgttcgacaaagtggtgccgtcgatcgcggcgatgaccaggacgttcacgcccttggtcaccatgttttcgatctgcgccagctggttgggaatgtcgtcttcggcatattgcagatcggtctcgtagccggcggccttgaactgctcgaccatcgagctgccgtcggagatccagcgggcggaggatttggtgggcatggagatgcccacatatccctcgccggccgatgccaggtccgcgccccccatggcgatcacggacaggccggccgcaagcgcgaccgtcttcaatgccctcatcttttcctcccttcgcggcgccccctggttcagccccgcttctgcggagtccgccgggacggcccttgcttttgtggcgcaactcatcggcggacggtccggccggtgattgccgctgggtctattggtaagaggattggatatgccggtcaaatcggcataatcatgttcaatatatcattatccgaatatcacacgcgtcggcaggacgggaggttgccatcatggagagcggcccgaacaaggtggggcgacgcgaccggctgatcggccgcggcatcaagttccgtcatctgcgggtgctggcagagctgctggacaccccgcaggtcagtgctgccgcggcacggctgaacatgacccagcccaccgcctcgcgcctgctggccgaggcggagaccatcgtcggcgtgcccctgtatgaacggcatccgcggggcatccgcctgaccgtgatgggggcaaccctggccgaacgcgcccggcgcctgctgcgggatctggaccagaccgatcgcgagatcgaggatatgggccgcggcacccggggcaccgtcaatatcggcgcggtgaccgggccggcgctggagatcatcctgccggtgatccgccagctgcgcgtgacccatcccgacatccgcgtcaacgtatcggtcgacctgtcggacaagctggccggcgagcttctggcgggggcggtggatttctacatcggccgcctaccggccgaccgggatccgcgcagtttcgtgatccgcaccatcggcgaggaacccttgagcctggtggtccgcaagggccatccgctgacccgcaaacccgccccgacgctggaagactgcgtcgcctatgactggatcctgcagccccagggcgggctgatgcggaccacggtagaggcttatctgctcggccgcggatgcaccctgccggaccgggtgctggggacgtcgtcgatcctgctgacgctggccttgatcgccagttcgaacggcatcggcacactggcacgcaccgtggcgcggttctatgccgatcacgaaggcatgggcatgggcatcgtgaccctgcccgtcgccgaggatatgcgggtgacgccttatgccctgatccgcccccgcgatgtcgaccccacgccggcggcagagaccgtgttcgccatgatccacgagcgtatcgacaatctggccccgaccatctgaatggggcggaatgtcacggcgggccataatattcttctgatatacatatattctctgccctgtcggagcctcatcccatggacgacgtcaccatcgcccgcgtcattcacgtcctggcggtcctgcactggatcggcgggctatggctggtcaccttcgtgctgctgccggccgtcggccggatggccgaacccacccggcggctggaggtgttcgaggcgatcgaggggcggttttcagtgcaggcgcgggtgtcggtggtgctggccgggctgtcgggcttctggatgacctggcggatggatgcctggtggcgcttcgccgagcccggctattggtggatgcatgccatggtcgtgctgtgggcgatctttgccgtgatcctgctgatcgccgagccgctggtgctgcatgcctggttccaccgggccgccgccagccggcccgaggcggtgtaccggctggtgttgcgcgcccatcgggtgctgtcggcggtggccgcggtcacggtggcgggggccgtggccggggcgcatggcatgctgttctgatcggcgcgggggcgccggtcaatccatctcgatcaccagcttgccgaaggggccgcggtcgagatgggcgaaggcctcgcgcacctcatgggcgcgatagcgccgggcgatgaccggctgaaggcccagcatgtccaccgcgcggacgaaatcttccagccctcgccggtggccgacggcgatgccctggatcaccggcgccttggtcagcagcggtttgacattggccgagatttcggcgccgtcgagcacgccgatcaccgagatccgcccgccgggggcgagtgcgcggagcgaggtgccgaggccggcgccgcctgccacttccagcagatgatcgacaccgcggccgccggtcgccgccaccgccgcctctgcccagtcgccggccgtccggtcgatgccgtgatcggcgccgagcgcgcgtgcctgcgccagcttgtcggccgagcccgaagtgaccagcacacgtgcgccatgcgcccgcgcgatctgcaacccgaacagcgccaccccgccggtgccctggaccagcacggtgtcgcctgcccggatacggccgtattccaccagcgccatccaggcggtcagcccggccaccggcagggtcgcggcgccggcatcgtcgagggtgcggggggccgccaccagccagtcttcgggcagcaccgcgtgggtggcgagcaggccgggcagggtgccggccagggtatcgagcggcagcggccacgcgccgcccggtctgcggccgtcgatccagtcggggatgaactgcgcgatcacccggtcgccggttctgaagcgcgagacgccggcaccggtcgccagcacccgcccggccatgtcggaggcgggcgagaccggcaggctgagcggcaggcccataccggtttccaccaccatcttgtcgcgataattcagcgccaccgcgccgatcttcaccagcacctctcccgggccgggcgtggggatgggcagggtttcgggctggagggtcgcgatgtcatgggcggtgatcgtccagcgggtcatggtgccgtcggtcatggggcctctctccggcgggggatgatggagcccgcaggctagcctggaatttctgtcgccagttgcgccgatatgtcggaagattggcgcctggcatgcaacaaaagacggatcatacggcggatcatggaccggttgagcggcatcggcgtgttcgtggaggcggcggaggccggcagtttctcggcggcggccgagcgtctggccctgtcgcgctcggcggtcgccaagacggtgggccggctggaggcgcggctgggcgtgcggctgttccaccgcaccacccgcgcccaggcgctgaccgaagagggccaggccttcctggagcactgccagcgggggctggccgacatccgcgcgggggaggcgatgctcgcccatggtcgtcgtgccgtggcgggccggctcagggtctccctgccggtgctgttcggccggcgctgcgtcgcgccggttctgaccgggctggcccgcgagcatccggggctggagctggacctgcatttcaccgaccggctggtcgatctggtcgaggacggcatcgatctcgccatccgcaacggccccctcgacgatcaggccgggctgatggcgcggctggtcgcccgccagcggatgacggtggtggcctcgcccgactatctggcccggcggggggcacccgccgatctggcggcgctggccggtcacgactgcctggtctatctgcgcggcggccgggtgcgcggctggctgttcccgatgccggacggccgcgatgccgtgatccggccggcggcccggctgcgcttcgacgatctggaggcgctggccgatgcggcggcggccgggctcggcctcacctggctgccctgctggctggtccgcgaccggatccgcgccggcacgctggcggaagtgctgaccgaccagccggccaccgtcttcaccagccacgcgatctggccgcgcagcccgcaccccgacctgaagctgcggctggccgtcgaccgcctggccgagcggctgcccggcgcggcggagctttgatgggggaacggtgcggcgtgcccttgtcggggccttagcgcttgtctggggccttagcgcttttccggggtgatagtgaggcgcgtcttcatgtccgcggccgtcagaatgggaatcggaacgtcatctgcgagcaccagcagatcacggtccccggtgaggagtgcattggcgtggccggcaagcgccagcaccaggaagggctggtcgaacggatcgcggcaatccgggaccgcaggcggtgggacggggatcagcactgtctcgcaccagggcagatagtcagccagcaggtcctcgtgcccaggcaacggcatcggcaatatctgcttccgacaggttcacttcttccagcttggcccggacagcatcagcgcggttgatgcgaaccggggtgagtatgatgcggccgttctcttcgaccacatcgaaatactccgcgccctctaccgcagcgaccaccgcctttggcagagtgagttggtttttcgatgtcagttttgcgagcatgtagatgttcctggggcgtaaggaaatgctgacatcatgatttccaggattcaaggggacatgaggctgccggacacggttggagcccggcgccatcgtcacccccggcaccggtccagataccccaccagcatctcccccagcgcctgaccgaaggcctcgaccgcggccggtgattgcggggtttccgagtagtcctttccgaccgatttcagcgtgcgcatgatcacctcgccggtgagcgcgcggcgggcgtcgtcggcctcgggcagggcttcgcgcatgaaggcggcgagggcgtcgtcgacccgggcgcgggccgctttggcttcgggggcgtcgcgatagagcggggcggcgtcgtcgagggcgcggcggatggcggcctcttcgcattccgagcggaggaaggtcgtcgccagatcgcgcagccggtcggcgggcgcgcgggtggtatccgacaggatcgcatgcatctggcggctggtctgctgccattcatcgctttgcaggcggaacaggatcgccgccttgttggggaagtactggtagagcgagcccacggccacgcccgcccgttccgccacccgcgcggtggtgaaacgctgcgcgccttcggtcgtcagaacctgaaccgccgcttccaggatcgccgccaccagcccctcggaccgggcctgttgcgggcgttttcgcaaggaaatccgcggggtctgggcagggggcatcaggggctccgccaatgcgattagcgcgaatgcgacgatctcgtcatatttttagggcgaggcggcgcccctctcaatccgaaacgaccgatacccgaaatcctgtctgtcgagagggagtttccccatgtctacgctcacccaagggccggtcgccgacctgttggaccgcctgttcgccgaggccgccgcggcggaaatcccgccggccctggcccggctctccgccgaagagcgcgatcggctgatgcgcagccgaagcctctatcgggatctctatcatggtctggccgaggtcgcgctgccggtctcgcccacaaccgggcggctgctttacatgcttgcatgcagcctgaaggcgcggacgatcgtcgaattcggcacctccttcggcatctcgaccctgcatctggcggcggcgctgcgcgatacggccggtgcggatggtgccggccggatcatcaccaccgaattcgagcccgccaaggccaaccgcgcccgcgacaacctgcgggtcgccggtcttgccgatctggtcgaactgcgcgagggcgatgcgctggaaacgctggcccgcgatctgccgccggcgatcgatctggtgctgctcgacggcgccaaggtgctctatgccgagatcctggcgctgatcgagccgcatctccgccccggcgccctggtggtggccgacaatgccgaacacgcccccgactatctggcccgggtccgcgacccggccaatggctggctgtcggtgccctttgccggcgatgtcgaactgtcgatgcggctcggctgaccattggcggcccccccccctttaccgcccttatcttgtggtggagcgttccatgacgacctcttcagccggtgcgcaggcacggcttctgctgctggttgccgttcttttcctctcctatctctgcgtcgccatcccgctgccggtggtgccggtgcaggtcaccgacgggctggggctcggtaatcttcaggcggggctggcggtgggcatcgctttcctcgccaccatcctcacccgcggcccggccgggcggatatcggaccgcgcgggcgcgaagatcgcggttgcgcgcggcctggcgctttatgccgcgggcgccctggtctcgctgctcgccgggctgacatcactcgcgccgataactgcatttgcggttctgatcgccggtcggttgctggtcggcctgggcgagagcctggtcggcgtcggcgtggtcgcctggggcatcggcatcaccggcccggcgcgggccggccgggtgctggcgctggtgggggccgcgatctatggcgcgctgggcctgggcggcccgctcggcctgctgctgatggagcatgcgggcttcatgggggccatggccgtggcggcgctgctgccctgcctcggcctgatcgccgtcgcggccatgccgggggtggccccgcatcccgatgccgcgcgcccatccttcctgtcggtgatgggccagatctggcggcacgggctgatcgtctgcctgcagggcatcggctttgccgcgatcggcgccttcttcgtgctgctgttcctgaaccggggttgggcccatgccgggctggggctcgccgccttcggcgccggtttcgtgctggtgcgcatcctgttcggccatctgcccgaccggctgggcgggctgccggtcgccacggcgtcactggcggtcgaggcggcaggtcaggtcctgatctgggcggcaccgatgccggagctggcgctggccggcgccttcctcaccgggctcggctgctcgatggtgtttcccgccatggggcgcgaggtggtgcatctggtgccgccgcatctgcggggcacggcgctgggcggcttttcggccttccaggatctcgcctatggcctgaccggcccgctggccgggctgctcgccgatcgcgccggctatggcccggtcttcctgatcggcggctgtgcggcgggggcgggggtgctgatcgccctgtggctgcgccgggcgcgtcaccgaacggtcgcagcatgaccccagagatgccacgatgtcgtatccagctcagtttcaggcagaaggagtggagtcatgcccatccgtcttccccgacgcacgcgtctgcagctggccggccgcctgcaactgctcgtcctgggcgcgctggtcgcagctgtgcccgcccgcgccgatcatgggccggcgaagctggcggccctgaccaaccggccgtcgcaggcgccggtcacgccgcgtgccctggcgcccaggctggacggcagcctgccgcccggccggctgccggccccggacgaggtgctgacctatcgccccgatccggcgctgcgccggcgcaatttcgatatcttcgtcgaccggctgcgggcccatgacgccggggccgccgacaatctcgaccgcctgttgaccgacaacgacgtgatcggcgccgcccgcgactggctgaaaccctatggcatgcgaccggagaacgtggccgatgccatggcggtctatctttccaccgcctggggcgccgtgcgcggcagcgaggccgacccggcgcccgaggtgatgcgcggcctcagcgaccagctggcggcggcgatcggcgccacccccggcttcacccgggcgagcgatgccgagaaacaggaactggccgaatcgatgatcgtccaggcggtgatcatctcccgccatgccagcgccgcccgcgaccgccccgacctgcaaaggcgggtcagcgaggcggtggcgcggggtgcgcaggcgaccttcggggtggatctgacggcgctggatctgacggcggacgggttgaggtgaggaccgccggcaggagggccggcagaacgatgcgaaggcgctcccgcagcgtgacgtcgctgtccggatcgtagcgcaggcaatgctcgatcagggccgggtcgaggaagatggcaaaggatccgttgagggcccgcgccgcctgtgcgggacatgccctttcgacatctccggcttcgacatctccggcttcgatcccctgccggatgatgtattcgaacagtttctccatccggtcgagatggaccgcaaggatggcggtattggcccggctggcggcgatgatcatgtcgtgcatgcgtcggtcgttgaaaaagcgtgcccgattgtaccgatgaaccgcggtcagaagccgttcgatcttcagggccgccggcatgtccatcagggcgatcgcgaaggcgatgtcggcgatctccttcacggcacgatggcagatcgcgtcggaaatggcctgcctggccggaaagaagcggtagagattggccgggctcatgtcgagttcggcggcgatgtcggccatcgaggtcttgagatggccgacgcggcgaaacctctcctccgccacctgcaggatgcggacgcggatctcgttggcgctggcgcgcggcggtttggtgcgcggcgggcggggagaggtcaccgatatctccgtcatgtcgccctgatccggaaccagacggcgtagagcgccggcaggaacaggaggatcagcagcgtgccgcaggccgtgccgccgatcagcgtataggccatcgatccccagaacaccgaatgggtcagcgggatgaaggcgagcaccgcggcaagggccgtgaggatcaccggccgcgcccgctgcaccgtcgcttcgatgacggcgtgataggcgtcgagcccggcggcgcggttctccttgatctgctcggtcaggatcagcgtgttgcgcatcaggatgccggccaggccgatcaggcccaggatggcgttgaagccgaagggctggttgaaggcgagcagagccggcaccacgccgaccaggccgagcggggcggtcagcatcaccatggccagcatcgggaaggatcgcacctgcagcatgatgatgatcagcgtggccgcgatcatgaccgggaagatggtgaccagcgcggcattggccttgccggcctcttcgatcgacccgcccatttcgatgcgatagccgggcggcagggtggcgatcagcggctgaagggccgtcatgacctgtttcgagacctcgggcggctgggtggcctcgtcgatctcggaccgcacggtgatgacggggatgcgatcgcggcgcttcagaatcggctcttccaggcggatttcggcatgaccgatctggtcgagcgggatctgccggccgtcccggctggtcagggagaaatcggcgaggcgtgtgggatccagccgctctccgccggcgctgcgtgcgaccacggcgacgttgcggatgtcctcgcgaagctccgtgacggtgatgcccgacagcagaagctgcaattgctggctgacctcggccggcgacaggccgatcaggttcagccggtcctggtcgggcacgaagcgcagcaccggggtgcgattgccccagtcgcgattggcctctcgcacctcgggaatgccgcgcatgacggcgagcacctgttccgagaggctgtagagtgttgcgggatcggggcccatgatccggaattcgaccggaaagaccgagggcgggccgaagacgaactgtgtggcgcgcacataggcctcgggtgccagaccctgggccacggccgcccgcagccggtgcttcagggcgtcgcgcgcctcggcatcgggtgtcagcaccacgatcttggcgaaggccgggtcgggcagctccggcgacatggccaggaagaagcgcggcgccccctggccgatatagctggtgacgatccgggcctcgggctggccgtccagccagtgttcaagcttgcggacggcgccggtcgtggtctcgatgctgctgccttcgggcaggcggacctccaccagcacttccgggcggtcggaggtggggaagaactgctgcttgaccccgcccatccccatgcccgccaggacgaaggcgatgacgacgatgccgcaggtcaggaatttgtggcgcacggccagcgcgatgaagcggcgcagacgccggtaattgggcgtgtcgtagatggcgtgatggccgccctcgaccggcctgatcgcgggcagcagcttcacgcccagatagggggtgaagaccacggcgacgatccacgagacgatcagggcgaagcccaccacccagaagatgttgccggcatattcgccggctgtggagggggcgaagccgaccggcaggaagccggcgatggtgacgagcgtgcccgagagcatcggtgccgcggtatggctccaggcataggccgccgccctgatccggtccatgccctcttccatcttcactaccatgacttcgatggcgatgatggcatcgtcgaccagaagccccagcgccaggatcagcgcgcccagggtgatgcggtcgaagaaccggccggtctccagcatgatcaggaacacgaccgcgagcgtcagcgggatggccgccgccaccacgataccgacccgccagccgaggctgagcaggctgaccagcagcaccacgcccagcgccatcgcgaacttcagcatgaattcgtcgaccgccgaggtgatgttgacggcctggtcggtcaccttgtcgagcgtcatgccgagcggcaggccgccggcgatggccgccgtcttctcttccagcgcccggccgaggtccagcccgttccagccctgcttcatcaccgcggcgagcatgatggcgggcttgccgtcatggcggatcagatagccgggcggatcctcgtagccgcggcggatccgggcgatgtccgagagcttcagcacgcgcccgccggcgacgatcggcgtgtcggcgatcgcctgaaccccgtcataggcgccatcgatccggatgaagacctgcgggccccgggtctcgatcgatccggccggggtcagggtgttctgacgctgcagcgcggcgatgatcgcctgcgccggaatgccgagcgtcgccagccggtcatgggaaaattcgacgaagatccgctcggggcgctcgcccaggatgttgatcttctccacccccggcacatgcagcagatcctggcggacgatttccgcctgccggaccagctggcgcatcggcatgtcttcggccttcagcgcatagagcgcgaagctcacatcggcgtattcatcgtcgacgaagggcccgtagacgccgggcggcaggttgccggcctcgtctcccagcttcttgcgggcctgatagaattcgtcctgaacggccgaaggcggggtggtgtccttcagcgtgacggtcatataggcatagcccggccgcgcggtggtctccacccggtcgtaccaggccagttcctggaggcgcttttccagcggttcggccaccagatcctgcatctcgcgcgcggttgcgcccggccaggcggccgtaaccgtcagggtcttgatggtgaagctggggtcctctgcccggccgagtttcaggaaggcataggcgccggccgccatcagcagaagaatgaagaacagcgtgaccgcgcgttcgcgcacggcgagcgcggaaagattgaagcgcatcactgccccccaccgactgcggcggcagccctgacctcggcgccgtcgcgcagaagatgggcaccgagggagaccacggcgtcgcccggctgcacccctgcaagcaccgcggtttcgctgcccagccgcaccaggcggacggggcggaactgcacggtggaggcggcgggatcgaagacccagacgccggttttccgcccgtcgtcgagcacggcgccgagtggtacttcgacctctgcttcggccgggcggccggcgatgcggatggtcaccgtcgcacccagcggtgccgccgcggcctcgccctccagcacatagcgtgcctcataagtgcgggtcaggggatcggcggcgttggagagctgacggagctgcgcccgatagcgatgtgccccgtcgccgtagagcgtggcctccgccaccgagccgatcgcggggcggaccgtttccggcagggcgaccacggcttcgcgcggccccgaccaggcaaggcggatcaccgtctggccggccgggaccacctgtcccggctcgcccagcgtttcgaccacggttccgtcggcttcggcgaccagcacggcataggctgcttcgttttcggccacacgggcctcggcttctgccgcggcaagccgggcggccgcgctgtccagggcggctttggcctggtcatagcgctgcgggctggcggccaggccgttcttcaccaggttggcatagcgccgctcgtcggccttcgcctgaacgaagaccgcgcgggccgccgccgcggcattgcgccgggcggccagggcaagctgaagatcgctgtcgtcgatccgcatcagcggctggccggccgtcaccgcctcgccggtattcaccaggcgttcgatgatcttgccgggcacgcgaaagcccggattgctctgcacccgcgcgccgatcacgccggtgaagccacgctcggatccgccgaccacccgggccgtcgccagcctgacggtcggcggatcctgccgcgggtcgttcacggccgcggcctcgtctgcgcgcagggacagggccgcgaagccggccacccctgcccctgcaaccgccagcccccaaagtgcagcccggaattttgccgtcatgcccggtgtccccgtccgaatagattgcatacgaccgctatataggttatagatgtcgaacacaatctaaaaaagacggagaatggcaatgcgcgtcagccgggctcaggccgtggaaaaccgggaaaacgtcatcaatgtcgccagccgcctgttccgcgaacacggtttcgacggcatcggtctcaaggatctgatgaagggcgccgggctgacccagggcgccttctacaagcagtttgcctcgaaagaggacctggcggcccaggcctcccggcgggcgttcgagagcgtctcccaccgctggtcggatgccctggcggcagcgccggaggatcccttcacggcggccgtcgccttctacctgagtgcggagcattgcgacgagaccccggacggctgtccgatcgcggccttgggcaccgatgccgccagacagggcagcaccgtcagggcatcgttcgaggaggggatcagagagcgtctcgacaaccttcgccgcctgatgggcgcggatgagagcgcgggcgcggaagacgcggcgatggccgcgctgtcgaccatggtgggcgcgctgatcctgtcgcgcgtcgtgaatgaccccgatctgtcgaagcgtttcctggatgccgccgccgccagcctgacccgcgatcgcggatgaccccgcccggcgtcggtcgccgggccagcagaaagatgtcgtacccatgaacaaagtcagtgccggcgtcgccctggtgacgggggcatcctcgggcatcggctatgcgacggccgccgccctgctgcaggcgggataccgtgtctacggcaccagccgcaggacccccgccgccggcccggcgggggttgccatgcgcaccgccgatgtccgggatgatgcctcggtggcgcggctgatcggggatgtgctggcagaggccggccggatcgatctgctggtcaacaatgccggcatcggcgtgaccggcggggcggaagaatcgtcggtcgcccaggcccaggccctgttcgacgtgaatgtcttcgggcccatgcgggtgatccgggcggcgctgccggcgatgcgccagcagggggccgggcggatcgtcaacatcagctccatcctgggcgtgatccccgccccctacaacgccatctatgcggcgagcaagcacgccatcgagggctattccgaatcgctcgatcacgagctgcgcggcttcggcatccgggtggtgctgatcgaacccgcctataccagcaccggcttcgatgcccatggcatgaccccggatcagccgcttgcgatctatgacgaggtgcgggcgcaggccgaacggctgatgcagaggggcgtgacggcgggcgatgcccccgagatcgtggcgcagaccgtgctgaaggccgcccgggccgccaccccgaagctgcgctacaccgccggaaagatggcgggccgggtgcggctgctccgccggttcgtgccggaatcagccttcgacaaaagcctgcgcaaacaggcgggcctgccggcctgaccgcgcctgccccaccgtcagacgccgaagaccagcgatcgatgcgcgcccacccccgcccgcacgcccgaggcgagggccagactggcattgtgcatgggaaaggcgatgtcgcccgcggcatagacgcccggcaccgaggtgaggccccagtcgtcggtcgcgatccaggggccggtcgggccggtttcggtgcggcagcccagcatgccgggcaggggggtggtgaaggcgggttcgggggcgacgaacaggccggtcatcggcagctcgcggccgtcggcaaggcggatgccggcaaggccgggggccgggcccagcagctccgccaccggcaccgtctcgatcgtcaccccggccgcggccaggcgggcggcggtttcggcatcgggggcggggatggcgtccagcagcagcgtcgtcggcccccaatcggtgaagagcagcgcatgcgccgccatgtcggggcgggtggcgagcacgccgagcggcccgcccgccgtttcatagccatggcaataggggcagtgcagcacgccatggccccagcggtcggccagcgccgcggccagcttgcggccggtcccggcgccgggcatggcgtcggccaggccatgggccaggatcagccgggcggcggtcatctcgcggccatcggccagctgcaccagaaagccgtcgctggtggccgccgctgtcgctacctcgccgccgatcagcgtcgccgccggataggtggcaagctgggcgcgggcctcgcccagaatcgcggcagggctgcggccatcctgcccgggcatgccgtgcagcgcgggcgagaaccggttgcgcggctggccggcatcgatcaccgccacctgtcgccgcgcccgggccagctgcatcgccgccgccagccccgcaaagctgccaccgaccacgattgcgtcgaagtgcatggatctctcctgattacgtatcgttcgaagttacgtaactttaggagtggcgtgtccagcccgtcaagactcatgtcgcttccgctcttgcgtgacggggctgcatgatgggatgaagggatcggagcctgcctgccacccttgaccacccggacccacgcgatgagatccgacagccgcctgtcgcgcatgctgcatgtgctgatccacatgaaccgccatgacggcccgatgacctcggacgccatcgcggcgatgctgtcgaccaatccggtggtggtgcgccggaccatggcgggcctgcgcgaagccggccatgtgcgctcggaaaagggccatggcggcggctggaccctggcccggccgctggccgacatcacgcttctggatgtgcaccgggcggtgggcgaccctgccatcttcgcgatcggccttgcccacgacaacccggactgtctggtggagcaggcggtggatgcggcgctggcgggcgcgctggccgaggccgaggcggtgctgcgcgcccggctggcggcggtgacgcttcaggatctggcgcaggatttcgagcggcggctggcggatatcgggctggcggggccggcctgccccgtagaaacctctccggtagaaatctccccggtcgagggctgaggccgggccgcggtcagagcagcgggatcaccatcagcgtcgtgcagaccgcattcgccagcatgccggccgccgccatcgccgccatgtcgccgccgcggggggcggcatgggccacgccgatcgcatggctggtgaggccgagggtgaagccggtgacgcggtcgtcgtcgcgcaggcccgccagacgggtcagcgccagccgcgccagcagcggggtgaccatcgccccgaacagcccgttgcccagaatgccgagcatggtgacgtccatggtgctgcccaggctttgtgccagcgggatcgcgaccggcgccgtgaccgcgcgcaggcccagccccaactggtcgggcaggggcaggcccagcagcgggccgatcaggaagatgccgaggaacgaggtggcgccgccggcgatcgtgcccgccaccagcggccgccagaccgcgcgcagatagacccgcatccgccagagcggcacggccatggccgcggtcgccggcagcagggcggccgatagcggcgtggtcgcacggccgtaatccccgatcggaagatcgatcgccgtcagcacgccgatgatcagcaccgccgcggtcagcaccggggtcagaaaggccgagccccgcgccgccgcccataaccgccgcgccgcggcccaggccgcgaaggtgagcgccagcagcgccaccccctgccaggagagcgcccgcgcccaggccagaagctcggtgacgggatcagtcatggccgcgcgccccgcgctccgccgccgggatcggcggctgccgcctcaggcgggtgaacaccacgaccgtcaccgccaccgtgaccggcaaggtcagggcgatcgcggccaccagccccggcagccgcccgggatcgtccaccatcgcctgcagggcccgggtggcgggcgggatcaggaacagccccagcagcggcagcagaacatccccggcggcttctattggccgccgcgcgacgggcacccaggccagcaccgccagcacgatcggcaccgccagaatctgccccggcagcccgatcccggttaccgccgacagccagctgccggccatgcaggccagaacgaacccgaccattccgacgcagaccgcgccggccttcttccaccccgtcgccatggaacccttcacgatgctgtgcgtggcggcgggcagtatgcatcaggggtgggggaaggggtaatgcggttgtcatctcccggcccttgcggcagagaggctgcgccccgtgccgggcatgaagaccgttcccgagaaacagagggtggcgatgacgacgcagaaccagccgggcgacaggtacggtgtcatgacggcatacaggcccgaaaccgcaaagatgcccagattgagcaggctggcgtgataggaattgatcgtgctgcgccaccgttcggagagatggttcagacgtgcgtgatgaagcggccccgcggccccgtagccgaaggcccagggtgtccccgcaactgccagaagacagggtgagcccgcgggcagggcgaagagggcgatgccgatggccgaggcggcagcaagggccggcagcgcccggcctggccagcgccgttcaagggtatggccgcagagattgccgatgatgacgacaaacccgaaccatgccgcgatgagacccgcccccgcggtcgtgatcggcaggctgcgggccgcgacattggccacgatggcgccgaagccggcggcacatcccagccacagaaagctggtcgcaagaccggaccgcacgcctggcgttcgcagcgcggcgccatgcgtggcgaagaaggatgccggacgcccccgcttgcccggcgggcacagggcgaccaccccgatggcgcagagaaacgccgtcgcgccaagggcatggtaggcatgttgccagcctatgccgctcgccatccagcccgccacgaccggtgtgatcacgaaagacgccatcagcccgacaaagaccctggcgagccgccggccgatctcatcgggcggtgcctggtcggcgacgatggtcaaggcgttcggctggatgatcgcggcgctgcaccccgccagtcccgacagccagaccgcgatggtgaggctgccgcaatgcggcaggaccgagagcgtgacggcctgaccgagaaggccggccgtcagcatccgtttccgccccaggcggtcggcgagggggcctgcggcaagtgcgaccgccgcgtagaccagaccataggcggcgggaagaagcgcgatgcggctggacggcacgccgaaatgggcgcccatcacggtcatcatcggcccggcgacgacttccgccgagccgatgatgaacaggcagacccacagaaccgcgaaccaggcgcctgtgccgctgcttccctggcctctgcttccctggccgcctttcaaggcactggtcgacgtcaacaggccccctccggaccggcaccgggccgcatgccgaggagcgaaaagagctccagtctcgcccctgggtctttccggaaaacgccggtcatccggctggtgatcatcgcgacgcccggcttgtgcacgccgcgcgtggtcatgcactggtgtgatgcctggacgacgaccgcaaccccgcgcggttcgagaaccgtggcgatggcattggcgatctgcgccgtcatcctctcctggatggtgaaccgtttcgcatagccttcgacgacacgcgccagtttcgagatgcccacgacccgggtccggggcagatacgcgacatgggcggttcccacgaccggcaccatatgatgctcgcaatggctttcgaaccggatgtcgcgcagcgccacgatttcatcgtagccgtcgatctcttcgaaggtgcgcgcgagaatctcctgcggctccatcgcataaccggcgaagaattcgccataggcgcgcacgacccggttcggtgtccccagcaatccttcgcggtccggatcatcacctgcccagcggagcagcgtccggacggcttcttctgcctcggcaactgttggtcgtgcgtcgagcgcggccgatacggcatcaggcatggtcaatcctcccgtcgcacaatcctagaagaaatggatttccagcttgatgtcttcgatgtaatcccagtcgatgccgtcgatgcggaagctggccgcatcgtagacgccatcgtcataggtgtcatcgggatcgatcgtcagaccggcgcagacatatttgcgcagataatcattgtcggtcggcacgatggcgttcttgccatagcccgagacgtcgacgatgtaattgatatccccggcctcgtaggtccgcacgaccgtctcgcccctggcaaagccgatatggcggagcaggtcggtcgcgaaattattggcgccgacttcgaacgacacccgatccttgcgcttctgatcggtcatctccggcggcgcatcgagcccgttggcctggccttcggtttcatagtagtgaagcgcagactgcacgccgcgcagatcataaatgtacgaatagcgctcgatcttcttgtccttcgcagcacagatgaagaaatagtgccccaggctgtgcagaagcataaacatccgcgacgacagggaaacgccctgcgcaaaggtgatgtcgcggcctttgatgatggtcttgatgttgagcggatgtccggccgcctcgcggtatcgcagcccgtacatgcgggccagctgatcgcaggcggcctgatactcctctggcgtgacgagcgccaggacgtcgcggatgtcgtcgtcggtggcggccttgggggcgggggcggggcgtaagttttcggaaaccagcgacatacgtcgtctccttgcacaacgaaggggcggatctgttcggcgggtcttcggacgatgtcgtcttggtggaccgtgaagcccgcctgcaggcgcaccggtttgaaggcaccaggatccgcgactgtcagatgccggagggcagtggtggcgcactgccgatattaatggcataggacattattatattgtcacaattcaatcataatgtcatagatgttgatgttcaaggacaatcagggttgatgatctggtcacggctgccacgcggagtgatgtctcagcttccgcgccggcggccatcaatgcgttgtacgtgtgtgcgaggctggcatctggtcgatattgtccggacaaatccccttgcgcccacccccgccctctgcatacagtaacttgtccagacaaaatggccgccccccagccggccgggcacaagtaacaatcagggagacgggtcgtggacgaccagcgcattatgcagcggaccagccatctgcacgtcaattcggccgatgtggtgccggaagtgatcaaccgggtggagggtgtcgaggaacaggggcatgtcacggtgaagaaaatggccgtgggtgagcatatcctgtttctggaagtcttccgtaagaaagggctgatcgatccagtgcataagcacatggatcatgagaccgtggcctatctgatcagcgggaagatgcggctggtgattggtggcgaggagttcattgccacggccggcagttcctgggtccatccggtcggggttgagcattacagcgaggcgctggaggattgccttcaggtcgaggtgaagtcgccgccgcgcaagacctgggagtgagggccgtggcgacgcttgcgacccatcacccggcgccgctgtatacagaggccggcctccccacccggccgcgctggcgatcggccgccgaagcgccgctgaccgcggacagcctgcgcgcgctgttggatgacgagatcccggcgatccgcatccccggcttcgcgagccctgccgaatgtgcggcctttgcgcaggcggtctcggacgcggatctctcctattacagcgtcaagcggcggatcggttatatcggcctcgcccagtatgaatatcgctgggaccggcccaaatccgactatttccgcgatgccgccctggtcgaggcgcggcgcgatgcggtgcaggcccgggccttcgacgcggtcgggcggctgatcgaccggctggcggcggtgagccccgccggtgtcggcatcgccgaagaggcgggcgggcgctattatgccggcatcatccggcatgcctcggaaggcgtggatctgcatgccgactgggcgccggtcaattcgcctgcctatgacatcgcggcgatcgatgcgcagctcggctggaatttctatgcccaggagctggtggaggggggcgagaccaccatccatcacgcgccctggacgcctgcgcacgcgccgggcgagatcccgcaaagctacggcctgcctcctgagaccgtggccggcgccgagcgcttcaccttccgcgcggtcgcgggcgacgtggtcatcttcaacacccgcaacccgcacgagatcgcaggcggccgcgccgccccgggccatgaccgcatctccatcggctccttcatcggccgcctccccacgggccggctggtcctgtggtcgtgatggatgacaatcaccaacctcaaccaatcctggcaccaacctcaaccaatcctggctcccagccgccattgaggcggcggccaagggtgcggcagcacccgcttgggccgaggggctaacataactatgaaagagactcccatgggcgacagtctcgggtggcgtgccaagttcggcgtgctggtccccagcaccaataccagtgtccagcctgaattcgaccggatggcgccccatggcgtcaccagccatattgcccggattgcgatccccaatattgcgatccacaatgacgacgacttcaacgagctgatccggctgatcgccgaggcgcagatggccgcggtggacagtgtgatgtcatgcgagcccgaccgtctggtgctcggcatctcggccgaaaccttctgggacgggcttgccgccagccggaagctgaaggcggagctggaggcccataccgggctgcaggtctcgatgggctccgatgcctgtcaggcggcgttgggcatctatggcgcgaagcgcatcgcggtgatcacgccctatcagccggtcggcgaccgcaatgtcgtgcgcttcttcgaggaatgcggctacgaggtgccccggatcaaggggctgaaatgcgcaagcccggtaaagatcgcccatgtccaggaggcggaacttgccgccgcgatccgcgaggtcgacgggcccgatgtcgacgccgtggttcaggtgggcaccaacctcgccatggcccggctggccggtttcgccgaaacctggctgggcaagccggtgatcgcgatcaacaccgccatcttctggcatgccctgcgtgcccaggggatcgacgaccggatcgatggctggggatcgctgctgctgaagcactgaagaaggctgccatcgtgacgccccccaccgatatcgagaccgccccacccgaaacagccctggcgcgtgcctatgccaccatccgcaccggcattctggagggccgtttcgcccccggggaccggttgcgggaagagcatctggccgagatttcgggcgtcagtcgcacacccgttcgtgaagcgctccgccggctcgccaccgaagggctggtggagctgacccccggtctcggcgccttcgtgtcgagctggagcgtgaccgatctggaaaacatctttgccgtccgtgcgttggtggaggcggctgtggcggagcaggccgcccggcatctgacggccaccgatatcgacgcgctggaggcgctggcggccgggatggaggatctggcggcccgccggccggccggcttcctcgaccggatcaccggtctcaaccatgacttccacacccgcatcgccgccgcctgcggcaatgaccgcctggccgggctgctgacccagaccgtcgatctgatcctggttcaccgcaccttccggcgctatcacgaccgccagcttgtccgcagcatggcccatcaccgcgagctggtggacgccttccgcgcgcgggacgccgactgggcgggcgccgtgatgcgcgcccatgtccatgccgcccgccatgcgctggtggccgatctttccctctcccctccggccgaaccgaaagccccctgaatgcgaccgctcgacaatgtcatcatcctcgacttcacccatatgctctcggggccctatggcacgatgctgctggccgatctgggcgcgcgcaccatcaagatcgagccggtgaagaccggcgagggcacccgcaagctgctggccaaggatcccgatcattcgatcgagggcatgggcgcctatttcctgacgctcgcccgcaacaagcagtcggtcgccgtcgacctgaagaccgaagagggccgcgcgctggtttatgatctggtgcgcaaggccgatatcgtggtcgacaattacagccgcggcgtcaccggccggctgggcatcgaccatgcgacgctggcggcgatcaatccgcggatcatcacctgttcggtgaccggcttcggcgagaccggccccaatcccgatcgcccggccttcgatctggtcgcccagggcatcggcggcggcatgtcgctgacgggtgaggccggcggcacgcccctgcgggccggcattccgatcggcgatctgggcggcgggctgttcgccgccatcggcattctggcggcgctcaaccagcgcaaccttaccggccagggccagcatatcgacatctcgatgctcgactgccagctgtcgatgctgaattacatggcgaccatgcagtcgctgtcgggccgcgagcccggccggtcgggcaacggccatttcgtccatgtgccctacaacacctatcgcaccaaaacccgccacgtgatcctggcggtgatcaccgatcagttctggcagcggctggtcgacatcctggatgcgccggacctgcgccgcgacgcctatctcacccagcccggccgctgggccgatcgcgatgtcatcaatgcccggcttcaggagattctggagaccgagagctgcgagcactggctggcgcgcttcggcaaccagatcccctgtgcgccggtcaacgacatcgcccatgccatggccgacgagcagatccgcggccggggcatggtggtggaggtggcccatccctcgggccggcgggtcgagatgccgggcaatccggtcaagatgtcgggcatgaccgacgaggtctataccccgccgccgctgctcggcagtcataccgacgaggtgctggaagagctgctggggctgggcgccgaggcccgcggcgcgctgcgcgcccgcggcatcatcggctgagggaggacagcatgagcgatcgcgtcaccatcaccgaggtcggcctgcgcgacgggctgcagaaccagccggtgcctgtcgccaccgccgacaagctgcgtctggccgggttgctgctcgatgccggcctcacctcgctggaggtcaccagcttcgtgagcccgaaggcggtgccccagctggccgatgccgaggccctgctcgccggcctgccagcgcgggcgggggtggactatatggcgctggtgccgaacatgcgcggctatgaacgcggcaccgccgccggcgcccgggcggtggccctggtgctctcggccaccgagacgctgaaccggcgcaacatcaacatgtcgctggatcaggcccgcgccgtctgccgcgaggtgatcgggcgggccaaggccgagggcgtgttcgtgcgcgcctatgtcgccgccgcctgcgcctgcccttacgaggggcaaaccccgctcgcccgggtggtggcgctgaccgaagagatggtcgcggccggcgccgatcaggtcgcgatcgccgacaccatcggcgccggcaacccggcgcagatccgcgacatcgtcaccgccctcgccggcggtgtcggcaccgaccggctggcgctgcatctgcacgacacccgcggcctggcgctggccatggcctgggcggggctggaggcgggcatccgccgcttcgacgccgcgttcggcggcctgggcggctgccccttcgcgcccggtgccgccggcaatctcgccaccgaggatctggtctttatgctgagcgaggcgggcatcgagaccggtatcgactggcgccggctgttcgatgcggtcgccctggccgaaaccctgctcgaccggccattgggcgggcgcatggcggcctggtggcgccaggcgcaggcaaaggaggcgcaggcgaaggaagctgcccgccaggagatgccggcatgatcgtcgaggaacgctgctacaccatcgcccccgcccatctgcgcgagttcctgaccgtgttcgagcgcgaggggctgggcatcatccggccgatcctgggcaatctgatcggctatttcaccaccgaggtgggcatgatcaacggcgtggtccatctctggggctatgagagcatggccgatcgcgagacccggcgcgccgcactcgccgcctcggaagactggcgcgccttcctgcccagggtgacgccgttcatccaggcgatggaaaaccgcatcctggtgcccaccgccttctcgccgctgcgctgatcgtttcattcgtctccatcgaggatccgcccatgagcgccgacaccgatctcaccacggactatcagggcgccggcttcatgggcgcgctcggcttcggccggcgcccggcgctggtgatcgtcgacgtggtccaggcctatttcgaccccggctcgccgctctatgccggggtggaggacatgctggcggccatccaccgcctgctggccgcggcccgtgccgccggaattccggtgatcttcaccaatgtcgaataccaggcgggcggcgccgatggcgggctgttctatcgcaaggttgcagcgctcaaggtcttcgaccgcggctcgccgctcggccacttcgcccgcgggctggagcccgcgcccggcgaaatcgtggtgaccaaacaatatgccagcgccttcttcggcacctcgctcgcctcgacgctgacggcactgggcgtcgacacgaccatcatcaccggcgtcagtaccagcggctgcatccgcgccaccgccctcgacgccctccagcacggcttcatccccatcgtggtccgcgaggccgtgggcgaccgggcgccggggccgcatgaggccaatctgttcgacctgcaggcgaaatatgccgatgtggtggaggtggaggaggtgatggggaggttggccgccaccggccgggatcccgccggttcatgaaccggcccgaagcctgttgccgctctcccggaaaacggggatcctgatcagagaaaggccggcagaaatgcacaacccggatggacgggccggatggactggaacgatctcagagtcttcctcgcggtggcccgcaccggcagtctgacccggacgtcggccgagctgagggtgagccagtccaccgtcagccgccgcatcgcccagcttgaggcgagcatcggcatgacgctctttcagcgccatcagaccggctatttcctctcggacgaggggcgtgaactgctgcggcatgccgagctggttgaagacagcgtcatggcgctggagcggggggtggcggggctggacaaggcgccggccggcagcgtgcggcttgcgacctcggaaaatctggcgaccgatctgatcattccggcgctgccggcctttcgggagcgctatccgggtatctgtctggagatcatcaccagcaccgccaccgccgagcttggccggcgcgaggcggatatcgcgctcagggtggtccggccggaacggggcaatctgacggtcaggcgcgtcggccacatgacctattcggtctatggcagccgggattatgttgcgcgccacccgcccatcgacggcgagccgcttggcggacggcatgccatcgtctgggatgacggccatggcttcatgccggcggcggtctggctggcgcgggaacatcccggctgccgcatcgccctggtcaccagcagcctgccggcccagatcgccgccgtgcgcgccgggctggggcttgccgtcatcccggattttctggccgcgcccgaggatttcgtgccggtcatcccgtcggaccggctgttcagcaacgatgtctggctggtgacccatgccgatctcgtggcctcggcccgggtccgggcggtcggggattttctggccgatcaggtgatgcgcaccaaccctgcgctgtcggggcgcgggccgggcgcctgacctgccggcacctgacctgccggcacctgacctgccggagcccggcccccccggcccctggcctgcgcgtcggttacgaggtgcgggtggtgcggccggcccagaggtcgaccggccccaggcggtcggcgccctgggtggcgagcatccagccgggatattccggcggcagctcgctgacggcgtcgagccgtgcgatctcgtcgtcaccaagcacgatgtcgacggcggcgatgttgtcctccagctggctgagccgtttcgcgccgacgatgaccgaagtcacgaccggcttcgacagcagccaggccagcgcgatccgggccgggctgcagccatgggcctcggcgatcggtttcagcacgtcgatcacgttccaggcgcggtccttgtcgaccacggggaagtcgaaagacgagcggcgtgcgccttccggcgactggttgtcgcggctgaacctgcccgacagcagcccgccggccagcgggctccagaccagcaggcccatcttctcggcgtcgagcaggggcttcagttcccgttccagatcccgcccggcgatcgagtaataggcctgcagcgtgttgaaccgctccagattgagtcgggccgagatgccgagcgcggtcgcgatccgccaggcctgccagttcgacacgcccagatagcggaccttgccctgccggaccagatcgtcgagggcccgcaacgtctcctcgaccggcgtcaccatgtcggtggcatggatctggtagaggtcgatatggtcggtctgaaggcgccgcaggctggcctcgaccgcgtccatgatatggccgcgcgacgcgccgacatcgttccggccggggcccatccggctgtagaccttcgtcgccagcacgacctcgttgcgggggatccccagattcctgaacgactggccgagcgtttgctcgctcgccccggcggaatagacatccgccgtgtcgaagaagttgatgccggcatcgatgccggccttgaccagcgcatcggcgcccgcctggtcgacgtcaccgatatgctcgtaaacaccggtgccgtcgctgaaggtcatggtgcccaggcaaagctgcgagaccagaagcccggtattgcccaatgtcctgtacttcatcctgcatctcctgaagacgaggccgcccgttcgggccggatatcctccggcgccgtgccctcgggctgtggcgagtgatctgattgtggtgacgggtgatcgggtccgcggcggccgcggcacgatctcaggcggcggtgtccggcgcgccgaagatctcgttgatgtgcagcgagtcggtgaactcctggccgcgcgcgatccggccgtcacggaaatgaagaaggaaatgataggtgttgcgatagtgccggccgtccgtcatcggcaggtcgccccgcgcgacgattgccagccggtccgcctctccggtgatctcgccatagtcgagcgccagatggccggcggcattctcgaacagcgtcgaaatggccgcgagataggggcccttggcatgggtgcccgaaaatttgttcccgggcatgatccaccatgtcagatcctcggtgctgagccgggacatggtgtcggtatcgccccgccccagcgcctccagaaaggctttggcggtctgttcatgctgctctcggttcacggcgcgtctcctttcgggccgttcttgcgtcacgtcacgacctcagactgccgtctccgtcttcggaaaaatatggcgaagatcgggtgatcgttttccgaatttggaaaatgaaaagcgccagcgccgacccgtgggatggatccggcgctggctctgtttttggggtgcgaagcggcttcagatgctcttacgcaccgacctgatcttgccgctgcggccgccgccgcaatagaaggtgccgttgccgtcgctttccagccccgagaccgcgagccctgccggcatcgcgatcacggcaattacgccgccggtctcgggatcgatgcggcggagatcggccgtctgctgctcgccgtcccaggtgccgtgccagagttcgtcgcccgcccaggtgacgcccgtgaccatgcggtccgaggtgatctggcggagcacggcgccggtttcggggtcgatctgcaggatgcggcggtcgtcgaactggccgacccagagcgtgccttcgccccaggcgaggcccgaggcgcagccattgcccgggcaggggatggtgccctgctccgcgccggtttcagggtcgagccggcggatcaccggccctgcgatctgatagagaaaccggccgtcgaaggcggtgccggcctctcccggcaccggcagcgagcggaccacccggccatccgaggggtcgagcacattcaccgccgggccgacggcgaaccagacatggctgccgtcgaaactgaccccgtgcacggtatcgaccccgggccaggggccgtagtcgcgcaggatctcggcatcggccgtggcgggcgtggcggtggcggtgggggatgtgagggtcttggtcatgggaacctcccttgggatctgcggtgggatcatgtccgagcctcagcctggatcggggaggggtgggggtgagagtaacaatgctgtcgggaaggcgcggctggctcgccgcatcagcctatacccccggcagcagcatgatcgtcggaaaaccgccgagggcggggaccgtccagcggcgggtgcggccgcggccggtggggcggacgcggcccgtggctgccaggcgttccatgaggcgctgtatggtgcgcgggctggtgccgagggcgacggcgagtgccgtggtcgaccaggcctcgccatcggcgagcagggcgaggatgcggccgcagccggcctcgatcggcgggtcgagcagggcgaccgggccggggcgggcggggtgcagaacgaagccggccggggtggcatggatccgggcgagcgggtggagcaggcggcgcaggcggccgatctcgacccggagccgggcgcggtggctctcgtcggcggtgcggccgccgaaaccttcgcggatcagcaccgcgcgcggcacatcggccggatgggccagcgccagccggcgggccagcgcgaacagcaccgggcgggtggcgagctgacgggtttccttggcgtcgcggatgatcagccggcaggcatcgacgaccagggccgcttctgccggcagggcctctatctcggccagcgtgaccatgcggtcggtgccggcccggaccagccgcgccgccggagcgtcgagctggcggcgggcggtggccacctcggctacgagttcggcgatgccgctggccgcggccgccgccgcggcggcatcgaggtcacgggcggcttcggccgccgcgatccggcgggcggcgatgccggcccgggtcaggtgcagcccggccgcaagggccgtcgggatccggccgggatcgagcccggcgatcgcgtcgccggcggcgcccggctggccgatcagcagcaggcggcgggcctcgatgatccgggcatgggcggcattggcatggtcgccggccgcttccagcaccgcgcgggtgcggtccagaaggcccggcggccaggcgatgtcgcgcagcaccagggcgatttcggcctcggccaggttgcagcgcgcccgcgccgccggattgccgcggccgaagccccgtccggcccgggcgagcagatcccgcgcccggccgaattcgccgagccttgccatgacgatgccgcgcagcgccagcgccggcgggtcgtcgcggagcgacacgcgattgagggcgcccaaaaggtcgcccgccgccagggcgcgggcggcggcggtgatcagcgcatccatggctctctgccgatcgtcgctcaggcacgcaggatagcacgaggaccggcagctgccgtcatggcgttttttacttcacgagaccaaggggcgcgacgcaccgttcgccatgcccgacggacagtcccatggatggcgatgcgatccatgtggtccagatcaaaggccggtatcgcgagatgtcgctgccatgctgcgaagtattggacggatatatgtttcgctatgcgaacgatcgtgcgtgaaatcgccatcccgggcaagaggaggctggttccggcaagacgatagcctgacggaagagggtgcaagtggtggtcgggtggcggatccggcatcacccgccgcgtgaatagaccatgccggtgatgctgggccggtttaacgaccccctcttgtcgaatccggtctgatcaggcccgtgatggacgatggggctgcggatatgtcctgcggtcagattccatggatatgaaaacgaaatacgcatgggcgaaaatctggacttgatccgggccatcctcatactgaagcccaagagggcaacgggtccgacgtggtgacctgcgcaatacccggacagatcctcttcaatgcaaaacgagtcatgggcgttccggataccccatccgggatgagggtgaggtttcgtgccgataccttctcatgaactcgcaaataaagaccgccgcaaggccaggtcttcagggaggttaaggacatgcgacgtcgcattctcgcgactgcggtcaccatgaccgcggcgatggttctggccggcgcagcgctggcggcggatcccgtccggatcggtgtggcggccccgttcacgggtgcggcggcgggctatgggcgcgatgcgaagatgggcgccgagatggctgcggccgagatcaacgccgccggcggcatcctgggcgggcggcagatcgaactggtctacgaggacgacaagggcacgccgcagggcggtgtcgcggcggtgcagaagctgatgtccgagcaccgggtgcaggcgatcaccggtggcaccaacagctcggtcgtgctggccgagacctcggtcaccaagaaccgcatcctgcaggtgaatgcggccgcccaggccgatgcgatcaccgagcagggatcgaaatggctgttccagatcaacaacaccgcctcggccaattccgaggccttcaacggctacatcaccggcacgctgaagccgaagacggtcgcctatatgggtgagaattcggagttcagcaaggcgctgctcgccggtctgcgcaagtcgctggatgccgccggcatcccgctggtcaatgttgcgacctatgatgccaacatcaccgatttcacctcgatcatcagcaaggtgaaggcgtcggaacccgaactgctctatgtcgccgacgcctatcccgcgcgctcggcccagctctggaagcagatccgccagcagggcggcttcccggtcgagacccaggcgccgggcgtggtgcaggcctccatgctgaccccggccgagggcgccatggacggcgtgatcaccggtgacatcttcatcgccgaaggcaataccggcccgatggccgatttcgtcgaagccttccgcaagtcgcatcaggccgagccgaacaaggtccatctggtgacctacgaggcggtgcaggtgatcgcccgggcaatggacaaggccggcagcgccgatgattacgatctgatcgcgaagaccatccgcaccaatccctggccgtcaccgcgtggtgaactcaccttcgacgatcgcggccgggcccgggcgccgcagttctacatccacgaggtgaaggacggccggctgacgctccgcgagaccatcgagaaccgttgaggatccgcggagagcgcatgcatggatatgcatgcatgcgcgccgcgacaggggacgggacggatggacctctttttccagacgcttctgaacgggttgatgctgggtgccggctatgcgctggtcgccgtgggtctgaccctggtcttcggcacgctgcacgtcgtgaacttcgcccatggcgccttcttcgcgctgggcggctatggcgtgctgatgctccagcaggcgggcctgccctatctggccgccctgccgctggcggtgctgctggtggcggcggtgggtttcgccgcggagatcgcgatcgtccgccgggcgatctatgaccgtggcgaacatggctcgatcatcgtgaccttcgccgccggccaggcgatcgtggccgcgatcatcctggtggccggccccgatccgatgccggtggcctcgcccttcggacaggcgaccaccaccgtcttcggcctgtttctgtcggggcagcggctgttcatcgcggtcatgtcgctggcggtgctgatcggcttcgccctctggctgacacgcagcgtgcggggccagcaattgctggcggtcgctcagaacgcgcgcggcgcgctctattccggcatcgacgtgccgaccatccgggcgctcgccttcgtgctcggcgtctcggcggcgggcctctcgggcgcgctgctcgcctcgatcatcagcgcttttccgacaatgggcgatgccaacatgatcaccgctttcacggtcgtgatcctgggcgggctcggcagcattccgggcgccctgctcggggccatggccatcggcctcggcaatgccttcttcgagacctacgtctcggtgtcgtggacgcccgccctcggctgggtgctggtgatcgtggtcctgctcctctggccccagggtctgatggggcgtgcgcagctgcacaggcattgagggcgaggcacggacatgacggatacctcttccacgtcccccctggcgggcccggcctcaggctggccgacaggcggaatcgtgctcacgctcgcggccatcctgctggtcctggcggtcggcttcggggtccggagcaccttcattctcagccttgccggctatacctgcgccttcgcgctgttcgcgctcagcatcaatctgatgctgggcgggctcggcgaagtgccgctcggccagtgcatcttcttcggtgtcggcgcctatggcacggcgatgctgaccatcgaggccggcctgcccttcgtggcggcggtgccggtggcgatggcggcctcggcggtgctggcggtcggcatcggctggctgacgctgcgcctgaccggtgcctatttctccatcgtctcgtgggggctggccggtgtgatgatggtggcggcgatgaacctggaggtgacgggcgggccgctcggcctgttcggcttcccgagcctcgccgtcggcccggtcgacctcaccgatccgcagagctatttcttcttcaccgcggcggtgctgctggtggtgctggccttcctcgcccgggtgcgcagttcccgattcggccatgcgatcgaaagcatccgccagagccgccatctggcgcagtcggtgggcatcaacgtgttccgcgagcggctgaagatgctggtgctgagcgcaccggtggcggcactggccggcgcgctctgcctgccctacacccagatcgtgacgcccgaggtcttctcggtggtgctgacggtcgacgccctgctcgccgtgctgatcggcggtaccggcctgctgttcggcccggtgatcggcaccgcgatcttcaccatcctgccgcagttcctgaagctcgaccccaacgtcaaggtgctggtcttctcgctggcgatcatcctggtgatgatgctggcgccgggcggactgcatcagatcggccggtcgatgctggcccggctgaagcgcggggagggcgggcgatgacggctgacatgagctgtgccgacgacatgagttgtgccgacgatatgagttgtggcgaccggcccctggccgtccgggcccggggcatcgagaagcgctatggcggtgtcgcggcgctgaaaggggtcgatgtgtcgatcccggagggcgccatctacgggatcatcggacccaacggcgccggcaagtcgaccctgttcgacatcctttgcggcatcaccagacccagtggcggcacggtcgacgtgctgggcatggatgtggcggcaatgcgccatcacgaggtcgcgcgccgcggcgtcggccgcaccttccagcgcacggccgtgttcggcgaggcgacggtgcgcgagaacctgctctatggccgctattcggccatgggccattcggtgatcgaacggatcctgcatggccggcgctggcgcgacgagatggcggctttcgaagacaaggctgcgggcgtgctggcgctctgcgggctcgaccgcatcgccgaccagccggcggcttcgctcgcctacggcattcagcgccggctggcggtggcgatcatgctgatgaccgacccccggatcatcttcctggacgagccggtggccggcatgaacgacgccgagaccgcggaattcgtcgccctggtgcgcaaggtcgcggtcggccggaccatcgtgctggtcgagcacgacatggccgcgatcggcgagctgtgcgaggcggcgctggtggtggtcgacggccggccggtggtggccgatacgccggccgcggtgttccgccatccggaggtgatctccgcctatctgggggccgaggatgactgatgcattgctgaccgtggacgggctgtccgccgcttatggccgggtgacggcgctgcgcgaggtgtcgcttgcggtccgcccgggcgagatcgtcgcgatgctgggcgccaacggcgccggcaagaccacgctgctcaacgccatttcgggagtgctgccgctgtccggcggctcggtcaccttcgatggccggcggatcaacgggctgaagccctggcagaccgcgcgccttggcctcgcccacgtgcccgaggggcgcgagatcttcccggggatgacggtggaggccaatctccgcgtcgtcgacgtcaatggcggcgggcccgaattcggcgtcgaccgggtgctggacctgttcccgcggctgaaggagcggttcgatcagctggccggcgggttgagtggtggcgagcagcagatgctcgcgatcggccgcgggctgatggcccgaccgcggctgctgctgttcgacgagccgtcgatggggctgtcgccgcttctggcccgcaccgtgctgggggcgatcgccgaattgcgccagagcggcatcgcctcgctgctggtcgagcagaacatgcgcgcggcgctgaaggttgccgaccgcgcctatgtgctgcgcgtcggccgggtcacccgcgaaggatcggcggcggcactccgcgatgccgacgacatcaaacaggcctatctgggcctctgacagtccgaaggatatccgatgaccaccgcctcccagcctctccccgaaggcctgcgcctccccgacggcagcgccgactgccatgtgcatctctatggtccctatgaccgcttcccccatggcgacgagggtcgcttcacgccccgcttcccgcgcacggtggaagacctcttcgcccattgggatgcgatcggggtctcgcgcggggtgatcgtccatgcggtgggctccggcgccgacaatgcggtgacgctggatgcgctgcgccgctatccggacaagctgcgcgcgaccgcgatcctgaagggcgacgtctcggacagggtgctggacgagttgaccgatgccggcttcaaggcggtgcggatcaccatgctgcgccaggacggcaagccggtctcgacgctcggcaccagctatgaggaactggtggcgctggcacccaggatcgccgagcgcggctggcatgcccagctctggatcaacagttccgacctgatggaggcggcgcccgacctcgaaaagctgccgctcgactatgtcatcgaccacatgtcgcggaccatggccgacattccgccggacagccccggcttccgcggcttctgcgacaagctgaagaccggccgctactggaccaagctgtcgggcgccgaccgcaatacccggatcggtgcgccctatgccgataccgccggtcatatgaaggcgatcgtcgccgccaatcccgaccggctggtctggggatcggactggccgcatgtcggccacagcgacgagaccatgccgaagatgggcgatctgatccgccttcttttcgattgcgtgccggacgagacggtgcgccgcaaaatcctggtcgacaacccggcggtcctttacggcttctgagccgccgccggcctccctggccaggacgtgtcgaagcaggtgcctctcccccctggcacctgcttcgacctctttcttcgtccccgaggaggggagcccgtccggtcccggtgcgcgtgcccggccggtgccgagagatcgagtgatgacgcaaaccagttcgactgcggccgccgagctgccgctcgccgggatcacggtcctggatctcggccaggtctatcagggcccctatgccggcttcctgctcgcccaggccggggccgacgtgatcaagatcgagccgccggcgggcgagccgatccgccaccgcgcccgggtcagcccgggggcagcggtccccttcgccatgctgaacgccaacaagcgggcgatcgcgctggatctgaaggcgccggaaggcgtgcagatcctcaaggatctggccgcccgggccgatgtgctgctggaaaactacgcccctggcgtgatggaccggctgggcgtgggctgggaggagctgcgccggatcaacccgcggctggtctatgcctcgggcaccggtttcggcctgtcgggtcccgatcgcgacaatctggcgatggacatcaccgtccaggcggcgtccggcatgatgagcgtcaccggctttcccgacgggccgccggtcaaggccgggccggcggtggtcgatttcctgagcggcgtgcatctctatgccggcatcgtgaccgcgctctgccagcgcgcccgcaccggcgaaggccggctggtcgaggtggcgatgctggagacggtctatccgagcctggcctcgaacctggctttcgtcttcgacaccggccgcgcgccgccgcgtaccggcaatcgccacggtgccatggccgaggccccctacaacgtctatccggccgctgacggccatgtcgcgatcatcggcgtcaacgagcatcactggacggcgctgctgaaggcgatggggcgcgaggatctgatcggcgatccgcgcttcgacacggccgccgaccgggtgcgcaacatggaagagaccgaccggctggtcggcgactggaccgcagcccacaccaaggcggaactggcgggcattctgcgccggcacaaggtgccggccgccccggtgcgcgacctggtggaggtggtcaacgatccgcatatgcatgaacgcggcatgctggaacatgtcgatcatcccgaattcggccgggtggtgctgccgtcgagcccgctgcgcttccacggcgccgaaccggtggtgcggcagccatcgccccggctcagtgaacatgatgccgagatcctcgccgatctgccgggctatgggccggatcggatcgaggcgctgcgcgcgcgccgcgtgatcggcggccgggggtgagcctgcggccgccggaaggccggcgcttccgtcggaatggccggggcgacccccgtcatgccgacgcgctgctcctgaccatggccggacggctgttcgacgatctggccggggcgcccgaggatgccctctgggcgggccttgaggaggcggggctgacggccgccctggcgcccgaagcgctgggtggggccgggctcggccttgatgacggcctgggcgtgatgcgggtggcggcggtggccggcctggcggcaccactggcggagaccatgctcgccggctggctgctggcccggggcgggctgcgcctgccggcggggccggtcgcgatcgcccccgccgcggtcgaagaccggttccggatcgatgtggcggggctggcgcacggccgggcagggcgggtggcccgggccgggaccgccgggcatctggcggtgctggctgacggaccagacggccgggcggtggtggccctggtcgcaggggctgcctgcaccgtgcttcgccgcgaggacggccctgccggcatggtgatcatcgagcaggtgaaaccactggccctgggtgccgtaccggtctggctggatcgcggccgctggctgctgatgcttgccatcgcagaggcgcagcgcgccgccggtgcggggccggcagaaatggtctctgcggccattgccgccacggaggtgctggacagggcggtctctgccggggacggcccggacggaccggccctgtggcggcaggccggggcggcgctctgccgctgcacacgggctgccatcgatatcccggccgatccggtgccgggcaatagccgagggaggaaagaaacgtgacgcgacaggatgtcaggctgttcagccccgcgaccttccgcggggtggaactgaagaaccggatcgtggtctcgccgatgggcatgtattcggcggagaacggctatgtgaagccgtttcatctgatccattacggcaagttcgcgatggggggtgcagggctggtcttcgtggagcagacctcggtcacccgcgcggggcggatcaccaatggcgatcccgggctgtgggaggatggccagatcgccggcatgcgcgagatcgccggccagatccgggtacatggtgcgaaggccgccatccagatcaatcatggcggccgcaaatccagccagcagcgggcgttccgcggcaacggcccgctgaccgaacgcgacatcgccgccggcgaggagctgtggcagcccgccggcccgtcctctctgccgctggccgatggctggctgatgccgcgggagatgagccgcgacgagatcgccggggtatgtgatgccttcgtcgccactgcgcggcgcgcggtgctggcgggcttcgacgtgatcgagctgcacatggcccatggctatctgctgcagagcttcctgtcgccgctggccaatcagcgtgacgatgactatggcggcagcctggagaaccggatgcgctttccgctggaggtgacccgggcggtgcgtgccgccctgccaccggcgacgccgctgttcgtgcgcatctcggccaccgactggatcgagggcggctggacgctggaggaaagtgtgatcttcgcccgcgagctgaaggtggcgggggtcgacctggtcgactgttcgaccggcggcaatctgcgggccggatcgaccaatgccaatctgaagcgcggcccgggctatcaggtgcccttcgccgatcgcatccgccgcgaggcaggcatcgccacgggcgcggtcggcatgatccgtacggcggaactggccgagcgaatcctgcgcgaggaccgcgccgatctgatcttcctgggccgccagatgctggtcgatccgttctgggcccaccatgccgccgaagccctgggcctgaccggcgatttcgagggctggcccgagcagtatggctggtggctggcgaaatggggccaggcgctgcgcgacaatggcgagagcctgatgtggccggatggtggggcgatggcggccgggtgacccggccgccggatcattgccgcacgcccatccggtccagcgcctcaggggtcagcggttcctggccgtcggcagcggagggggcatgcaccgccgcggtcacgtcgttgcgcagccgcggcagtccctccgggcattcctcctgcatccagaccagcatcttctcgcggatctcgcagcgcagatcccaggcggtgggggagttgtgggcgctcatcagcgcgcggatggtgaccgtgcgctcggtggtgtcgatcacctgcagcacgccgaccttgccgtcccagagtttgctctgcttcagaaactcgtcgagcttttcgcgcatgcgggcgaaggacatggcgtagtccacctgccagatcaccgtgccgatgatgccggcagtctcgcgggtccagttctgaaagggtttttcgatgaaatacgaaatcggcagcaccagccgccgccagtcccacagccggatcacgacataggtggcggcgatttcctccacccagccccattcgttttccaccaccaccgcatcctcgatgcggatcggctgggtgagggcgatctggatgccggcgatcagattggccaggatcgactgggcggcgaagccgatcacgatgccggcgacgccggccgaggcgaacaggctgacgccatactggcgcaccgacgggaaggtcatcagcatggccgccaccgtcaccaccaccaccaggccgatgccgacccgttgcagcagcatcagctgggtacggtgcttgcgcgccaccagattgtcgtcgacatcgatccgatagcggcggcggctgacatcggccagcgcccgcagcaccgagacggcgatccagccgatcagcgcgatcacccccagctgcagcacccggccgatgatggcgcctgcgtcgtcgtcgacggcgagttcgggggcgatcgcccgcagcgcgatcaggatgaaggccagccgcacggggccgcgcacccggcgaaagacttccgtgcggaagcccttgccggtgcgcggcaccacgatggtgagcaggcggaagaacaggcggtgggcgatcagcgccacgcccaccgccacgatcagcagcagcagataaccggtcccggccggcatggcggcggcaagctccgccagccagcgcggggttctgaggatgtccatggcgtcctggtctcgtgcgtcttaatgcgcgccggccgatcgcgtcatgcggggatcacatccggggaggccggcaggaacagccggtcgatgcggatcggcaggcgccggaagcggcggccggtggcgtggtggatggcattggcgatggcggcggacatgccgacattgccaagctcccccagccccttgatgcccgaggggttgccggtgcggtcgtcttcgtcgagcaggatgacatccacctgcccgatatcggcattcaccggcatcagatagttttcaagatcgtggttcagcacgcgcgccgcccggcggtccagctcggtctcttccatcagcgcggtggacagcccccagatcatgccgccgatcagctggctgcgcgcggtgagcgggttcatgatccggccggcggcgaaggcgccggtcatgcggggtacctcgatttcgagcgtgcggcggttgatccggatttcggcgaattcggcgcccatggcatagcgcagcaggtcgcccgatccgccgccgcgcatgggggtgcgaccggcgcggagcttctccaccgcatcgggcttcagcccgtcggggatgaagtcggccgtctggctgatcgtctccagtccggctgcctccaatgcggcgtcgagcgccatataggggccgccggcctcgatccggccgtcgcggaggcggagcgtggcggggtcgagcccgtagaagggggcggcctcggacgccgtcaggcgggtgaagagatcggccttcaccgcctctgccgcccgcgccaccgccgaacagacgctggcggtggagttggatccgcccgagacgggggccggcggcaggtcgctgtccccggttctgaccgtcacccgctcgggcgccatgtccagcacttcggcggccatgcgcgccaccaccgtgcggatgccggtgcccagctcgtggctggcggtctctaccgtcacccggccgtcggcggcaagccgcacccgggcggtggcggcggcgatgttggcggggtagacggtggcggcgcagcccatgccgatcacccagtcgccgtcgcgcatcgaccccggcaccgggtcgcgccggtcccagccgaaggcctttgcggcggcatcgaaacagggcatcagcatccggctgctgtagcgcttgcccgacagcgggtcggtcgcggtatcgttccgccgccggaagtcgatcggatccatgtcgagcgccgccgccatctcgtccatcgcctgttccagcgcgtagacatagggcacttcgggcggcgagcgcatatagccgggagtgggccggtcggcatggaccagcgacagcttcgtctgaaccgcgccatagccgtagagccgggcggtgaccgaattgccgccgaccagatagggatcggcgcgcgaggtgacctcggcgccgtcgtgcacgaaggcggtgatccggccgtcgcgcgtggcgcccatgcggatccgctggcgggtctccgcccggtgggtaccggcggtgaagccctgggcgcggctgaccacgcagcgcagcggccggccgaaatgccgggcggcgaaggcgatcagcgccgtgcgcgcggtgatcggccctttgccgccgaaggcgccgccgacgaattccgccaccacccgcacccgggcgggatcaatgcccagctggcgggccagttcatggcgccagccgttcacgttctgcgagggttcgtacaccgtcagccgcgcctggtcgccctcgccgtcccagaccgcggtggtggaatagagttcgagcgcgttgtgatgctgcaccggcgtttcgtaatcggcctcgatacacacctcggcgacggcgaaaccggcctcgatatcgccctggccgggatccttgcgcccggcggcgtctgcggcggcgacggtttcggcgccggcatcgtcgaagccggtggcgggggcctcggcctcgatccggaagctcacccgggcggcagcctctgtcgcgatctcggcggtctctgccgccaccaccgccaggatctcgccgtcatggcggatcagccggtcctggagcggcgcgatcgacgaggcggcgacgccgaagcggggcaggccgatgcggccggtgacgtcgtcgacggtcagcacccccagcacgccgggcagggcggcggcctttgcggtgtcgatcgccgccagccggccgcgggccacgggcgagacgaccagggccgcatgggcgaggccggttatcgcggtgtcggcgggatagacggcccggccggtaaccttggcgcgcccgtcgatgcggggggtgtcggttggcagagaggtggggggcaggctcatcggcgggtctccgtgaccgggagatcgcgggcggcaggcagggcgcgggcggcaagcagggcgcgggcgatcaatgcggcccccagatcgcgcttgaaggcgttgtcgggccggaccacggcatcggcgaaggcggcgaccccggcggcatgggcacattcctcggtcaggcgttcgccggccagcagctgttcggccggaaaggcccgccaggggatggtggcgacgccgcccagcgcgaggcgcacctcacgcacccggtcgccgtccaggtccagcgcgcaggcggccgagaccagggcgaaggaataggaggtccgttcccggcgcttcaggaacagcgagcgccgcgcccagcccggggcgggcaggtggatggcggtgatggtctcgtcggcatccagcgcggtttcgacatcgggcgtcgcccccggcaggcggtgcagccgggccagtttcatgcgccggaccccgccctggccggtgatttcgatctgggcatccagcgccagtgcggcctgggcgaaatcgccgggataggcggcgatgcagctgtcgctggtgccgaggatcgcatggtggcgggtgatgccctccatcgcgccgcagccgctgccgcgctcgcgcttgttgcagggccagctgacgtcgcggaaataggggcagcgggtgcgctgcagcaggttgccgcccaggctcgccatattgcggatctgcgggctcgccgccagctccaggctttgcaccaccatcggcaggtcgcggcgcagctctgtgtcggcggcggcctcggccatgcgggtcagcgcgccgatccggaaggtgccgtcgggcaggcgggtgatgccgcgcagcgccggcgccgacacccggtccagatcgaccagggccgtggggcgttccacccccagccgcatcagatcgaccagattggtgccgcccgcgatctgccgggcgccgtgcggcgccggaccatgggcgggtgttgtcgggtcgagccgaaagggctgcatcacgcgcctcccatccggtcggcggcggcgtgcaccgccgccacgatgttgggataggcggcgcagcggcagagattgcccgacatgtgctcgcggatccgcgcgtcgtcggggtgtggttccgccgcgatcagcgccacggccgacaggatctggccgggggtgcaatagccgcactggaaggcatcatgatcgatgaaggcctgctgcatggggtgcagcgcgcccccgtcttccgcatccggcgccagcccctcgatgctggtcacccgggcgccgtccagccgggcggcaagcgtcaggcagccgagcacggcccggccgtcgaccagcagggtgcaggcgccgcactggccatggtcgcagcccttcttggcgccggtcagccccagccggtcgcgcagcagatccagcaggctgagccgggggtcgatggtcacgcggcaggggcggccgttgacctccaggccgaccatcaggccttcggccaggcggtccccaggcgggcggttacccggcatcgtcgtcatccgtgtcgcggcggtcggggggccagccttcggggaagcggtcctcatcctcggtctccccattctgttcgtcgtcgagggcctcttcgtcgtcgaacacgtcctcggcggcgcggcgggttgcctcttcggtcgggtccaggccctcggcctcgccggtgacggggtcggtgatcacatcatccggccgggcgggcgcttcgtcgcgcgggacattgcggaagcgcccgccatcggggctgcgcgtgtcgcgggcatcggcctcgcgcccttcggcgctgcccaggatctcggcatcggtggggtccagaggccggcggttccggtcggctgtcgccatggcggcggtatctcctgctcaggcgggcggttaccagggctgaacccccgaccgcgcgggaggttcccggatcaagggggaactctccctccgtccggccggttgaccgccatccccaggaaggaggccggcgatgaccaggcagagcccggagcagagaacaaccagcagggatgaccggatcaaagaacacatgcatcggctgtggaaggaagagggcgccatcccggggcgcgaggcggaataccgcggccgtgccgaggagctggtggcgatcgaggacaaccagcacctgaccaccttccgcccgggatccccccgcgaccgcatccgcaacgaccccgccgaaccgctggaggcggtggagaaccagggtgagttcccgaccctgaccgaccagggcgaagagcgcaccaccccccggccggtgccgccccgggatgacgatatttccgggtgagaggccgacgacaacgagaaaaccccgcaccctcggtcagaggatgcggggtttccgaaagtgcctcgggtatcgtcaggcgtcacgaatgtccgtggtggtagctacgcctgcgaacgcgcctctcgcctgtgggtcaggtcgagccgtcggctcagtcgatcagggagaggttggcggccgccagcttgccgctgcggcggtcggcgatcagctcgtaagagaccttctggccctcacgcagctcggtcaggcccgagcgctgaacggcgctgatgtgcacgaaggcatcggctccgccctcgtcgggctgaatgaagccgaagccttttgtggcgttgaaccacttcacggttcccgtcgccatgaggggacaccctttcgtcatcgtcgttgtccagtgtcgcccgcagcccaggcgcggacggacggcgggcaccccatcatccctggtgcccgtcgacgagaaaaagggtgcggcttttcgggccgggtttcaagtgcggcctttcgcctcccgccgtttcggcacgatccgcagacgcgaaaaaccccgccccggtcgaaaccagggcggggtctttcttggagacatcgtcaccgtggcgcgccacccgagggggcgcaccgcaaccggatcagagaagctccagattggcagctgccagcttaccgctgcggcggtcagcgatcagctcgtaggcgaccttctggccttcgaccagctcggtcaggcccgaacgctgcacggcgctgatgtgcacgaaggcgtcgtttccgccctcgtcaggctggatgaagccgaagcccttggtggtgttgaaccacttcacggttcccgtagccatgggaataacctttcgtcgtcgtcataagggcacccgcatcgcgtgcggatggtcgaaatcagatctcaaacaagacaaattcgaatgggtatacgaagttcatcggctagaggtctgggaaccgggtaggctcgtactcgacgctgccgaaggtggggccttttcgtccctctggcaagccggtatttcatttttttggggggcaggcccaaaataatcctctcatggcggtggacggcgaggggaaaacgcggcctgcggtcattgcagccacgcgcattcccgcgtgcccctattctgccacacccaatgccctgagcgccgccgccgtcagcccctggcggggcggcaccagcccggcccaggggtcggttgcgggcagcgggtcgcccagacggaaggcgtcggcccggtcgatcccggccagcatctgccagtcgaccggccgggccaccggggcgccggcccgggcgcggggcgaccaggggcagatggcggtggcggtgcggtcgttgcggaaatggtcgatgaagatccggcccctgcgctttgccttgctcatggtcgcgacgaagcggccgggatcgtggtcggcgaagcgctgcgccagggccttcgctgccgccttcaccaccggccagtcgtgccggcgggtgatcggcaccaccacatgcacgcccttgccgccggtcagcagcggcaccgaggcgaggtcgagggcggcaagcgcgtcgcgcatgtcgaaagccgcctggcgcacggcttcgaaccctaccgccggatccgggtccagatcgaagaccagccggtccgggcgctggggccggtcgatgcgcgatccccagagatgcagctccagaaccccgatctgtgccgcacccaccagaccttccggatcgcggaccagaacatactcttcggtactgcccaggctatcggtcagtttacggctggcgaaaccccggggcagaccgcggccggcatggcgctgaaagaaacaggccttgcggcggccctcggggcagcgcacaaggctgaccagccggttctccagatgcggcatcatcagcccggccacggcatcgaaccagcgggcgagatcgcgcttggtgatgccctgttcggggaacaggacccggtcgggatgggtcaggcgcacgccgcgcaggctgtcaccggtctcgtccatcgcttctgcctcctcgacggccatcacccggtccgcctcaacttcggccgccggcttgtcctcgcgcgggcccagatagcggccctggcggatcagcccctcgccggtcaggccgccatgggcgatctggaccacgatccgcggctccacccagcgcgccgcccgggccacggcgggcggcaagctgtcgcggtcgaccggcggggtcctgcgggccagcgccgtcagccgcggtgccagccaggcgaaatccctgtcgctgaaaccggcgcccacccggccggcatagcggcaggtgccgcgatcctgaaccgccagcagcagcgaggcgaagggccgcccggcttcggagggcgaggtgccgaccacgacatactcccccgcctgactgcatttgaccttgagccaggcatggccgcggcccgggcgatagggcgcatcggtccgcttggcgatcagcccctcatggcccgccgcgcagacctggtccagcaggtcccccgccgggccggggctgtgatcgacaaggtggatgccgtcgcccgcaggcgcccccagcagcgccctgagccgggccctgcgggtggtccagggcaggtggcgcaggctttccccgcccgccgccagcaggtcgaagacgccgtaatgcagcccctcgcccccggcggagagcgccgcctgcagggcggagaaatcggtgcggccgtctgccgtcatcgccgtcatctcgccgtccagcagcacgccgtccaggcccggccgtgccgccagcgcccgggcgatgccggggaagcggtcggtccagtcgaggcccgatcgggtgcggatgacggcccggccgcccgacaccgcggcgagggcgcgatagccgtcgagcttgatttcgaacacccagccgggcccgcgcggcggccggtcggtcagggtggcgagcatcggcgccacgaagccgggcaggggggcggcctcgcgcttcggctgaaccgccacgctgccggggtggcggcgggtcacctcgcccgtcgggtcggcatcggcgtcgtcgcgcttgatcagcagccagttctcggccttttccggcgcccgtccggccttggccgccggtttcatgcgcaccagcacgaaacggccgcgcagccgctcgccatggaggatgaagtccagccggccggcggcgagcccgtcctcggcatcacccaccggctcccaatggccgcgatcccacagcaccacttcgccggcgccgtactggcccgcggggatctgcccttcgaaaccggcataggcgagggggtggtcttcggtgcgcaccgccagccgtttctgcctggggtccaggctggggccgcgggtgatcgcccagcttttcagcaccccggcccattccagccggagatcgtaatgcagccgccgggcgtcgtgcttctggatggcataggtcagcctgccgccttcaggggtgcgcccgctcctggcctccggctcgggcgtgcggtcgaagcgacgcttgcggcgatagctgtcgagcgggtcggcggccatcggcctcaccccgccttgcgccggccgctccgtgccgcccgtgtcttgccactggccttgccgctgtccttgaccgagcgacgcagcgcctcgaccagatcgacgaccttgccgccgccgccggtctcttccgcggcctcttcgcccagctcgaccgatttctccgccgccttggcgtcgatcagctggcgcagggcccgggtgtaattgtccttgaaccgcccgggctcgaaggccgaggtcttccgctcgatcagctcggccgccaggtcgagaagttccggatcgctcgcctcttcgtcgatcgaggtgaagaagggggcggcgcgctggacctcgtcggcgaagcggagcgtctccagcatcagcccctggccgcagggcttcagcgccgcgacatattcccgcccgcgcatcacgaactggccgaggccgatccgtccggcgcgtttcagtgcatcgcggagcacggcataggcctcgatcgccagctcgccgtcggggaccacgtaatagggccgctcgaaccagatcggcgcaatctcgtcggggcccacgaactgcaccagatccagggtgtggcgggcctccaccttcagcgcatcgatctcgtcctggtcgatcagcacccagcgaccctggcccaggtcgaagccctttacgatctcgtcggtatcgaccggccccaccccgggcacgattttctgatagcggatgcgccggcgcgagggctcgtggacctggtggaaccggatccgcgcgccgctcttcaccgcggcataaagcttcaccggcaccgacaccagggcaagccgcatattgccggtccagaccgggcgtgccgcggggcgattggccgccgcctcgccgtcatcctgtcgtttcggtttcgccgccttgcgcgccatgggtcgcctctcgtcttctccgggcctgatcccgtcaacccggccgctgcggcagcggttcccgagaccccggacccccgagaccccggaaccagggggcgggctgccgggttcgcgctgcaagggtaagaccagccgaaggaggtatccgacccatgtcagatgcgcgcaccaccaccgatcacgacgaaatccgccgctgggccgaggcgcgcggcggccaccccgctgcggtcaaggcgacccacaagggcggtgacgccggcatcctgcggatcgatttcgacgacggcgagcccgatccggggctggagcggatcagctgggaagatttcttccgcaaattcgacgagaccgccatcgccttcctgcaccaggacaaaaccgccgacggcaagaccagccgcttcttcaaattcgtgcggcgcgaggaggggtgatccatggcggggccgaaaacgatccgggctttcggcatcaactgcacgctgaagggcggcgatgccgaaagctcgactgatctgctgctgtcgcagttcctggcgcggctcggccgtgacggggtggagacggcgagcatccgcgcggtcgatcacgacatcaaacccggcatcaccgccgatgaagggccgggcgatgcctggccggcgatccgccgccaggtgctggacgcgcagatcctggtgatcggcacgcccatctggctgggccagccctccagcgtctgcaagcgggtgctggagcggctgaacgccttcctgaccgaaaccgacgaggcggggcggctgcgctcttacggccgtgcggtggcgctggtggtggtgggcaatgaagacggcgcccatcatgtcgcggccgaggtctatcagggcctggccgatgtcggtttcaccatcccgcccaatgccgtggtctattgggtgggagaggcgatgggcaagaccgattacaaggacctgcccgccatgcccgacaagatcggcaccaccatcgatctggcggcgcgcaacgtgctgcatctggcccggctgctggccgaaaaccagtatccgcccgatggccagccggcgaagtttcgcgaggattgagccggcggggggattgagtgatggcgggcgcactgcccggtgcccgccatcatctgcgtcaggactgaacgatggtcccgccattcggatgcagcacctgaccgctcatgtaagacgcctcctcgctcgccaggaagacatggcaggccgccacctcgttgggctggccggcgcggcccatgggggcgctgccgccgtgttcggcgaccttttcgggcggaaagctggcggggatcagcggggtccagatggggcccggggcgaccgcgttgacgcggatcttccggtcgaccagcagcttggacatcgatcgggtgaaggccacgatcgcgccgcgggtggcggcataatccaccatgctgggatagccctgataggcggtgatcgaggtggtgttgacgatggccccgccgtcgggcagatgctccagcgccgccttggtcatgaagaaacagccgaagacattggtgcggaaggtccgctccagctgttcggcggccagatcggtgaagtccttcacctcgtgctgttcggcggcattgttcaccagcacgtccagccggccgaaggtcttgaccacttcgcggaccatccggcggcagaccgcctcgtcgccgacatcgccggcgatgtgcatggcctggcggccttcggcttcgaccagacgcacggtttcttcggcgtcgcgatgctcgttcagatacagaatggcgatgtcggcgccctcgcgcgccatgccgatcgccaccgcccggccgatgccgctgtcgccgccggtgatcagcgcgaccttatccttcagccggccggtgccgggaaatcgtggcatgtaatcgggggccggcgacatttcatgctcgcgccccggctgctgattttgcctttggggtggttgaagatgatccgacatatccgtccctttccaggctctgttgcagacatgtcgcgtgaacgcttccagatatatttggttccggcataggaggaacagtatgccatccgttcaagttccgtctccgcgtgccgcgtgacgtgcggccgtccgatgaattaaactgcaacggaggttgatccacccgatgacgaacgacgtaagaaaggtcgggtgcccccaatccgacgtctggcttccggagacggccaggctggtgactgccgaaaccgaagcctcgaccggccggcgcccatgcatcatgcatcatggcccgaggctgccttcggcaggatgatcccatgacgaaggaacacccccaacccatggcaagcgcacatcccggacgtcgcatcgacgggaccgacccgaaacggcaggccgagcacgacgaccgctcgctcgaccgggccctccaggatctctacgccgcttatggagacgacacatcgccgcccgaagagctgatggctctggcgcgcgaggctgctgcggctctggtcggcaaccccgtctatgacgatgccacgccgaaggatgcatcatccgaggcatcttcccagccggacgccccgccggccgacgccctgccggccgataccgtgcagggcggcggaaagccccgatcggacgagcacacctcctgatccgatccggcacccgcagcggggtgcaccggatgtcgtcgccggccccccatgatgcggggcgtcagcggcggcggcagagatagatctcgtccgccggacgggacaggatcgtgaacccggcgctgcgcagcatcgcttccgtgcaggcccggttcgggatccaccagttgctggggtcgcccgcataggcgtgctccacgaaatgcagccgcggatagtcgtcgcgatcaaagatcgcgtgttccgagaagtcatgatccgcggcgagtgcgccggccgttccggcgccccgctccagcgactgcaccaccagcagatccgccgccgcatgggcgtggatcaggtccagcgccagcagcgggtggcgcaggtggtacagcacccccatgaacagcaccagatcgaagcgctcgcccagccggggcaggtcgtagaccgacatctcccggaactcgaccgcgaccccggcgacctctgccgccagacgcgcctgggccagatagcgggggtcgtgatccaccgccagcacccgggcggcaccttcctgcttcagccggatcgagaaatagccggcattgcagccgatatcgagcacgttgagaccgccgagatccgccggcagggccgggcgcagtctttcccactgaaagcccggatagtcgccgaggaaatggtccggcgcggtccggatgccatcaagttccatgttgtggaaccatggcccgagttcgtcgatgcggcgcctgagatcgtgattcggggtgtggtctggcatgggtcgggtccgtctgtcgtcgggagtcatggccctgcgaacagcagcgccaccagcgcttcggcgcgggtgcggcggccgccggcacgggcacgggcgtaaaggccggccagacggccggtctcgaaggtctcgatcagccgctgatggacatagctgcgccgggcgaccgccggggtattgcccagcatctcggccaccgcacgcatcacatgcgcgatctgccggcgccggcgggtgaccgatcgggcgggatcggtggcggcaagcgccgcaccggcggcggcagtggcggcgagggtgcggaaatccttggccgtgaccggggtttccaccgggccgcggccgcgggcgatctcggccagataggcgttcacatcggccgcagtcaccgtgtgcggccggccgttgccatccggatactggaacagccgcgtgcccttcagccccgtcaggcgggtgagggcggcggccagatcggcatcgtccagggtgcaggcgatcgcccggccgctcttgccgcggaaatccagcgccaccgcgctttccgagatcgacacctggcgcttcagcagggtcgcggcgccgcggctgcggccggactgaacatagtcctcgcagccgatccggatatgggtgaggtcgatcacccgcacgatcgcggccagcgcgccgtcgcgggtccggcctgcctgttccagatcgcgcgccacccgggcgcggatgcggccgatcgccccggccagcgtcgccagacggtcgatcttgtcgcgctcgcgcacctgttcccaatccggatgatagcggtattgcagccgcccggcgcgatcgcggcccgtggcctgaagatgggcgcgcgggtcggccgcgatgcggacctcgcgataatcgggcgggatcgccagcgccttgatccggtcgatttcggccgggtcggtgatccgccggccatcaccgtccagatagacgaagccgcgccctgcccgcctgcggcggatcggcagggcatcggccgcggcccggtgcagccctgccgcgcgcatccgcgccgcccgccggcgcttgcgcccgcgggcgggcggcgcgctaccctcgcggctcaatgttccggcgccgccaggcccagagagaccgcagcgccgccggccggctcgcgccgccgggccgcggcaccgcgcagctctgccgcgggcttcgccaccagccggccctcttcggccagcagctcggcgaaccagtcgatggtggcggcaagcccggtgcgcagcggcacccggggttcccagtccagcagccggcgggccagggcaatatcggggcgccggcggcgcggatcgtcggccggcagcggatcatgggtggtgcggatccgccggccggtcagccggccgatcatctcggccatctccaggatcgaatattcttccggattgcccagattgaccggggtctcgggccgccgctcgacctcgatcagccgcaccagcccctcgaccagatcgtcgacatagcagaacgaccgggtctgacggccagagccgtagatggtgagcttctgcccggtcagcgcctgggccacgaagttcgacacgatccgcccgtcatccagccgcatgcgcgggccataggtgttgaacacccgcgccacccggacatcggtgccgtactggcggacgaagtcgtagcacagcgcctcggccatgcgcttgccttcgtcatagcaggcgcggggcccggtggtgttgacgcagccgcgatagctttcgggctggggatgcacctccgggtcgccatagatttccgaggtcgaggtcatgacgaagcgggcctcggcctgggtcgccagttccagaaggttcagcgtgccgaccacgctggtggtggcggtgcggatcggctggtcctggtaatgcggcggcgaggccgggcaggccagattccagacctgggccaggccggcgatcttgggcagcggccggcggatgtcgtgctccatgaacacgaaatccggatgatcggccaagtgggccagattgcgggcaagcccggtgtggaagtcgtcgaccccatagacccgccagccgtcgtcgatcagccgggtcgcgagatgcgagccgaggaagccggcggcaccggcgatcagggccaccgggcggttcggccgcggcccgcggcggttggtctgcggggtggggccgttcatggggcgatgatcaggcaggtgaatgcgcatcgtctccggtcctttcgcgctgcccggccatggtctgcccctccatggcctggatgacgggcgggtgggcctcgtgaggccgcaccagccctgcgatcaactcgtctgcccggtgccgcccggtatgggcgccgagcaccgccgcacgcgccgcggcggcgatgcgcgcgcgggcccgggcgtcgatggtggtcagcaggcgcaccacctcgtcggtggtgtcggcgatcaggattgcgtcgctctcggggaagatcgcctccagcccgggctgacggtcgctgatcaccggcgtgccgcaggcgccggcctcgaacagccgcacgctgggcgaccatccggtcgccatcatctcggcccgtgtgaccgacagcgtgaaggccgatgcggcatagaaggcgggatggtcggccggcgcgacatggtcgacccgctcgacattggcgggccaattgatatcgtccggatattgcggcccggccacgatgaagcggcggtcgggcaggcggcgggccggctcgatcagcagccgctccagccccggctgacgatcgggcgaataggtccccagatagctgagatcatagagcggccgcccgcccgccggggcgtaacggtcggcatccaccgcgcaatacagcggcagcgcccggcgtgcgccgtaatcgcgttccagcctgtccagcagcgggccgccggtgaagctgaaatagacgtcgaaagccgggatcagcatgcgcgacagccagctgcactggtcttcatccagccgggcgagtgtcaccggcgtgtcgatgtcgtaaaagccgaccggcccgccggcgatggtcatcacccggcggatcacctcgatcccgtcgggcacgtaagacccgatcagcaccgcatcggcccccgcgatcagcgcgcgatgcctggtctccagctcggccgggcggtcgtagaagaccagccggcagaaatccgggtcggccaggtcgcgctggctcgcgtaccagggcacgtcgcgctccagaaaggtgacgcgatggccgcgggcatggaggccgcggatcagcgcccggaaggtggtggcatggccgttgccccacgacgaactgagcgagaggccgagaatggtgatgtcgagcgggcgggtcatgcggcgcgttccctggctttccggtcgctgagccggcggaggatctggtccacctcgcggccgcgccggtcataggtgtggtcctgaacgatgcgggcacgggcccgggcgccgatgtccgccgcccgttccggcatcacctggcccagcatggcgagcacgtcccggccgtccctggccaccaggatctcgcggcccggctcgaagaaggtttcgatgccgggccagtgatcggtgatcaggcaggcgccggcggcggcggcctcgaagatccgggtggggggcgagaaaccgcgttcggccatgctgtcgcggttgacgttcagcaccatgcgcggggtcacgttgaaggcgttgtggtctgccgtgccgacatggccgatcgcgcggacattctgcggcagctcgtcctgcacccagccggcaccgcccaggatcatccggcaaccaggtgccgcggccgcaggttccaggaagaagcgccgcacccgcgtttcgcggtcgggcaggcggttgccgaggaaggcgagatcggcggcgaagcgcggatcgggcgccaccggatgatgggtgtccagatcgacggcattgtagaccggcaggcaggcgcgggcgccggccccggtatagtcggccaccacccccggcccgccgccataggtgagcacggcatccagcccgggcagcgccgccgccagaacccgttcgccgccggtcgccatggcgtgcagcgtggcgggggcgtcgacatcccagaacagccgcagggcatcgggccgggcggcggtcatcacccggtcgagcaactcgtcgtcatgcacgccgaccccgctcgccttgatcaccacatcggctttggcggcatgggcgaccgccatctccagcccttgggcatcgggctgccagaccaccacccggcaccaggccgacgggtcgatgtcgcggcgttcctggcggccgaaggcgtcgggctcaagaaacgtcacctcgtggccaaggcccgagagcgcgcggacgatgccgcggtaataggtggcggcaccgttccagtagctggacaggatgctggagccgtagaaggcgatcttcatgaggaaacggcctccgctgccgtggcatgagggtggacgccaggggcgtgtgttgcaggccggtcgggggcgatctgccgcaggatctcgaacagctcgtccacccggtgttcgcagccatggcgggcaaggatggtctcgcggccgttccgcgccagctcccgcgccatcgccgggtcgtcgagcacggcccgcatggcgcggcgcatggccgggccgtcttcgacccggaggtagtcggtgccggtgcggaacagcccctcgctgtcgtcccagggggcgctgatcagcgggatgcctgaggccagcgcctcgaacatgcggatggtcgggatgccgggcagctcgcgcgcatagaaccggcggggcacgtggatggtcatccggtggcgggcgaaggtttcgggcacatcggcattggcgatccaacccggctggtcgatgccggcgcgggccagcgccacccgcgccggttcgggatagcgcaccccatggacggtggccgacaggccgagcgcgcgcaccggctcgaccaggaattcgtccagctccgcgccgcgctcgccatcgccccaattgccgatccagaccagatcgcggctgcgcgggatctggggatggggtttgaacagggtcagatccgccgcctcgtgccagacatggacctgatcggcccagccatggcggcgccaggtttcggccagcacggcgccgaaggcgagcacgccgtcatagccgtccagatccagcgccgccatctcttcgggggccgagaccgcccggtggtgggtgtcgtggaacaacagcacgaagggcgcgccccgggcccgcatccggcccagccggcggaccagcgccggatcggtccattcatggaccagcaccagcccggcgccgtccagcgccgcctcgatctcttcgaaaccgcgatagtcgatgcggtcgatatcggggaagcggcgggcgaagcccggggccggatcttcgccgatcgcctcggccaggttcgaccggctccacccgcccaccggttccagcgccaccgcctggtggccgcgcgcggccagcgctctcaggatgccgcgctggaaatgggcattgccgtggttccagcacgagaccaccgaatgggtgaacatgacgaccttcatggcacggcgtctcctctgtcggcggtgtggcgggcgagcacccgggcatagacggcgagcattgcgtcggcctggcgggcgtgggagaaggtggcggcccgggtggtggccagcaggcccatgcggcccagggccgccgggtcgcggaccagcccgtcgagcgcgtcgcgcaccgcgtgcgggtcgtgcgggtcgacgaaacaggcgcagtcgtcccaaagctcgcgatgggtggggatgtcggacagcaccagcgccgcaccggcgccggccgcttccagcaccgacaggccgaagggttcatagagcgccagcgagacgaagatcgcggcctcggccatgcgggcgcggagggcgcgattgggcaggctgcccagatgggtgacatgaaccggccgcggcccagcccctcccgacccggcccctcccgaccccgaacttcctggcccctccagcgggccggcgatctccaccggccagagcgcgccctcggcggcggcatccagaacggtcaggttcttggccggatcccaccagcgggcggcggcgagcgccacctgccgcttccggcccgccatcaccggcacggcggcattgggcaccaccgccaagtcgggaagcgcgccatagatcgcggtcatggcggcggcgaaagcgtggctggggctgatcaccgcatcggccgccgccaggccccgggcggtcgccgcaccatgccaggcgaggttgagcggcggggtctcgccccgcaccgcctgccaccaggtcgacaggcaggaatgggcggcggcgatgcgcggaagatgcgggctcagaaacggcagcagcggcgggttgttgacctgcaccagatcggcgcccgcggcggtgaccgcggcggcgagcgcccggccgctttcggacagggcctcgggcccctcgacctgccagtcgagcggccggtcgatccagtccagcgcgacgcccgcctcataggcctcgtcgcgctgcgcttccgacggccgggggccgaggccgatcagcaggggctccaccacctgcggtgcgtcatcggccaccgccagcgcccggcccttcagcgtgccggccaggtcgagcgcatagcgccacacaccccccaccgcatcggtcgtgatcaccagattgagcggcgggctcagcgtccgcatgccgcctccagccggtcgaggggtaccgggcgttcgtcctgaatgtcgctgaaccggtcgaaggccgccagataatgctcatgcgcccgttcccaggcccggtcgtccgggcggccccagagcgcgtgatattgcggcgaggcggggtagggataaagcggcacgggatcattggcccagacgccatgggcctgaacatgggcgcgccaggcggcgatgtcgtccgggtcgtcttcgggcgtgccgatcagattggcctggacgaagggcacatggcggcgggcctcgatcagcagcgcggtcagctcgtcggtgccgatgcggcagcgcttggccagggcatcgcggccggcgacggtcaggctttcgacgcccgcctcgatcgacacgcagcccgcccggcccagcagctccagcatgccgggtttccagaggtcgatgcgggtctggatgccgaagcgcagatcgcgcgcgaccagcgcctccagcagcggcttctgcggcaggaagatctcgtcgatgaaatagacgtaagtgacgccctggtcgatcagccggtcgatctcttccagcaccagatccagccgacggcggcgatagccgtcgcggaaatccagcttggcgcagaagctgcaggcataggggcagccgcgcgaggcctccacctcggccccggggccgtcgggggcggcgtcgaagcggtggtggtgatggtcgtggcgctgcagccattcggtcggccagtgcagcgccggcagatccttgaagccgccgatatgcgggcggccattgaccagggtgtcgccgccggtccgccaggcggtggcgggcacgcggcgcatggcctccaggccgggcgcggcggcgaggctggcgatcacctcttcgcattcgcccatcaccaccgcatcggcggtcagcttgcgcagcgtcgcccccggggtggacgaaccatggggcccgaccgcgatccggatgccgccgcggccgcccaggcggttgaggaaggcggccggcacccgcaattcgggcggcgcacagcgccagaacagatagctgggcgcggtggtgaccacggtcatggccggcgcgaaggcggcgacgcgggccaccgccgcggcctcgtccagcccttcgagatgggcgtcgatcagcagcacctcgtggccggcctcggtcagcagcgcacgggcatagcccagttccagcggcagatgcggctcgcggcagccgaaatagatgctgccgtcgaagctccagggcgggttgacgagtgcgatcttcatgcggtgagactccaatccgccggtgcggtggcatcggtggcggcgatgccttccgcgaccagccagtcatgcaggtgtttcagccccgccgcccagtcgatccggcgctgccagccggtttcggcctccagccggcgggtatcggccacgaaccacagctgatcgccggtgcgcggccggtcgtgatcgagggtgacgggacggccggtcaggcgccggatcgcgtccagcaccgtggtcaggctgacggcattggcggggccgccgcccaggttgaaggcgcggccggccaggcggtcgatattgccgcgcaccgccagataggcggccacggcatcgtggacatgcagcacgtcgcgcacctgaaaaccgtcgccgaacagggtgatggcctcgcccttgagcgcacggatcaggaaatgggccacccagccctgatcctcggtgccgaactggcgcgggccgtagatgcagctcattctgagcaccgcggtcggcaggccgaaggaggcggcatagtccagaacgtactgatcggccgctcccttggaacagccatagggtgtcgcaaggtcgagcggccggtcctcgccgatgccgaagcggcggagcccgggatcggccggcagatggccggccggggtcagctccgtcgccacgtcgcccagatggccatagaccttgttggtgctggcgaagaccagcggcggcggcaccgggcgcgcgcgcagcgcctccagcagatgcagcgtgccgccggcattgatggcgaaatcctcgaccggggccaccaggctttcggtcaccgccacctgggccgccagatgaaacaccgaggcggcatcgcctgcggcatcccccagggcatccagatcgcggatatcggcggcatgcagcgtcacccggtcgccatggcgggcgcgcagccagtcgacattggaggcgacgcccggcctcgacaaattgtcgaagagcagaacttcctcgcctttcgcgagtagggcatcggccagattggcgccgatgaacccggcgccgccggtgatcagcaccggggcggcggcacgctgcgataccgcccccgcctcgcgggtggtggcgatcttgcggcgcaccgcttccaccccgccccggcgcagcagccgggccagcagcttgtcgcggccgcgggtgtcgagcacgcccatatggtagtgccggatgtcgaagccgcggccttcctggatggcggtctcggccggcagatcttgcagcgcataccagtagagccggtcggccggggcatccagcgcatcgaggaagcggcgggcctgttcgcgctgatcatggcgccaggtcgaatagccggcctcggtgatccagatctgggcgtcggggcggtagcggtccagcagcgtgcgcagctggccgatatgcgcctcccagccgccccagacccccgcctcgctgtcccaggtgccgggaaacccgtgcaggcccacggccgagacggtgcccaggatgccgcgttcgcccatcaactccagccaggccatgtcgaaggggcagggcccccccagcaccaccggccagccgcgcttttccgcccaccaggcggcggcgccgatcatctcgcagaagatcgaccagtcgcgatccacccgccagtcccagtcgagcaggttgttgggctcgttccaaagctcgatccgcgggaaatggcggccgtggcgggtcaggacatggtcgacgaaatcggccagatcccgcggccgccgcggcgggcccgaggcggtgccggtgaccgagagcgagggcggggtataatggatgcagggcagcacctccacccgggcggccagcgtcggcagcagccagtcgtaccagtcctggccgccctcggcgtgataatcggcccaggagagatgcgtgcgcagccacgacacgcccatcgcctccatatggtccaggcaggcatgcacgcggtcgtgatcgccgggccggaaccattcggtcaggccgaaggcggggccggatggattgtgatcggggggaagcgccgtcataccaccagcccccgcgtctccagctcgcgccgggcatcggcgacgcggtcggccgcctgctgggtggacacccagcgcaccagttcgaacaccgtctcttccagcggcaattgcggctcgaagccgagacgggtgcgggcatgggtgatgtcggcgatgcagtggcgcacgtcgccgacccgcgatttctgcaggatttcggggacaagatcgtcgcgatccatggcgcgcgccagcaggcgtgccacgcctgagacggtatagacccggccgcttgcgatgttgaacacctcgccgccgatgccgggggtttccagcgccaggcggaaggcgcgggcgacgtcgcggacatggacgaaatcgcgctgctgttcgccgtcttcgaagaccagcggcggctggccgttgagcagccggccggcgaagatcgccagcaccccggtataggggttggacagcatctgcccggggccgaaggtgttgaacaacctgagcgccacggcatcgatgccataggcggcgcccagcatcagggtcagccgttcctgatcgtatttggtgagggcatagaccgaattgaggtcggggcgcttgctctcgggcgtcggcgccggcacgagcggccggccgtcgggtgccacaggatcccagcggccggccttcacctcgtccgccacccggcggacgtcatccaccgcagcgccatccccggccgtgcggtacagcccctcgccgtaaatgctcatcgacgaggcgacgatcaggcggcggatgcccgccttgaccagctgctgcatcagcaccgcggtgccgaagctgttgaccgacacatagcggtcgatctcgtacatgctctggccgacaccgacatcggcggccagattgatcaccgcatccacgccatccagcgtgcgggcgaccagatcggcatcacggatgtcgccccgcacgaagtcgaccgcaggcggcaggccgccatccggggacggatcggggccatgcgcctggtcgatcaggctgtccagcacgcggacacgatgcccggcgccgagcagttcggtgcagacgtggcggccgatgaaaccggcgccaccggtgacgaggactgtactcatgcggcaacttcccggaggtcgtcttccctgaagggccggaccgtccggcccggtgtctgacaatcaaccggccggggaagaaaaggttgcctctgagcaagatgccgttgaagacgaagccgtcaggtggagaagaagaggaagatgccgcgcgcgccctcaggcgccggaccctcaggcgccggaccctcaggcgtcggaccctcaggcgtcggggcgcgccggccgccggtcggtgtcgtccgcagcgatacggctgcgacggctgccaccggtgatgtcgtcaaggaagtcgtgttcgtcctcgctgtcgagcaggcggagcagggccgtgcgggcccggctgacccggctcttgatcgtgccgagggcgcagccgcagatttccgcggcctcttcgtaactcatgccgccgccacccacgagcatcagtgcctcgcgctgatcggcgggaagcttgcggacggcctcttcgaccatgcgcagcttcatcgaccattcctgagccggcttgacatgcacgccgggcagatcctccaccaccagcacgggttcacgctgctgcttgtgataaagggtgtagaaggtgttgcgctggatggtgaacagccaggcgcgaaggttggtgccggcggtgaactggccggcattggcgatcgccttcgtcagcgtttcctgaaccagatcatccgcttcgcacggattcctggtcagcgatcgggcgaaggcgcgcaaggacgggatcaaggcaacgatttcatcctgaacgacctgttggtgatgttccatcatgcgtggcccctgtccattgtcatcgggtccgtggtggctatcggctttggcgtgtccgggtgtcggcggaaccggctggtgcctccgctccagggcggggccgccggaagatgtggcgcgaccggatgcggcctccctgccgccggcctggagtggatcagtctgcgcgccgtgctgtggcatccgtatgtcctccctgtttcaacgggtggtcgcggatcgtcgcgtggtcatgacccgaatttgcgtggcatttcaggcaaaaggagccgatctgcaccggttcctccgcccctcccggtcagcggtagatccttctgcaaaatgcgaggatattcaccgcagcagcggggaggaattgacccactcaggaaccttaatgcggccgcggtaaggattctttaatctagtttaaccgttcccgtggtcacatgtggcgtttcacgaattgttgatgtggttgatatcacgggattttcccgggcgactctcccgggggccccaaatcgggcgcggcggagcggcggacgagcggggcgcggttcgcccgcagattgagggttcgtgcccgcctcggggtagggggttcggccagatgagactgacaattgcaatcggccacgatgtggttgcccgaggtgcgattcatcgcaccaacagttccacggccacgatcatgcccataaatataatcgttatgacaccaaccagataaagcccgcggggcaaccgccgcggttggccaccgggggagggttccagccggtcgccgtccagcccgggggccgaaaccgggtgatgaaccgtctctgccgtcgccgcggccgcgatgtctgccccctggggcggcgtgcccgccgcttcgtcatcggtgccgagcggcgcggcggcggggtcgaccaccggcaccttgtcgcccgtctgcccccgatcgatccggtcgcgcagctccgcactggtcggcggcgcatccggccgcaccggcggcagatcccctggtgccggcgcgatcggcgccggatgctcgcccgagggccgggtgtcgcgcggatcacgcgcgcccgcttccatgtcgcgcggatcacgcgcgcgcgcttccatgtcgcgcgggtcttgcgcgcagtttctggcttcggtgtcgcgcgggtcggtcatgatgtcatatctccgcagacgggggctcttcgcccgtcaatccgctgcgggggcggctgttccgccggggagcgtgtcacgatatccccgccccttctccccccgcgccagcgccgccgcgacggcccttatgtccgcatccgacaggccgctcgcggcgcgggtcatcacctcggcgcgggggccgccgccgcgggtgccggcgcgccagaggtggagctgggtggcgagatagccggcatcctggccggcgaggcgagggatgccgggtttggggtcggcgccgcccgcaccgtggcaggcgctgcaggcgggcacgcgggcttcaggcatgccgtcggagatgatcgcggcaccctgggccagccgctcgggatcggcgtgggcggcggggtccggttccggtcgttggccggcatagtggcgggcgaggcgggcgatggtgtcgtcgtcgagaccggcggtcgcgacctgcatgatgccgccgtcgcggcggccgtcgcggaaatcgatcagtgtcgccgccagataatcggtccgctggccgccgatcaccggcaccgcgccgccgtcggacccgccatccgtgccgtggcaggccacacatccggcccgggcgggcaggctgtcgccggcgtccgccgtggcggcgcggccggaaagctgcgcataatcggctgcgtccatctgcggcagggcgcgcaggaaggcgaccatcgcccagacctcgtcgtcgcgcgccggcgccggccaggcgggcatgccgctgaatttgatgccatggccgacgatgcggaacagctcggccgggctccaggcatcggcggcgtgttcaagcccgggcgggcgcggggtcatgttgaagggcagtggcccggccggggcgcccggcgcgccatggcagaagcggcaggcggtttcgaaatggccggcggcgcggcgcaccagaaccgggtcgtcgacctcggcgggcgtttcgacgaacagcgcatcggtgcgcacggaattctgcatcacccaatgcaggaaccaggcggtgatccgccaatggcccgaactggcggtgaccggcatcagcccggcccagagcgccaccagcgccgcagcggccagcccgcccaggccgtagagcaggtggcggagacggatcctgcggttcatggcatggtcccctcaccctggctgtcgcggaacagccgcgccatcagcgccacccccccgatcagataggcgagcccgccgcccagcagcatgatcacgcccccggcctgctggtcggcgatcagctgcgccggatcgaccccggtgccatgcagcccggcaaggccgtgggtgtagagcggccggccggcgaaagcgatcagcgcgcccagcagggtcatgtgcatcgaggtcagcagcaggccgacggtgccgagggcggcacggcgggaccggccatccgtctcaccgcctgccaggccgtggccgagacaggcggtccagacccagagcccgacggtcaggaagctcagctgttcggcggcatgggcgatgggatcggtgcgggcggcggcatgcagggccggcaggtgccagccccagaccgtgacgaattccgccgccgaggcgatcagcggcccgaagagcaccgggtggcgcgccgacgggtcgaagcgcgtgccggcaatgccggcggcgagcagcggcgccaccaccgccaccagccccatatgcaccgccatatgggcggcgaaatcctgctgcgaggcccgcatcagcggcccgccccagagcagcgccagcaggatgagcccggttgccaccagcacccggcgcatcatcggcaatccgggatgaacacggccggcaggctggtgaagatcaccgccacgaagctcaacgccgcgaccaggaaggtggctgcccccatctggcgcatgcgggcgccccgggtcgggtcgtcatgggggggtgtgtcggtggtgaagccggtatggcggtgggcggcgcgggccgccagcacgatgaagaccagcgccgccgcggtggcagcggcgatcaccagccgcacggtgccgagatcccaccccttggcgcaggcgatggcggccaggatataggcggtcaggaaatgcagcgcccagacggtgggcggggcgagcagggtgacgatggtggcgcggtcggggcgggtcagcatggatggctctcccctcagccggtcgccagcgggaacaggccgatcaccgccatggtgatggcgagcgtggccgtagcgaaatgccagtagagcgcgacgttctggatgtcgatgtcatggaccggcgtcatgtggccggcaaggctgcgggccaggcagtagagctgcatcagcacgcccgccgccagatgcagcgcggtccagatcaccagcacccagacggtcgcgtcatagacatgcaccacggggtcgagcccggtggtcaggatggcggcggccccggcggcgatggaggcgagcgccagaactgcgcctgcccccagcgccagccttgccgtcatcacccggccggtgcggttggtgtggcgggcggccagcaccgccgcccaggcggcaagcccggttgccgccgcgatgcccggccaggcgagccccgggccggtcgcctggggcggcgggaattcggcatggatggtccagtagaagaaatagccgaagaccaggctgatgaaggcggtggcatcgccgaccatggtgatgcacatcgcccaccagccgactgaacgcggccccgaggcatagagcggcagggtcagcccgcggccgacatccatcatggccgcctcgggcgggcgggcggtgccggtccagagccagcccaggatcacgccgatgccgatgatcccgccggccgccgccagccaccaccattcgaaggtggcggcgatgaagcaggtgccgatgaagatggcggcggcgagcgggcggaaggaattggccggcaggcgctgcacctgttcgggcgtcgcatccagcacgccggtgatcagggtctcgcgcttgcccgcggcggcgtcgggcagatagccctggccgcggtccatctcgtcgagcacgcccggctgatcccagaggggatagcggctggagatctgcggcaccgagcgcacgccccaggcctcgtcggtggtctcggccgtccattccagcgtgccggcattccagggattgcgcggcgcgggtgggccgtggcgcagggcgcggaccacgtccaccaccactacaagcaccccgattgccataatataggcaccaaaggtagaaatcagattcagccagtcccagccatggccggcgggataggtgaagacccgccgcggcatgccgcgcagcccggtgaaatgcatcggcaggaaggtgatgttgaagccggtgaagatcagccagaaggcccatctgccgagccggtcggacagcatgcgcttcgtggcgaaagggaagaagtagtagagcccggcgatcagcggcagcagcatgccgccgatcagggtgtagtgcagatgggcgacgacaaaatgggtgtcgtgggcctgccagtcgaagggggccagcgccaccatcaccccggtcagcccgccgaagacgaagactgcgagcgcgccggccgcgaacagcatcggcaccgaaaagatcacccggccggtggccatggtggcgatgaacacgaagatctgcacgccggtcgggatcgccaccgcttcggatgccgccgagaagaagcccagcgacagcgccggcaggccggtggtgtacatgtgatgggcccagagcccgaagctgaggaaaccggtgccgacggcggccagcacgatccagccatagccggtgatcggcacctgggagaaggtcggcacgatcatcgccatcagcgcgatcgagggcaggaagatgatgtagacctccggatggccgaagatccagaacagatgctgccacagcaccgggtcgccgccgcggtcggggtcgaagaacggccagtcgaacatccgttgcagttcgaacaggatgtcgccggcgatcagcggcgggaaggcgaacaggatcatcccggccacgatcagcacataccagcaatagagcggcatcagatggatgcgcatgcccggcggccggcatttcagcacgccgacgatcagctccaccgccgccgcgatcgaggcgacctcgatgaaggacaggccgagcagccagatatccgcgccgatcccggccagatccttgttggtggcgagcggcggatacatgaaccagccgctggccggtgcggcatcgaaaaagatcgagccggcgacgaacaccccgccgatcaggaagcaccagaaaccgaaggccgagagcctgggaaagggcaggtcgcgcgccgccagcatctgcggcagcagcagaatggccaccgcttcgaagatcggcacggcgaagaggaacatcatcatcgtgccgtgcagcgtgaaggcctggttgtagaattccggggtgaccaggtcgttctcgggcacggccagctgggcgcggacgatcagcgccagcacgccggcgaacaggaagaagccgaaagaggtgacgatgtaccagatgccgacctcggtattgttcaccgccgaccagtagcgccagccccggggcgtggcccagacacggcgcagacgcgccgcctgtgcctcggcaagctgctcgcgggagagatcgtcactcattgcaatccctccagataggcggcaagggccgagaggtcgtcatcgccgatcccgccataggccggcatcagcacgccgggtttgaccgtgccggtggccgaaatgaagtcggcgatatggtcggccgtgttgggcaggatgccggcgccgatgctgtgccggctgcccagatgggtgagatcggggccgatcgtgccccgggcggccgtgccgcggatgctgtggcaggcgccgcagccctgctcgtcgaacacttccgccccgcgcgtcgccgcgctgcccggggcgggcggggcggcatcccggctttcggcggccagccagcgggcgaaatcttccgccggcatcacctcggcggtgaaggccatcagcgtgtggccggtgccgcagaattcggcgcaggcgccgcgatagaggccgggcttcaccggcttcagcagctggcgggtcacgcgccccgggatcatgtcggtcttgcccgcgatcgacggcagccagaaggaatggatgacgtcggggctggtcagctccagctcgaccaccgcgcccgccggcaggcgcaactcgttggccgaaaccaccggcgggccgtcttcgggcagataggtcacccgccaccagaactgttcgccctgaacccggatcttcaggtcaccgccgccggcccgcaattccggcatcagcctgagaccatgggcgagcagcagggtcagcacgatggtggggaagatcgcaccggcgccgatgatgaaccattgcgcccggttctggctgaccggcgggcccttgcggcgtgccgtggcgatggcggtggccatcacgccggtccagatcacggcggcaccggccagcatgatccagaacagcgttgccacccgatcggcggcctcgccggcggggtcgagcgtcgattgcatgcctgagcagccggcgagtgccgcgcccgtggcggcgatggcccagctccgcggggatgtgcgggcggccgggctgcgccgtccgggcgtcacggcttcgagcgtcacggcgatcagcctcccccgtcatcggcggcgggtggcagggcataggcgatgatcgcatcccccgcctttgtccccagcgagccatggccgccggccaccaccagcagatattgccggccgtcggggccccgataggacatcggcgtcgcctggccgccggccggcagccggtcttcccagagccgccggccggtttcgaggtcgaagccacggacatagtagtcgatagtgccgctcatgaaggcgacgccgccggcggtgaccagcggcccgcccagatcgggcacgcccatttcgaagggcagcggcaccggggcgcggtcgcggaccgtgccgttcagatgcatccaggctatgtcaccggtgcgcagatccgccgcggcgacatagccccagggcggtgcctggcagggcaggccgagcacgggcgacagcatcgggccgatatcgaccgcgaagggcgcgccgaaattctcgttgagccccggctcgccatccgagacataggtccggtcgtcatccgtgcgccggatcagccggatgacgaaggcgagataagagggcgtggccaccaccacctgccgttccggatcgaccgcgacgccgccccagttgaacacgccgaaattccccggatagaccagcgtgccccgttccgaaggcggggtataggcaccccgatagtccaggctgcgatagcggatccggcaggcgagctgatcgaacatggtggcgccccacatatcggcctcggccagcggcggcggccggaacgacagggcggaggcgggctgggtgggggcggcgtaatcaccctctgccgccccttgagcggcgggttcttcggtgaccggcaggatcggttcgccggtgcgacggtcgagcacgaaaatgtcgccctgtttggtgggctgaaccagcgccggaacgggaccattgggcatatcgagatccaccagtgtcggctgggccggcacgtcgcggtcccagagatcgtgatgcacggtctggaacacccagcgcacccggccgctcgccagatccagcgccgtcaccgatgacgaaaaccgctcggcagcctcggagcgccggccgccccactggtcgggcggctggttgccgatcggcagatagaccagccccagcgcttcatcgaccgaggcgaccgaccagacattgggggaattggcggtatagctggcgccctttgcgagcggttcggtcgcctcgggattgccggtgtcgaaattccacaccagcgcgccggtctcgacgtcataggccctgaccacgcccgagggctcggtcaccgagacattgtcgttcacggcaccgcccacgatcagcagattgcgggtcaccaccggcggcgaggtcgaataatagaagcccggctcgacattgggcatgccgcgccagaggtcgatctggccgttgtcgccgaaatccgtgcagacccggccggtggcggcatcgagcgcgatcagccgggcatcggccgtcggcatgaagatccgccgcgcgcagggcgtcgcgggatccgcgccctcgcgggcgtgatacgacacgccccggcaggtgaggtgctggcggttgatgttgtcgggaacctcggggtcgaagcgccagcgctcccggccggtgccggcatccagcgcgatgacgtaattatgcggcgtgcacagatagagggtgtcgtcgatcttgagcggcgtgacctgataggtggtctcgaccggatcggtcggccggcgcatgtcgccggtgtgataagtccacgcgaccttcagccggtcgacattgcggggggtgatgtcgccgagcgggctgtagcgctgccccgccgcggtgcggccataggcgtgccaatcgcccgccggaacgcccccgcctgccggcatcccgccctcgtcgggcgtcagctccgccacccgctccatagacagcctgcccgaaatgccgtgagagggggtggccatcgcgatcccggccaccaccaccgccagcaccagcgatgccgccagcggcaggccgccgggggcaaggctgcgcgtgcccagccgccgggtgatccagggcatccagagccagaggcccagcagcacgatcacatcgccgcgcggcgccagctgccaccagtcgaagcccacctcgatcagcgcccagaccagcgtgccggccacgatcgccgcatagacatgcagcgcggcagcccgccgccggtgcagcagccaggcggtgaccaggaaacccagcccggccagcagataataccacgacccgcccatggccccgagccagccgccggcgccgatcagccccagcgcgatcagcaggaacaggatcgcggtggcggtgatcagccaggaccgcgtgcgtgtttcaggcgtcggctcggccatgggatcccctccgcgtcgaactgccggcgaagggtcaacgcgggcagggggcgaaggttccatgtcatgggccgtcgtggggatgcgcacatcccgatctgccaccgcccgatcccggtccaggccagaaccagcctgagcagtgtttctccgccccggatctgccgcggccgctcgtcatggatccggacggatggcagggggcaggtcagcgcctgtgcgtgaaggcggcggggcaaaagaagcgaaggctcccgttgctggggagcggtttcgggccgcgcccgcaaggatgcgactcttgtcgacgacagcctcaatctgagactgcccgcttcaatccacgcacccgcaagggtgcgactcgcctacgccgagttgccggatcccatcgccgggtttcaatccacgcacccgcaagggtgcgacctgatcttccaccgacacccccatccagacgttcggtttcaatccacgcacccgcaagggtgcgaccctatatcggcagcgatgccgacaaggaggccaagtttcaatccacgcacccgcaagggtgcgacgcggggagggggctacctccacctggggtcacgcgtttcaatccacgcacccgcaagggtgcgacggcgtaaatctctattcggcatctgaagtctctgtttcaatccacgcacccgcaagggtgcgactggagatagcccggggacagcgcctcttgcaggttgtttcaatccacgcacccgcaagggtgcgaccactcctcagccgaatagtatcccccgcccggagggtttcaatccacgcccccgcaagggtgcgaccgtcatggacggctaccgcgatgagacattgcggtttcaatccacgcacccgcaagggtgcgacgccgataatctggccgcccgaactgcgcgcctggtttcaatccacgcacccgcaagggtgcgacctcgctcatttcggctccctttcgacggcgtcggtttcaatccacgcacccgcaagggtgcgacaattcgatctgaccgcggaggtgcgcgatcagatcgtttcaatccacgcacccgcaagggtgcgacggcaggtcgccttggccaccagacttgatatcgctgtttcaatccacgcacccgcaagggtgcgactcttgtcgacgacggcctcgatctgggaagtgctgtttcaatccacgcacccgcaagggtgcgactatcacgccgccctgggggcggtactggaaaccgtttcaatccacgcacccgcaagggtgcgactcaccccctcttaatagcctgaatccgcagccggaaaaaggcgatctgcgcgaacctccgctggagaccatctaatagtatgaacatgaataaagggtaaaatttaagtctttgaaaagagagagatattttctccgcgaacctcccgggatttttacgggagattggggttcgcgggcgaggcggggcgggtcctcgggcggtatatcgtcggtccggcgtgagggctgacggttgcctttcgcgaggatgacggtatgcattctggacggagatcggcaggtatggaacccgacatgggcttcagacaccggcctgtgtgttgcgggatggcggatccgcctgccccacaccccttgccccgcgccgtcctctcccttaatttccaaaggacggcttggaataacgctttggcatgatcccgaaagggcgaggacgcgggtgaccgaccccttgagagacccttccctgagacaggcaacgggtacggccgaccggctgctgaccctgatcaagaccgggggaccggaaaccgccgcggtgctgggtcgtgcgctgggcaccacgggggagaatgcccgtcagcagctggtcaagctggcggccgaggggctggtggaggcgcgggcggagatccgcggcgtcggccgcccggcccagatctggcacctgaccgatcgcggccaggctaggtttcccgatgcccatgccgagctgaccgtcgccctgatccgccatgtccgcgatcttctgggcgaagaggcgctcgaccggctgatcaccgcgcgcgaggccgaaacccgtgccgcctatgacgcggcgctggccggcgcgaccgatccggaggcgcgcctccaggcgctcgcccgccagcgcagcgccgaaggctatatggccgaggtgcagcccgcccccgacggcgacggctggctgctgatcgaaaaccactgcccgatctgcgccgccgccaccgcctgccagggcttctgccgcgccgaactcgccgtcttccgcgcggtgctggggcccggctgcacggtcacgcgcgaagaccatatcccggccggcgggcggcggtgcagttatcgggtgcgtgcggcgacgggcaccaaccggtgagctgccggagcgcgaacaacctggtggaaattctatctctctgataatattctagaaaagattcttggaggcggcgttgcataacctgttatgcaaatcagtgggagccgacggaaattgcccctttcacaggccgcttgacaatgggttggaaggaggggagtttgaggtcatgaccatttgctccggtcatggaaaccccgcaacccggcctccccgggttgtcggccgcttcagccctccggccatccgcgcgccgcgccgttgatgtccggcgctgtcgccgccaggacctccacaccctccccaccgtcatcccggcgaaggccgggatccaggttcgtccccccacaaagaccactgaatgccctggtccggcggtgatggccgacatggtggtccgcacgcccggttgcctgtccattctcgtggaagcctacctggatcccggccttcgccgggatgacggtagagggggtgtgcggtgggtggcgaggtttggatcggacatagaggccaggcttttgggggtggttttgcgggggcgtcccgggtcgcgggggtatgtgagccgcggccgactgcgaataacccagtggaattattatgctgttgattttattttggaaaaagaaatagtggaccgggacgcataaccgtttatgtaaatggcttgaacccgacggaaaccgtgcttttcggagggcccttgacaaaggcttggaaggaggggagtttgaaggcatgaccaatcgctccggtcatggaaaccacgcggcggagggagtgccaccgcaatagagtttgaaggcatgaccaatcgctccggtcatggaaactgcgccggtgtgggcgccggaggctgcgtgggtttgaaggcatgaccatttgctccggtcacggaaaccgcgcaacccggtctcccgggttgccggccagttcacccctctgaccatccgcgcaccgcgccgttgatgtccggcgctgccgctgccagtcccggcacaccctccccaccgtcatcgcggcgaaaggcaattttcagcgtccatgccggatggtggtgcgcagccggtcggccgtcgtgccagcctttaagcatgacgatccggatgttgaagtgggggcattgccggggaatgggtgcgcaaggcgatatgcgacgggtcatttcggcacgatgcccggtcggccgccgacacggggtcaggccgcctgtgtcatcgccgttcccatctcattccgtccgcggaacgccggtcagtcttcgctgctcatgcgcccgcagaagccgctctcgaagatgattgaagaacccgggcggcagcacgccataatggaagcgcggcggcgtctgtcccggaacggggcgaagatccggtcccggccacagaaactcgttggtctctgagacaaggacccatgaccgggcctcatccaggcccagatgtgccttcacggccagcgggatctccaccgcgtcggcggaatcacgcggtggtgtgtgcgtgaccggcagaacggtcacgaccatgcgccccgcgatgatctggcgagcagcgacaatggcacaggggcggtttttccggccctcttccatacccttggcatgctcttctgcccagagatagctgtagccggggaagtgtcacggctgccagccgtcaagcagtctgtcgagttccgcgtattccgcggggacgctgctgtcggcaatggccttcaaggtggtggcgtccagatcctcgacgccgcgcgcgacgcggcctttcatcatcagctcgaaaaaggcggctgagaccagcacggcctgtgtgcggccgtctctggtaatggccacaggttcaagctgtgcggcatcctgataatgtccgacattctgctggaattcggtcgtggtgatcttcatcgcaacactcctcgaacgtctatcatagacacatcggaggcgcgggcaaagccgttggatcatgggggttgacgaggcctgccccgctcagaacaccgtgttctcggccgtgaacttggtcaccagccagccctccatcgcctcgctgccgccttccgagccgtggccggacgccttgatgccgccgaaggggacttccgggaagccgagcggggcctggttgatcgagaccatgccgctttcgagatcggccgagaccgccgcggccgtgcgggcgctgccggtccaggcataggcggcgaggccccagggcaggcggttggcttcggcgatgaccgcgtcgtaatcgcggaaggtggcgatgggggcgatcgggccgaagggttcctcgttcatgatccgggcagtgcggggcacgtcggtcaggacggtgggttggaagaaacagccctgattgccgatgcgggcgccgccggtgcggaggtcagcgcccgcggcctgagcatcggccaccagcgcctccatggcctccacccggcgcatattggccagcggccccatgcccacgccgtcatccaggccgttgccgacccggatcgcggcggcggcgcgggtgaaggcggcggtgaagggctctgcaatgtcttcatgcaccaggaaacgggtgggcgagatgcagacctggccggcattgcggaatttctgcgccgccagcgccgccgcggccctggccggatcggcatcggcgaagacgatcgccggggcatggccgcccagctccatggtggcgcgcttcatgtgccgcccggccagcgccgccagctcctgccccacggcggtggagccggtgaacgagatcttggcgatcaccggatgggggatcagataggccgaaatctcggcaggcacgccgaagaccaggttgatcacccccgccggcaccccggcatcggcgaaggcggcgatcagcgcggcacagctggccggggtttcttccggccccttgacgatgatggtgcagccggcggcgagggccgccgccaccttgcggaccacctgattgatcgggaagttccagggcgtgaaggccgcggccgggccgaccggctcgcgggtgacgatctggacatggccgggggtgcgcgacgggatcacccggccatagctgcggcgcgcctcttcggcgaaccagtcgatggtatcggccgagcccatcgcctcggcgcgggcttcggccagcggcttgccctgttccagggtgaggatgggggcgatggcggccgcacgctcgcgcatcagcccggcagccttgcgcatcagcttcgcccggtcgaaggccggcacccgccgccagctgcggaaggcgcggtccgcggccgcgagcgcccggtcgagatcggcggtcgaggcatgggcgacccggccgatgacggtgccggtggccgggttcagaaccgcctcgtcgcggccggtgctgccggcggtccagccgccgtcgatgaacaggcgggtgtcggggtaggagagggcggcgggacaggagagggcggcggacagtgggggggggcgtcctcggtcttgagacgtgaaagatcaggcgctggcctggcggtcatcggcgggcgcggtctcttcatggcgccagcgcagccgcaccccgcccgagggcgtggggtcgagggtcgggatcgcctggagcaggcgcttcgtataggggtcggccggggcgtcgaagatccggtcgcgcgggccttcttcgacgatccggccctggttcatcaccaccacccggttggccagctgttcgaccaccgccagatcatggctgatgaacaggcaggcgaagccgtggcggcgctgcagatcggcgaagaggtcgaggatctgggcgcgcacggtggtatccagcgccgagaccggctcgtcggcgatcaccagccgcggccggcggatgacggcgcgggcgatggcgatgcgctggcgctggccgcccgacagttcatgggggtagcggccggcatgggtgtcgtcgagccccacctcggccagaacctccagcacccgggcgcggatggcggcccggtccagccccgatccgcgcagcgcctcgccgatcgcctgagcgacggtcatccgcggatcgagcgaggaataggggtcctgaaacaccatctggcagttgcggcgataggcggtccaggccgggcccgagcgatcggtcaccggctcgccgtcgaagatcagccggccgccgccgggcttctgcaggctggcgagcacccggccgagggtggtcttgcccgagcccgagccgccgaccaccgccaccacctcgcgcgggcggatggcgaggtcgatgccgtgcagcgcacgcttctgcgcaccccgccggaagagcccgccgcggccgccgaaatcgaccgtcagcccctgcacctccaccagcggcggggcatccgccgccacctcgggcaccggccggcggcggggcatggcgcccagcagtttgcgggtatagggatgggcgggcgcgcgcaggatctggtcggtcggcccctgttcgacgatctcgccccggcacatcacgatgacgcggtgggaatagcgcgcgaccatggcgagatcgtggctgatcatcagcacggcggtgtcgttttcggcggtcagcgccaccatcagttccagcacgtcgcgttgcaccacggcatcgagcgccgtggtcggctcgtcggcgaccagcagggccggtttgggcagcatcaccgaggcgagcatgatccgctggcgcatgccgcccgagaattcatgcggccaggccttgagcacccgttcgggatcgctcaaccccacccgggtcagcatggcgaggatggcggcgcggcggccttgggcatcgagcccggtgtgcagcgccagcgcctcttccagctggcggccgatggtcagcgaggggttgagcgaggtcatcggttcctgaaagaccatgccgatccgcccgccgcgcagcgcccgcagttcgcgcggggtcatgtcttcaagcggccggccgtcgatccggatgctgccgccgcggcggcggatggcgggcggcgtcagccccagcacggcgcgggcggcgagcgtcttgccgctgccgctttcgccgaccacggcgacgatctcgcccgcccggacctgaaaccccacccggtcgaccaccagccggccggtctcgccgatgccgagcgagagatccgagacgtcgagcagcggcgcgccggcggtcatgcatccggtcatgcaatattcctcatccgcggatccaggcggtcgcgcagcgcgtcgccgagcaggttgatgccgagcagggtcagggagatgcagagccccgggaagatgccgagccagggggcctggcccatgaaggcgcgcccgcccgagagcatgttgccccagctgggcgcgggcggcggcgcgccgaggcccaggaaggagagcgcgctttccgagagcagcacccagccgaacatcgaggtcgcgagcaccgtcagcggcgccacgcaattgggcaggatgtggcggagcatggtgtagatctggccatggcccatcacgcgcgaggcttcgatgaaggcgttttcgcgcagcgacagcaccgtgccgcgcatcacccgggcgaccgagggcgtataggcaaggcccagcgccagcacgatgccgccggggctcgcccccagcaccaccagcaggccgagcgccagcagaatgccggggaaggcgagcagggcatcgttgaaggtcatcacgatccggtcggtccagccgcggaaatagccggccaggatgccgatgatgctgcccgcgatgatggcgaagaccacggtggtgagcgcgatggtcatgctggaggaggcaccggccatcagccggctgagtacgtcgcggccgaattcgtcggtgccgagcagatgggcgccgcccggggcggcgagacgggcgcgcaggttcagggccagcggatcctgcggcgtccagaccgcggcaagccccgccaccaggaccatgacaccgaccagcactgcgcctgaaaggccgcgcagggatctgaagatcatcatcatccgggcctcttcagttcagggtcacgcgcggatcgaagaccgggtagcagaggtcgacgatcaggttgacgatcacataggcgccggcgatgaacagcaggcagccctgaatgaccgggtagtcgcgggcgaagatgccgtcgaccagcagccggccgagaccggggatggtgaagacggtttcaaccaccgcgatgccacccagaagattgcccaggatcaggccgatcagcgtccaggtgggggcgaaggcgttgcggaagccatggcgccacagcaccactggttccgacagccctttggcgcgggcatgggtgatgtagtccagccgctgcacctccagcatgctggcgcgggccatgcggatgatcaccccggtctcgtgcaggaacagggtcagcaccggcaaggtgaggtagagcagcccggcctggaaatcctcggcgagcgagacatagccgatcaccggcagccagccgagttccaggccgaagagcagcagcagcagcaggccgagccagaaggtcgggatcgacagcagcagggtcgccaccgcgatgaaaccgaggtcgagcgcactgtcctggcgccaggcggcgatcatgcccgccggcacggcggcgagcgtcgccagcgccacggcgatcgccacgatggtggcgctgatcccgaaccggtccaggatcagcggcagcaccggcagatcggtggtgatggagcggccgaaatcgccggtcaggatctggcccagccagagcacgaactggaccggcagcggcttgtcgaggccaagctcgcggtgcagggcggcgaccgtttcaggcgtcgccatgtcgcccagcatcagcgaggccggatcgcccgggatcagccggatcaggaaaaacaccgccgccgccacgatcagcagcgtgggcacgcccatggcgatgcgtgagaagatgaagcgtcccatgggccggctccgcgctctgaggaagggtcccgctgtgatgatcaggggccgctcaggcggcggccgccaccgggtcgccggtcagggtgtagcgggtgaagccctgctgcagcgccggcagaggggccacctccatcacgccggccgccgggtccatcaccaccatggcgacggtggccgacagattgccggcctggttgggccggggcgggcggcagacggcatagggtgtgccgaaatcgtcgaagaaggcgcgcttcatgtcgtcgatgccgatctgcggcccggcctcttcaagcagccgcttcacccgccagtcgcgatacaggctgtcgggcatgttggcgatgccggtgtcgcgcagcttcgtgcgggcgatcgggctgatccagtgattggcgtggacgatgatctcgttctcgggcagcacggcgaaagcctcgtcgggcgcgcattcgaaatcgaccgcgaagccctgggcggtgctgatcatgatgttgttggagcaggatttgggcgtggtcgccaccgcccggatcgcctcggcgaaatggctctgttccagcaccttgcggcggatcagcgacagcggcacgccggcggtgcggaaatcgcgctcgcattccagataattggcggtgatggcgatgccggcttcattcaggcccgatcgggcgaggccgccggcctcgacgaaggtcagcagatccgggccgtcattgcgctctacgcgcagcaccacgccggtttcggcgcattccgaccgccagtcccagttctggccgtggatcagccggccggtccggctgcgcccgggcaggatgatcgccccggtgcagccgtcttcgggttcggaaggcgcgtcgtcggcggcgggcggcgctgcggtcagccggcgggcctgggccaccacctcggtgcgggcgttgatcatcaccacgtcttcgaacgaggtgcctgatccttctgcgatgccgcggatctcatccaggtaatgggcgccgaacgcccggatgcgctcggcgaaatcggcgatcagccggcggcggaaatcggcatcggctcccagcccgtccagcgcccggccatagatctcggcactccgcgcgatccggtcgggcacggccgcgccataggcgcagccgcggtcatagggcgtgcccgcgacggacacgaaggggaagggggaacggggtggctgtggtcatggggcgcgggtctcgtctggcagaaccgggagagtcggggggagagggacgggtgcggtggcgttacgccacctcccccagcgccgtgcggatggtatcgaccacctggcccatctgatcgggggtgatgatcagcggcggcgacagcaccagattgtcgcccgccacccggaccagaacgccgtcgtcgaagcagcggttgaccgtctcacccgcacgcgcgcccggggcaccgtcgcggctctccagctcgatcgccgccagcaggccgatattgcggatgtcgcgcacctggggcgcacccttcaactggtggacggcctcttcccaggcggcgcagatctccgggccgcggtcgaacagaccctcctgctcgtaggtctcgatggtggcgaggccggcggcgcaggccagcggatggccggaataggtgtagccgtgcatcagctccacggcggcttccggcccggtcatgaaggcgtcgtagacggcggtggaggcgatcaccccgcccatcggcacggcgccgttggtcatgcccttggcgcaggtgatcatgtcgggcgtaacgcccagggcattggaggcgaagggcgcgcccagccggccgaaaccggtgatcacctcgtcgaagatcagcagaatgccgtggcgggtgcagatctcgcgcagccgctccagatagccgaccggcggcggcagcaccccgcccgatccggtcaccggctccacgatcacggcggcgatggtcgaggcgtcgtggatctggacgatgttttcaagctcgtcggccagatgcgcaccccaggccggctgcccgcgcgagaaggcgttgtgcgccagatcatgggtatggggcaggtggtcgacatcgcccagaagcggaccgaaatcgcggcggtggcgcgggatgccggcaaccgacagcccgccgaagcccatgccgtgataggccttggcacgaccgatcagcttcacccggttcgcatcgccgcgcaccttgtgatacgcccgcgcgatcttgagcgcagtatcgaccgcttccgagccggaattggtgaagaacacccggtcgagcccggcgggggcgaggttcgcgatccgctccgccagcacgaaagcggccggatggctcatctgaaaggacgagacatagtccatccgcgccgcctggtcctggatcgcccgcacgatccgcggctgattatggccggcattcacgcaccacaggcccgccatggcatccagaacctgccggccgtcggcggtggtgtagtacatgccgtcggccgcgacgaacaggcgcggatcggccttgaacgcccggttggccgaaaacggcatccaatagggggcaaggtcgttgggcgcagaccgggcatcgggggcaaatccggcatcgggcgcgccggccaagtcgggggcaggggactggacggtcatgccgcatcactccgcatcggtggggatgacggaactatgatgctacaaaaaacaaaatgcaagaggtcgatgcccgcggtcagtccatcggtgtcggccgggtcaggccggcggcctgttccaggtggcggcggatcagggcggcggcgatttcgcgctggtccatttccaggcggtccaggatctccagatgctcgcggcacgagaccttgacccgctccagcccgtagacccagtcgtagttggaaaagcggcggatgcggctctgctggcggagcgcgttcaggatgaagcggttgcccgaggccatggccaggccctcgtggaaggcagcgttcatctcgaacagcgtgatcgacgaggtctcgccccagggggccgccaggaaggcctgatggcggcggcgcatgtcgtccacccaggcgggatcgagatgaaagttctgtgccatcacgctggcgggttcgatcagcaggcggaattcatagctttcccgccgggcggcatcgtccaggatcggcaggaaggcccagccatggccgggcttgcgttcggccatgccgatttccgacagctgtgccagcaccctgagcagcagcggccggctgacgccgtagcggcgcatcagatcggcttccgagacctccgccggcaggcggttgcgttggcgatcccccgccaggcggatgcagagctggtcgacctctccgggcgggtgcgcctctccggccggggcgtcgggcacggcgcgcaggctgtagccgcgccggggctggtggtcaagcacaccctggcgtgccaactcctccatcaccgcccggaccggcgtgcgcgagacctgaagatgctgggcaagggcgagctcggtcacccggtcaccgggggcgaggccgttgctgcgcagataatccagcacccgtggcagcagatcgcgttgcagccggcttggcccctctgaatcgacaacaggctcttgcgttccgttttcttgtctcatagcatctcaaaatacaaacagggacacaaagcgggccgggcagaccgcgcccctcacccctctcgaagaaggccggagacatcatgtccgacgggactgccgccagctttgccgaaggatcggcaccggatcaagcatcctcgacgccgcttcacatgctcgacgccgcggcccaggcccggctggtgcgcgagggcggggcgacggccacccgtctggtcgaggcgtcgctggcgcggatcgatgcggtgaaccccgccgtcaacgccatcgtccggcggatggacgacgaggcgctggccgccgccgcggctgccgaccgcgcggttgccgaggggcagccgatcgggccgctgcatggcgtgccggtcacgatcaagatcaacatcgaccagcagggccaccccaccgacaacggcacggcggtgtaccgcgacctgatcgcacccgccgacaacccggtggttgcgaacctgaagcgggccggcgcgatcgtggtcgggcggaccaacgcgccggtctattcgatgcgctggttcaccgacaacacgctgcacggccccacctacaacccttggcatcgtgatctgacggttggaggttcttccggtggtgcggcggcctcggtcgcgaccggtatggtggcgatcgcccatggcaacgacatcggcggatcggtgcggtttccggcgatgtgcaacgggctggtcggcctgcgcccctcttacggccgggtgccgtcgttcaatgccacggccaaggggggaggttcggtcgcggcccagctgatggccgtgcaggggccgctggcccgcaccgtgcgcgacacggaaaccgccttccgggcgatggccgtgccgcatgtcgatgatccgcggacaagacccatggtcgcggatcatccggctgtgccgcggcgggcggccgtggtctccaccgcgggctggccggattgtcatccggccgtgcggggcgcggtggaccgggcggccacggccctcgccgcggccggctgggcggtggaggaggtggtgccgcccgcgctcgacgagatccacgacatgtgggccgagatctgcattcccgacatcatgaccctgcttgcccccgcaattgcagtggcgggcgacgagaacatccgcgtcgcggtcgactattggcagcgggcctggccgcgggagctgaccccgggcgatgcgctggccgcggtggcgcggcgccatggcatgctgcggctctggcaacggtttttcgaggcctggccggtgctggtgatgccggtgtcgctggagccggccttccaccgcctggcggatgtccgctcgcccgaggatgcgaagcggatcatgcgggcgcaggggccgctgatggtgatttcggtgctgggcctgcccgggctgtcggtgccgaccgggcttgccggtttcaacgtcgagggccatgacgtcaccatgcccaccggcgtgcagctggtggcggcgcctgaacgcgaggatctgtgcttcgcggccggccgtgacgtcgaggcggccatgccacggctgggggtcgtggatccccggcccggcttttgacggaggcgttccccatgcgcagcacccccggccatggcgagatcctgagctattacgatttcggccgcaccaccgtgcaggtctgcgccgccgatccgcgcttttcgtattgcgcctatgtgccggaaagctatgacgaggcgggcgaccggcgctatcggctgctggtggtggtgcacggcacaatgcgcgacaacgctgcctgtcgcgatgccttcatcgatctggcggaggcgcagcaactgatcgtgctggcgccgctgtttccggccggcatcaccgccccgcgggagctttcgagctataagcgcctgcgcggtcccggagacaccggccccgcctacgacctgatcctgctgcagatgatccgcgagatgcaggcgctctaccggatcgatgccgaacgcttcgccctgttcggcttttcgggcggcgggcatttcgcccatcgcttcctctatgcccatcccgagcggctggcggcggtgtcgatcggcgcgcccggcatcgtgaccctgctggacgatcaggccgactggccggcgggggtgcgcgatgtcgacgcgatcttcggcagaccgatcgacctcgcggccatgcggcgcgtggccgtgcagatggtggtgggcgcggaagatacagccacatgggagatcgcgatcacgcgcgacaacccctggtggcagcccgccttcgagagccacggtgccacccgcatcgagcggctggtggccctgaaggcgagtttcgagagctgcggcatcccggtcacccacgacctggtgcccgagacggcccacaggcaggagcccctgctgccggtggtgaagcggttcctgtcggagcggttcgcgcagggagagcgcgacgccggatcctgacagggaaaacgggagcagaggacggccgcaggcgaccggcaaagagtcgcatcggccatgagagcagaggcccgctcgacggggccccaagatgctcgtcagacaaaaaagccgatctgatagggaactaaggtcatgagatcattcgccctgaaggggcttcgcggcggtgcgctcgccgggtcggccgcgctcgccgccctgctggccgcggcgccggcgggggctgcggacggcccgaagcgcggcggcacgctggtggtgtcgatgaacgccgatgcccgcagcctggagcccggcatcaatcgcgacgccaattccgattccgtggtgaacaacatcttcgaagggctggtcggctatcgcaccgatctgaccgtggggccggcgctggcccagagctggacgatgtccgaggatggccgcagctataccttcacgctgcgcgacggcgtcaccttccacaatggcgacccgctgacggccgaggcggtgaaatggaactgggaccgcaaatccggtcaggagggctggctctgcgcccgcttcttcaacggccaggccggcgggctgaaggtggaggcggtggaggcccccgacccgaagacggtggttttccgcctggcggaaccctcgggcctgttcctgacccagctggccaatatccagtgcggcatgctggtggcgagcccgaagagcgcaggcgccgacgggacctggacgccgatcggcaccggcccgttcaaattcggcagctggaagcatggcgatcagatggtgctggagcgctatgacggctatgttccgtcatccgaaccgggcagcggctatgccggggcgcggcaggtgtatgtggacgcgctgcgctatcagatcatccccgatgccgatgcggcggcggcggcgcttaagaccggggcgatcgacatcatcccccagctcgacacgatcaagatcgacgagttgaaggcggcgggcatgaaggtgatggcggcgccgggcctcagctggtcggccctgctgatccagaccgaggatccgctgctctccaaccccaaactccgtcgcgcgctggcccaggcgatcgacatcgcccagatcaccgaggtgcgcaccaacggcctggccaagcccaacccctcgggcgttgccgagagcatgcgcgccttttcggccgatttcctcgactggccgaaatacgacccggccgccgccgcgacgctggcgaaagaggcgggttacaagggcgagccgatcaggcttcagaccaaccggcgctatgtcggcatgtacgacaatgcggtgatgatccaggcgatgctgtccgctgccggcttcaacgtccagctcgaagtcctggactgggccgcccagctcgacaactacgtcaacggccgcttccagctgtcgtcgttcagctattccggacgattcgacccagggttgatgtatgccgccttgatcgccgataaggcgacggcaaaatgggcccagtggggcgacccggaagcccgcaagctgctggccgagagcggcacactgaccgaccagaccgcccgcgccgccatcttccgccgcctgcacgcgaagatgaaggaagaggtgccgatcatcggcctctactattccccgaccatcgagggcgtgaacccggccctgcacgactacaaaccctgggcggcggcgatcccgctggcctggggggtgtggaaggggtgacgggggtagatttggggacagcatgagatgagagatgccgccctgggggaccggggcggtgttttccttttggcggctgcgcacaccatcgaacgtgtcaggttatggtctgatactcgtgccctggcgtgcggccggcactcatgtcagggtctgcactgacaagcctctgtataccgtcatccccgcgaaaggcgggatccacctttctttccgcgtgaagattgcctgacctcgaaccgaaacgccggggcgtctctataggatctttccaccgcccgtaccgcctgagagcctgcgccgtttcgcccgcgaaccccaagctcccgtaaaaatcccgggaggttcgcggaaaaaaattctcccgatgtttcaatcggttaaatttttcaatttctgcatgttcatgcttttgcgtgagttccggcggaggttcgcgcggatcgcctttttcgatcgtgtcccaaggattggtgtaacagcgcagtcgccgcttgatctccggcaaggttgtccgggatagtcaggctgccgcgacgggcggcaggctggtcagcggatcatcgcccaagggggcgacggattccagggtcatatagcgggatcgctggacggcccattcgtcgttctgttccagcaggatggcgccgatcagtcgggtgatggcggccacgttggggaagatgccgacgacctcggtgcggcgcttgatttcgccgttgaggcgctcgatgggattggtcgagtgcagcttggcgcgatgcgcggcggggaagtccatgtatgcgaggacgtcggtttcggcgtcgtccatcaagtccgccagtttccgggctctggggcgcagttggtcggccacctggcgccattgcgcacgggcggcccgggcggtgtcctgggcgaaggcggtgccgatgaaggccgagacgacggtttgcccgcatgggccagcacgttgcgcatgaaatggacgcggcagcgctgccaggtggcattcatcaccttggcaatggccgctttcaacccttcgtgggcgtcggagaccaccagcctgacgccgcgcaggccccgccgcgccagcttgcgcaggaaatcggtccagaaggtctcggcctcgctggggccgatggcgatgcccaggacttcacgtcgcccggcggtgttggcaccgaccgcgatgatcaccgccacgctgacgatgcggccgtcctggcgcaccttgacgtaggtggcgtccagccagacatagggccagtcgccctccagcgggcggtcgaggaaggttgcgatcttgccgtcgatttcggcgcacaggcgactgacctggcttttcgagatgccggtcatgcccatggccttgaccagatcgtcgaccgaccgtgtcgagatgccctggacataggcctcctggatgacggcggtcagcgccttttccgccatccggcggggctccaggaagcacggcagatagctgcccttgcgcaggcgtgggatgcgcaacgccaccgtccccgcccgggtctcccagtcgcgctcgcggtagccgttgcggtggacaaggcgctgatcgggcttgcgctcgccatgcccggcgccggtcagcgtcgccacctccaactccatcagccgctcggcggcaaaaccgatcatctcgcgcagcagatcggcatctgcgctcttttccagcaggccacgaaggctcatcatctcatcggtcatcgtcttgatccttggttcggttgggggttgcaaccaaaccctaccgaagatcgacgatgaccaccccgatttcggggggcgcctggggatgatgcctccgggcgcgccgcgccctgcgccatcatccccaggcaaacgctgttacaccactcggcgggacgtcaccggccggcgcccggagtcgagaaatccacgcctgaatgtgtcctgaaattcggatcttcgacggcgagcaggatagccagatgggttgtccccaaggcgttgcccccgcggccttgagcaatcagcgcgtcggcacgagcacgcaaccccccggcacccgatcgcgcatcccagtatcccctggcgccataccccacgagtccgatcatcaaaagagcaatcagacccccgatatatctcaatatccgcatcattctgtcttcttatcctcagattcttgcatcgagaacttccttaatatgcgcatggccttaatatgcgcatggctgtgatctggatgtgataaagcgatggtcggaatatttatgggatattgaaccacgccctattacgccgaccggcacgcgcctctgacccggatcccggccgggcggatcattcatcggtcgctcgacgatgccgcggcagccccggccgggcttgccccctatcccagcctgggagatgcaggatgaagcacgtccttccaattgccggcctggccgtcctggcattggcggcgccacctgcatccgtccaggccgaggattacgacatcgactgtgccgtgatcctgtgcatggccggcggcttcccggcgagcacgccctgttctgcggctcatggctacatgatgaagcggctgaagaagggcaaaccgcccttcggcacctgtgcgatgtcagatggcaaggccttcaccgattacgacctcgacatgggcatccactattattgcgaggccgggctggtgatgcgctggccggatgaccgcgacaactggagtggcaaccggcccggctgctacatcgaagaggtggtcggccgggatgatgagcggcgctacacctgtgtccgggcggcggccggcgggccgtatatggagatcacgatcagcccggggagcgctgaggcgtacaggtcggggaagctgtattattaaggggttagatcatgatgggcgacggattgttgatgttcggttccgtttatccatccaattccatccattttcatccgagtcagggggcgtagctggcctgtctggtgatgcgctggccggatgagtgcggcgccctctgttcggcggccggttggcgtgggcactgcgttgaaatacataaaaaccatatatacgcaaaaacattaatgtatatatggagaatgggatgtgtcccggaatatcgtcgcgctgcaccgaccgggcgctcttctgcacgaagcctgtcgctgatcgcctgaagcagcgggcaggccaaacgggctgctcacgggaacagcactttttccagcgcctcggccaattcgcgccgcttgtcggcggacagctttttgagattgcgctgtttccataagacggcgggcaggttctgcgcgccaacgatgccgggcaaggtccagtccggctcgccgcgcttgaagctggtaaggaagcgccggtgatcttctggcatggcggccaccatctcggcgatgatcgcctcccgcgcggtctccaggtccgcaagcgggacaggttcctgtgtcatgccatcaaagccccgcgcgaactccttgtgcagcggcttgcgggtcggggccagaacttcagccatcggacggttgtggctgatgacataaaccagaaaggcgcgacgcaactcgtcaccgacgccctcgttctccagcaggccgcgcacatcaaagaggtcgcgcgggtgctggcggtcaaaggctgccacgatcttgcccgcgtagagatcggcgaaggacacgacttgcatttcggcgaagccgaaggtgtcctcgacagcgggaaccacgctcatgacgacaggatcatagaccgcaccgcggagcacgggggttacctcgatcttgatctgcacgccgggcgtccgaacgatcagcttggtgatgatatcctcatcggcagaacgcgaagcattgacgctcgcggtggggataccccgctcgatccgttcttttatcccctgcatggcggcgttgattgccgcaagcgatgtggcccggtcttggatcggcagataagtcaggtcaatgtctacggagaggcgcggcatgtcgcgcacgaacagattgatcgcggtgccgcctttgagcgcgaaagcccgctctttcgcgacgaaaggaaggacgcgaataagcagggcgacctgctggcggtatgtgtcgaggaaggccatggaattcacacgcctccaaggtcggatggcacggtgatgttgtagcgcggatcgagtttgccgcctttgacgagggcgcgtttgcccgaacccagatcgatgtaggacatgtcgagccggaatcgccacgcatggcggtggcggtcggcgaagaaaagaaaaagccgcttcaccttcacgctggcgcaagcctccagcagggtttgcaagcggcgcgggcttaagtcgctcatcccttccatcaaggcatcggcctgatgaaagctttcatggtcgggcagctcgtcgagcaattcgagaacggcgcgctccttgctggaatatcggataggtaaggtcagaccgccgacgccgaccatgacggggcttggctcggatggcgcgtcgacatcatcgggaaacaaccgcaggctgttgtgccagcgaaaggttatatcgagtggcaggctcgccagccaggtcggcggacgcttcggtccgtaaagatgaacctcgtgcatggctgtcgaaaggtaatgggcatagccttgctgttcgagcgcggtgcgtccgccgaccgtcaacggaagctccagcaccgtctggagagaaacgatcacctgctgccaggtgagcggcgtgcgcgagcggcgatagacgcgccgcgccgggctattgagccagcccgcgcgaacatactggctgcgcagcgccgacgagtagccgtgcgcctccatccaggcggcatcagccaggagaccctcggggagttcctgctgaagccggtttagttttttgccagaatgcatatccatacttagcgttttataatatttttaaaccgatgtcgcgttcgaatttgccaagattcgctaagtcatgctttgtattttggggaatatataaaccgtggggagtgaatcgcgccgggtttgccggaggctccaactcttgagagggtggagccatgaccagcaggacgacgaacaagtttgcccccgaagtgcgtagccgcgcggtccggatggttctcgagcacgagagcgatcacgcctcccgctgggccgccatcgcctcgatcgccgccaagatcggctgcacaccggagacgctgcggctgtgggtgaagcgggccgagcgtgagggcggtaagatcgacggcgccgccccggacctgaacgcccgcctgaaggcacgcgagcgggagaaccgcgagctgcggcaggcgaacgagatcctgagatgggacttcaaggcgttgttcgtggtcgaccgatccggacgaccatctcggacaaggcaacgccatgcccgcatgacctcgtcaatcgacagttcagggcgccgggacccaaccggctccgggtctccgatttcacctatgtggcgacctgggtgggtttcgtctacgtcgccttcgtgatcgacgtgttcgcgcggcgtatcgtcggttggcgggcgagccgaaccgcgcatgcgagcttcgttctcgatgccctcgagcaagcccgccatgcgcgccggccggcacccggtggcggcctcgttcatcacagcgatcgaggcggccaatacctgtcgatccgcgacaccgaacgcctcgccgacgccggcgtggtaccctcggtgggcagtatcggggattcctacgccaacgccctcgccgagacgatcaacgggctgtacaaagccgaggtgatccatcggcgcggaccttggcggtccttggaagccgtcgagtatgcgaccctcgaatgggtcgactggttcaacaaccgccggctcctcgagccgatcggcaacatcccgccggccggggccgagcaacgctggtgggacgaacaggagcaggcggccatcgcagcctggctcaatgctccgagcctccgacgaatccggcgcggttcagagccctaccataaagctcgcaagaggccgcgcttttttgcattgggaggcggccacagccgcttgtcgagtgtcgattatcactctacattcgcgacgttaagctagcgcgaatcgacacagatgcacccagggacgatcatccggcaggattgccttgaaaggaacgggctgagcgtcaccgacgccgctcgcatccttggcgttgatcggcagaccctcagcaacctgttgaacgcccggtcaggcatttcgccggagatggccgttcggttggaaaaggcgttcggcacgcccgcccgcgaatggctgatccaacagcttgaccatgaactggccgaggtcatgcgtcgggccgatgaaattgtggtcgagccgttccagggcctcgccggcgaaaggcagggcgaagcatgaacgcggtcgagatcggggaggccgtcaccgagcttgtggaaaattctttcgacgcagcagagtttccgtatcaatttcttggctggccggtgttgtcggttgaagaataccaaagattgaagagtagcaaggacaagaatttgaccaagaacgatacgacccgtccaacgagaaccgaagagaactgagctgcatcgatggcaacgatcacgcccgaacgcgatcttgaggaggctttggtctcaaagctaaaggacctcaagtatgaatatcgtcctgatatcagagatcgtgctacactagagcgaaacttccgtgagaagttcgagaccctcaatcgcgtccgcctgaccgatgccgagttctcgcgcctcatggatgagatcgtcacgccggatgttttcacggcagcccgcaccctgcgcgagcgaaacagttttacccgcgatgacggcacgcccctaaactacacgctcgtcaacatcaaggactggtgcaagaattcctttgaggtggtcaaccagctccgcatcaacacagacaacagccaccatcgctacgacgttattctcctgatcaacggcgtgccggtcgttcagattgaactgaagacccttggcataagcccgcgtcgtgccatggagcagatcgtcgaatacaagaatgacaccgggaacggatataccaagacgatcctatgctttcttcagctcttcattgtcagcaaccgcgatcgcacgttttattttgcgaacaacaatgcacggcatttcgcctttaatgccgaggagcgctttctgccggtctacgagtttgccgatgtagacaacaaaaagattgtccatctcgatagcttcgccgacactttcctcgtcaaatgtaccctcggccagacgatcagccgctacatggtgctggtggcaagtgagcagaagctcctgatgatgcggccgtatcaggtctacgcggtgaaggcgattgtcgattccatcgcccaggactgcggcaacggttacatctggcacactacgggcagcggcaagacgctaacctccttcaaggcatcaacgctgctgaaggacaatcccgacatcgaaaaatgcctcttcgtcgtggaccgcaaggacctcgatcggcagacgcgcgaggagttcaataagttccaggaaggttgcgtcgaggaaaacaccaacaccgcctctctcgtccggcgccttctctctgatgactataccgacaaggtcatcgtctgcacgatccagaagcttggccttgcgctggacgaaaacagcaagcgtaacaagcagcagaaaaaagacggcaagaagagcttcaaggaacagcttgagccccttcgcgacaagcgtatcgcctttatcttcgacgaatgccatcgctcacagttcggcgagaatcataaggccatcaaggagttcttcccgcgggcgcagctcttcggcttcaccggaacgcccatctttgatcagaacgctgctcagcagaaaatcgaggacacccaggccagcatgaagacgacggaagacctcttccagaagcgtcttcacacctacacgatcacgcatgcgatcgaggacggaaacgtccttcgcttccacgtcgactattacaagccgcagggcaagaccgtgcccaagccgggcgaaccgctggccaagcgggcggtcatcgaggcgatcctgtccaagcacgatgcggccaccggtcagcgccggttcaacgccctgctcgccacgtcgtcgatcaatgacgccatcgaatatcacgcgctgttcaaaaccatgcaggccgagaagcaagctgccgatcccagcttccagccgctgaacatcgcctgcgtcttctctccgcctgccgagggcgatcctgacgtaaagcagattcaggaggacctgccgacggagaaggaagacaacgcggttgagccagagaaaaagaaggaggccctgaaagccatcctcgcggactacaacgccaactacggtacaaaccacaagatcggcgagttcgacctgtattatcaggacgtgcagaagcgcatcaaagaccagcaatggcccgaagctgacctacggaaagcctatcccgatgtgccgcaccacaagatcgacatcacgattgtcgtcgacatgttgctgaccggcttcgactccaagttcctgaacacgctctacgtcgacaagaacctcaagcatcacggcctgatccaggccttctcgcggaccaaccgcgtgctgaacgccaccaagccctatggcaacatcctcgacttccgccaacagcaggatgcggtcgatgccgctatcgcccttttctccggcgaggcggccgccgaaagggctcgcgaaatctggctggtcgacaaggcgcccgtggttatccagaagctggaaaccgccgtccagaagctcgacaccttcatgaagtcgcagggcctggactgcgcccccgacgccgtgcccaatctcaagggcgatgccgcccgcgcggccttcatcgagcatttcaaggaggtccagcggcttaagacccagctggatcaatacaccgacttgacccccgaaaacgccgcaacgatcgaacgcatcctgccgcgcgacaacctcgttggcttccgcggggcctatctggaaaccgcacagcgccttcgcgcccagcagggcaagggcgcggacaagccgacacaggaagccgaccagcttgatttcgagttcgtcctcttcgcctcggccgtgatcgactacgactacatcatgggcctgatcgcccgctattccgaggcgacccctggcaagcagaagatgagccgcgaggaactgatcggcctgatccagtccgacgccaagttcatggacgagcgtgaggatatcgcggcctatatcaacaccctaaaggcgggcgagggactcagcgaaaaggccatccgcgacggctacagccgcttcaaggcggaaaagaacgcggcggagctggcgagcatcgcggacaagcacggactagcgaccgaggcgctgcaaggctttgtcgacaccatcctgcaacgcatggtctttgatggcgagcggctcaccgacctgatggaaccccttggcctaaactggaaggcgcggcgggtcaaagagttggacctgatggccgacctggtgccggtgctgttgaagcgcgctggcgggcgcgagatttcagggctgagcgcttatgagcagtaaggggaaatcctctgccgagacgggcggtggggctatgcttgtgccgaagctgcggtttccggagttccggaatgccggagattggaaaccaaagcgcttgggcgcgcttttctcacagcgggaagagagtggaaggaccaatctgcgtctgctgtcgctgacggataaggatggcattatcccgcaagaagaaagcaaccgtaagaacacctctaacggagatttgagcagataccttcgcgttgtgcccggtgatattgcctacaatacaatgcgcatgtgggaggggagaaacgcgctctcacgaatagaagggattgtcagtccagcttatacagtctgcagacccaccaaagacgccaacagcgtcttcttttcctattacttcaagacgccgcaactgattgcccagttcgcgcgatattcgcagggtctcgtcaaggatacgctcaacttgaagtttgaggcgttctcccgcattcttgccgcgacgcctccgacgctccccgaacaacaaaagatcgccgactgcctgacttcgttggacgcgctgatcgaggcgcaggggcggaaggtggaggtgctgagggcccacaagaagggcctgatgcagcagcttttcccccaggaaggcgaagccctaccccgcctccgcttccccgagtttgagggagctggggagtgggaagaaggcaccatttccgacattgggaccgtgttgcagggctacggcttccctgagaggtaccaaggtcagcaaagcggtgatttccccttctacaaggtgagcgacatttcaaggtcgcttggcgcaggaaagacgttcatcgaagaagcagcaaactacgtcaacaaaaaccaattgaaggaattgagagccaagccgatccctgccggaacggccgtcttcgccaagattggcgaagcgatccgttccaataagcgcgctatcacgacggttccatgtttgatcgacaacaacgcggcgggagttaagtcgatcaaggggaaggcaacagatttcttcatctatctgacgatggagcagatttcgctgatcgatcacgccgggggcgtggttcctgcggtcaacaagtcagcgattgaagccatacccgtgaagtttcctcaggtcgcagaacaacaacgtatcgccgactgcctcacctccctcgacgaccttatcgccgccgaaacccgaaagctcgacaggctcaagacacacaagaaagggctgatgcaacaacttttcccgcgggtcggggaggctgacacatgagcacctacaagaacctgaaaactttggtggccagacttcgtgacgatctgaacaatccaactgggccagtctcgctggtcttgatctatgcctacaaccgcaccggcaagacacgtctgtcgatggagttcaaggacgcggggaagcgcaagaccaagaagaacccgaccggcacgcctgacacgctctatttcaatgccttcacagaggatctgttcgtctgggaaaacgacctcgaaggcgacagcgttcgccgcctgcaactgaacgaaaagtcatccttcttcaacgcgatgacggaactcgcactggacgaaacaattgcgggttatctttcccgatatgccgatttcgatttcgacttcacctacaaggaaattcagcagggcaacgagaccatctccaagcccgatttcgtgagcttccgaaagggggatcagtccaatatcaaggtttcgcggggtgaacagaatatctttgtctggtgcatcttcatggccatctgcgaacggatgctggatgggcatgaatcctatcaggggaagaagtatctctacatcgacgacccgatctcgtcgctggatgacaacaacgcgatttccgtggcctgcgatctggctaagcttctccgccgggcagccacgcggaaggatgctgccggtgggcccgctccgatcaagttgatcttctcgtcccaccatgcgctgttcttcaacgtcatgtgcaatgaaatgggcaggcggaccgatggcgaaccgaagatcacccacaagcgctatttcctgcaccgcccaaacggcgacggcgcttacacgcttcaggcgaccgaggatacgcccttcttccaccacgtcgccactttagccgagttgcagcgtgccgccgatcccgacaaggggaagctctacaccttccacttcaacgccttgcgcagcgtcatggagaagacagcctctttcttcggtcatccaagcatagccttctgcttgaaggcgctgaacaacgaagaagaccgggcgctgttcaaccgggccctgaacctgctgagccacggcgcctatgccatccatgaacccacagagatgggcgaggacaacaaggaactgttccgccgcatcctgggcgaattcatcacgcggttcgaattcgccctgccgggagttgttccagcccagcccgcagccccggcgaaagcgcccgcccctgaggaagcacccgcacaatgaacgaccaaaatcaaaagcaactgggcaaaacgctctggaacatcgccgatacgcttcgcggcgctatgaatgcggacgatttccgcgactacatgctgtcgttcctcttcttgcgctacctctctgacaactacgagatggccgcgaagaaggagcttgggcgtgactaccctgatcctaatgcgatcggcaatggcgggcgctcgcccctatctgtgtggtacgcgcagaaccccgatgatgttgctgcttttgaaaagcagatgcgtctcaaggcgcactacgtcatcaagccggaacacctctggaccagcatcgctcatatggcgcgcacccagaacgacgaactgctgaacaccctgcaggcgggcttcaaatacattgagaacgagtcctttcagagcacattcggcggccttttctcggaaatcaatcttggctctgacaagctcggccggacatacgctgatcgcaacgccaaactctgcgccatcatcacggagatcgccaaagggctcgccgacttctcgtccgacgtggatgcgctgggcgacgcctacgaatatctgatcggccaatttgccgccggctccgggaagaaggcaggcgagttctataccccgcagcaggtgtcagacatcctttccgcgatcgtgacgctagacagccaggagccggcaaccggaaagaaagagcggctcgccagcgtgctcgatttcgcgtgtggctccggctcgctgctgctgaacgtgcgcaagcgcatggggccgcacggcatcggcaaaatctacgggcaggaaaagaacatcaccacctacaatctcgcccgcatgaacatgctgttgcatggcgtgaaggacacggagttcgacatctaccacggcgacacgctgaacaacgactgggatattctgcgcgagttgaacccagccaagaagccctccttcgatgccattgtggccaatccgcccttcagcttgcgctgggagcggaccgaggcgatgggcgatgatgtgcggttcaagaactacggtttggcgcccaagtcggccgccgacttcgcattcctgctgcacgggttccactacctgaaggatgagggcgtgatggccatcatcctgcctcacggggtgctgttcagaggtggggcggaagagcgcatccgcaccaagcttctgaaggatgatcacatcgacacggtcatcggcctgcctgcgaatctgttctattcgacgggcatcccggtctgcatccttgttctgaaaaagtgcaaaaagccggatgacgtactcttcatcaatgcggccgagcattttgcgaagggtaggagacagaacaagctcaccgatgatcacatcgccaaaatcatcgaaacctatcaattccgaaaggaagaggagcgctactccaagcgcgtgggcatggatcgaattgctgaggaaggcttcaacctcaacatctctcgctacatcagtacggtggttggtgaggaagagatcgagctgtcagccacccagggtgaactcgtcgagcttcaaaagcagatccgggaggcaacttcgaaacacaacgctttcttgaaggagcttggattgcctcttctgccaggggagaattgaggccatttcgcccatatcaacgacgagaaataagggcgcagcgttatcgcgcgatggctgaaccgcgccgggtttgccggaggctccaactcttgagagggtggagccatgaccagcaggatgacgaacaagtttgcccccgaagtgcgtagccgcgcggtccggatggttctcgagcacgagagcgatcacgcctcccgctgggccgccatcgcctcgatcgccgccaagatcggctgcacaccggagacgctgcggctgtgggtgaagcgggccgagcgtgagggcggtaagatcgacggcgccgccccggacctgaacgcccgcctgaaggcacgcgagcgggagaaccgcgagctgcggcaggcgaacgagatcctgagatgggacttcaaggcgttgttcgtggtcgaccgatccggacgaccatctcggacaaggcaacgccatgcccgcatgacctcgtcaatcgacagttcagggcgccgggacccaaccggctccgggtctccgatttcacctatgtggcgacctgggtgggtttcgtctacgtcgccttcgtgatcgacgtgttcgcgcggcgtatcgtcggttggcgggcgagccgaaccgcgcatgcgagcttcgttctcgatgccctcgagcaagcccgccatgcgcgccggccggcacccggtggtggcctcgttcatcacagcgatcgaggcggccaatacctgtcgacccgcgacaccgaacgcctcgccgacgccggcgtggtgccctcggtgggcagtgtcggggattcctacgacaacgccctcgccgagacgatcaacgggctgtacaaaaccgaggtgatccattggcgctccttggaagccgtcgggtgtgcgaccctcgaatgggtcgactggttcaacaaccgccggctcctcgagccgatcggcaacatcccgccggccggggccgagcaacgctggtgggacgaacaggagcaggcggccatcgccgcctgactcaacgcgccgagcttccgacgaacccggcgcggttcagagaaccatctgcttcggcagattgggagtcaacgacccgcaaattggtagccgaaagaccgcaatctgggaagaaataagaaaaatcgccatctgcaatcgagctttagcaggttgccgaagaacgatcagcgctgagccttcatcccgatccgtcgcccgtgatggaagccgacctcgaccctccaggtcactcgtggtgccggtagcggctcctcctttggccgatcaccgtctttgatccagccgaacgcctcctcgatgcccgagcgcggtccgctagagtggcaccttattcaatttcgccacttttccgcagccggccaaacatcccggcactatctccctcacctggtgcctatatctatgataacgtcctttatcataaatataatttgacatgacggatgtgttgttataaaataccactaactcaaaatggaaaggagatgatgttatgataataaaaattttacataacggaatcccgttcatatcaaatagcgatgcgagattggtatgttctggaattcgatatcactatatcgtacttttatagaaatttaccataatacgcggtccccacgcctttagaggcgtgggaactgatctgggggcttgaatggggttggtgacacagactttcaaatggcttgcttgtagccagccgttaatttctacagctggcgaaccggcccaactgcgcttcctcgaattcttcgttgcccggatccgcaacccgcacacccggcgtgcctatggccgggcggccgaagacttcctcacctggtgcagcggcgtcgggctgaccacgatcggtcaggtccagccgctgcatgtcgcggcctgggtcgagcttcagggccggcacttcgccgcgccgaccgtcaagcagcgcctggccgggctgaagcatctgttcgactggctggtgaccggccagatcctgcccgccaacccggccgcgtcggtgcgcggcccggtgcatcgggtcaaacggggcaagaccccggttctggaggcggccgaggcgcggcggattctggaggcgatcgacgtctcaaccccgatcgggctgcgcgaccgcgccctgatcgggctgatggtctacagtttcgcccggatcggtgcggccctggccatgcgggtggaggacgtctatgtccagaaccgccgcctctgggtgcggctgcacgagaaggggggcaagcgtcacgacatgccctgtcaccacaatctcgatgcctggctgcacgactatatggagggctgtgcgctggcggatgaccggcggagtgccctgttccggaccatcgctcgcggcaccggccggctgagcgaccgggcgatgcagcaggccgatgcctatgcgatgatccggcgtcgggccgcggcggccgggatcgagacgccgatcggcaatcacagcttccgggccacggggatcaccgcctatctcaagaacgggggcacgctggaaaaggcggcaaccatggccaaccatgcctccacccgcaccacccagctttatgaccggcggccggatgatgtgacactggatgaggtggagcgggtcatgctctgaccgctgctgcccggggctcggacagcaggttttcggccgcgatcaggcaacaccaggcatcggcgagcgggtcgtgggggcgatcctcgaccggcagtttcaggccggccttttgcaggtaggggcgggccgcacggggatcctctcccgctgccagcagcagcgtcgccagatcgtgaagcgggaagggggcctggaattcgcgggttgcaggatcgcgctcgacacagcggcggaacagtccggcttcgaccggggcggcgcaatgggcgatgcagaccagatcctcgtcgccggccgcctcgacctctgcccgataaaacacccaaaagtcgtcgagcagcgcgtccagcccgtcatgggtgcagggaatatcggtcatcatcgggatgacctcgcggtccacccagggatcgaccggcccgatcaacgggcaccggcccagaaagacggcgggcgcagcgccgccgccacgcgccaccgccgcgatggcaaaaggcgcgccatagagcccattggtttctgcatccacggcgaggatccgtctgggcgtgactcgcgtgtcaggcgtaaacatgtggcatctcattcatatgcgcggcatgatgtgacgataatgcaatcatacgtggaccaccgccatggcgacatccccggagggccccgggcccggtcaaccctactacatccggatggagtgcgtgaatttcagcgcggtcctctcggataccgaggatctgagcaccatccgcggcagcggcctcgccatgctgcatgccgtcgaatatgcggccaaggccctgaaggagctgacccggggcgcggtcgagcaggtgacgaccggtgcatcggtgggggtgttccgggtgagcgcggcggatcaggccgacgcctggacggtcgcccgcaatctgcgggcgcggctgacggcccatgcccccgcggcagccaacgatgaggagagtgagccagccaggccgcttccgggcgccatcgatgaagccgagcttctccgggtcctggaccatctgagcatcctgacggccgcctgtgccgcgacggcggacttccgggccgatatggaaaccctgctggcgctgatccgctggcagcagcagcaggccccctcgctggtgctgcctgcggcggggaccagctgggacaagacaaagctgatctgcccgaacgatcatacccggcttgcggatacctatattttccggcgcaaggatgagggccccggccgatatccggcgagccggagcgtgcgcgaccgccatgcctatggccgccattataagcagacgctttatgatcgggtgatcgacggcataccctatctgaaggacgacggctctaagcggcgcaagcgcgcatatgctgacgaactcgccgatccggcccgtcagcccgacaaagccctcgatggcaaaatggccgcgctctatgccgacgaactcgccgatctggcccgccggctcggtgcgcccctcgatggcaaaatggccgtgctctatgccgacggcaaccggttcagcgaacagatccgcgaccttgtgaaggcaagcgacaccccgatcgagacccagaaggcgatcgacaaggcgcttcagggctggcgcagtaagctattggagaaggtggtcaagctgatcgagctggatgatcgggattatcccctcacgcggatcgaaaccctgctctggggcggggatgaactgatctgggtgctgccggcctggcgggggtgggaagtggctgcgctctttgccgagcatatccgcaacgagccggtggaggggaagggcaggtcgatggacgtgccggagaaggatggctggtcgatgaacatgtcccacggtctgggcatggtgttctgccactatgatgcgccgatcaacggcatccgcacgctggcgaaaaatctggccgacaaggtcgcgaaggcagaacggacaagcacccgtctggcggtcatggtgctcgaatccttcgatgccgtcggccaggacctggaggcgcatctgacgcggacctatggaacagcgggcatcacgccgagcgccatgtgcctgacggccccgcagggggcaagctggaacgacgtgccgtgcgccgtggcgaagatgaaggaacatctgccccgtcgccggctgcatgccctggccgatgccctgcttcgtcacgggccggtgacgacggagaccgaccgggcccggggtcggttctggcgcgatctggatgcaccggccgaggcggcgatccgcgaggctgcggagacgctggggaggtgctgggggttcgatgcgcagggaacggatgcccggctctggctgcatctcgacatgctctgggactatctggccccggacgtacaggacatggcggaggtctgagggccatggagatcagccgttacgagttgagcctgacggtcgccggaccggttctgccccgcgccaccgccatcggccggccgggcatccacacgccgatcctgcgccagggcgaccggctggacggcctgccggtcattcccggcagccatgtcgccggcaagctgcgcgaggcctggacccagctgggggagattgctccggaccagtttaccgatgtcgacacgctgttcggcgccccgggcttcgcgcccgacgcggccgtggaggggccggccgggcagcgcaagcgggtgatcctgcccggcgatctggtggcggaccatgccggccgtccggacgggcgccggacccgggtgaagatcagtgatgagaccgggacggtcgagcgcggggcgcttcaggtcctggaagccccctatgcccccggtgaccaggtcaccttcaccggcgcgctgatcattctgggtaattccgacgaagcgccctatgcggcagagatcgccgaccggctgcggatctgcctcaactggatcctgcagctgggtgggttgcgcggcgccggctttggccgtgtgctgacggcggaactgaaggaggcgaacggcaaagggcagggcgccctgccggaagatgccgaccgcctgcggttggttctggccttcgagaccccgttctgcatttcggagcggccggtctatggcaacatgttccattcggtggatcatgtggcggggcgggtgatcaagggcgtgctggcccggctgatctctcatgcccatcccgagagcggcgtgatggcgcccgtgacgcccgcgatcctgacccggctgcatatcggccaggccgagccggtgcactgccccggcaccgctgcggaagaacggcttgaagcggccggcggtctttcgggccggcggccgctgccctgcccggaatcgctggcgacggcgggcgacgaggtggtggtcgatctggccgaagagaccgagccggttctgatcgacggcatggcgccatcccacccgaccgactggaagaacacgcccgacaccgtcacggcgatgatgcgcaatggtgccgatctcgcgtcggcgggcgggaaggcggtgggccgggtgatgcgggtgcgcaccgcgatttcgcccgagcggcgccgggcggcgcgcagccagcttttcggccaggaatgctgccgggtggaggatcatgtctggctgggccatatcgacctctacggcctggatcaggatgagcgtggccatgtgcgggcggctcttgccaatcttgcccggaccgggctggtcggcatcggcaagaccgatgccacggcgctgatccgggtggttccggagagcctgcccgcggtgccggttccagaggtcggccgcccgatccggatgctgatcgtgaccgaaaccctgctctgcccgccggatgtgctgggccggcatcaggggctggccgagttgcgtgccgcctatgcccgcgtgatcgacgagctgtcgggcggcacgctgcgcctgcaccgggccttcacgaccgaggcgatgcgcggcggtgctttccatgcccgtaagcgcccgccaaaaacgcagtatcggccctggggcgtaacccagcccggcagcctgttcgtgatcgagccgaccggcacgggcgacgccaccccggtgctgacgcgctggagccgcatcggcctgccggtgccgccatcggtgctcaaggactatgagctggacgggatcgcggccgatcagctgtggaaccattgcccctggttgccggaaaacggccatggcgcggtggtcttcgacccgccgcgccccgaaggccatctgcaggaccggacacgcctgacccggatccacctgcccgacggcctttgggcgacgcccgaacccgatccggcacggacctccgcgggaggtgaggcatgaccaggaaacccgccttcgggccgcgctggctgatcaccggcaggcttcggctcacctcggagctgcatctgggcaccggcgaaagccggcccgacgacgccctgcgcggcccccgcatgactgaggacgagacccccgacatcgcgctggtcgccggcagcgacaccgggcgtcattacatccctggcacctcgctcaaaggtgcgctcagggcctggatcaatcggcatctggcgcagctggcacccgacggcctgatcactgacgactggcagcgggacgtcttcggccatgtcactacccgcagcgatcggcccggggaggaagatgacggcctgggcggccgcgtcatcatcggcgatgccgaagtcagcgccacgcagacgatccaacccgcccgcgaggcccgcatcgccatcgacccgcgcacccgcaccgtcgacggtcgccgcctgttccaccagcagaccctgccgccgggcacggttttcgatatccgcgtggtgatcgagacgccgcctgcggaggacgggcgccagctcgtgccctcagccgaaatcgcccaggccctgctgaccgccttcgccggcttcgacaccggccccgaagagacccgcatccggctgggcgccgacaagggtatgggcaagggggcggcggtgttcgagctgggggaggtgcggtgttatgatgcggagatcgtgaagctctggctggggtcgggcgggaaagaccgctgggatgacgcccgagccgtcgcaaaacgggcgagacgtaaggctgatgccctgctgcaagaacataagatgcagtggaagaatgcccgaccagctggcccgatgccgtcctggccgtggatttttgccgtcacaatcgatcttcatttcacgtcccggctgctgatgtccagtcctgatccgtctgctcgtcgcgcacatgccgagaaacgcaggcaggttgaagatggcgggatcgagccgcttgtcctggagtatcgacggacatcgaccggagatccggccttgccggcgacctcggtcaagggcgttctgcgcgcccgggtgcagcgcatcctgaacaccatttttacgaccaccggacaggccatggccgacggcctgaccggaacattgttcggcagtgtcgggcatcgagggcgcgtgcggatcggcaccccacagatcgcccagcggagcttttccagggtcgagcaggaatatatcgcgctcgatcgtttcagcggcggcggcgcagacgggcggaagttcaaagtcgccggaattgagaatgggcactggtcggttccggttgcgctgaacctggaaggcctggaagaggatcagcgaatattctgcttcgcctgcatgtgtctgttgttcaaggatcttgccgatggtgacgtgaccttcggccatggtgcagcccggggatatgggcgcagtaaggccacgatcagagatctgcggatcggcgaggcactggactctgacgtctggtcgaccctgcgtgggatcggcccggaaaccaatttaatgacgtctgaagtcttcattctgacggcccgtcaggcactgcggaaacttcacgtggccaaggcatcagtgaccgatatctctgcgggagacgcgtcatgagcacatcctcctccgatctcttcatcaatccataccagttcatcgatatttcggagcccattgaaaagcatcgtgacgagctgcttggaacctatccgatcatccgggagctgaagaccgccggtgcagaccttggacatctgacccatgacaggtggctggagggcagctattcaggacatttcgtctgtacgctcatgacgttctcgcccgtggttgtcggcggccagcagacggcggcgacaagtgatgcttatggccgggtggaaccattcagatatcggggcaagattgcgttacctgccagcagcctgaggggaatgctctccagcattgcggagattgcgagtggttccgccccgcgaatcctggatcggaggggcatcctttcttatcgggtcgacctgtctgacgcactttcggcaatggccatggtcgagcgagacctcagagatcccacgaaactggtgctcagaccgcttgccgtccccacttttgagattaagaaaaaatcacccggaaaatggatgattgatgatttcgatcggttcagcaggaagtggtcaaagtgcttcccgggactatcattcaaatattacttcgataaagatcaaattccttatgaagattcttcatttgtatctgaagacggtcatcgtcggaaatatgaatgccctgcggcggcattggttccgcgctttcagcgcgaatatgatattgtcgcgacggaaaataagtgggatctgacagttgatggcaaaaaaattccgatcaaggtaaagatccaggacggccgttatttcgtgcttgggggatatgccggcagcactcctgcgcctcacgacgaggaaacctcgtcttccggggcagctgtcggctatgtgcgcggtatagaagcggctggagagacggtgcaggtccgcaaatacgatgtgtttctgcgggaggtggcacggaacaccccgacactgcctttgccggaagaggttgtgcggcgatatgtccgcctggcggaggaagcctatgaaagcgcgctggccgagcgccgacggagcaaaggtcggacgcccgccgtgctctatcctcggaatgcgccgaagaacaaggccgacgggttccgtccgcgccccggcgatattgtctttttcgacacgtccgataaggacggctccgtcatcgagatcagctacagcgctgcatggcggcgatatgcattgcgcaatacgggagacaattcgtttgaagccgccgatatccatgattttttcgaagccagtgaagaacgcgcaggccgccgtctgcgtccggtgacagctgagaccgccgggacgcctctgtctcgggcggaggccctgttcggcttcgttgccgacactggtgtcgctgacgaggagggcgaccgcgcagggttatcctatgccggccgcgttcaggtcggttttgcaacccttggcaaacgggtctctcaggaggacccgctggacaacaggaaggttctgcgcgttctcgccagcccgaaactgccgtcggagtccttctactttcatacaacggacgtcgatacgaaggggccgctctcactgacgaaccatcgtcctaacggtaccaagatgtatgtgcacaacggatctcctcgtccaatcagcattcgaaagatcgctcaaggtgatgatcaggcccgccagaaacttgaggtgcgcccgataagcgagaaaacgaaatttatatttcgtgtgtattttgagaatctggatattcgagaacttcagcttcttgctttcgcaattacgccgtcagataatttctgtcacaagatcgggctgggcagaaacattgggatggggaccgtcattatcaaggtgaaatctctcgtattgtgggatcggggacagcgatatatcgatcccttcgataccggccatcaacagcaattcgatggcgaggataacaataccccccttgcaccccggcagcttgcagccggttggcgtcgtctgttggaagaggcccttcctcagacggcccgggcccttgacacgcttggcaggttgcctcccaaagatggcccggccgtagcccatccttttgccctggatcagcagatccatacggaagacaaaacgttcagctggtcagcgaacaacaagcgcctggcggccgggaagcgacagacgctcggtcccatccgcgacggaaagctctcgaccctgaaaccgaatggtaacgggagtaaggagagcgataagagcggcggtaaatgacgccattcggccctgccaaggtcggcccggggcaagatcagaaacctgccacggcaccaacatccgcggcagaacgcctcaccacccccgccctgaccggcgggttcgacctgctcggcccggtcttcacgcgagaggtgatccacctccgctgtgcggccccggccgggctggaggatgggccgtggatgggggcggccgtgcggggcgcgctggggcgggttctggaagagcgggcggcaaacggaggggcgggcggtcggcgggatccgttcaaccggcccgcggccttcgcgatcctgttccagacccaggccatgctcacccgccggctggaagtgccccggccctggcggttgcgggtgcagcggcgcggccgcagcctcaccatcgagatcgcgctctacggcttcgccggctattgggcgcccgccgtcgccgatgccctggtcgaggcgctggccgccggcgtgtcgctgcgcgcgctcggccggatgcgcgtgccctggccggtcgaggcgctggagatccgccgggtcacgggcctgcccacaggacccgacacccgactgcccgacacctcgcgcgccctggtgctggacatcgaaaccccgctcgccctcaaggccggcggcgcgctggccggccatctcgacaatctgccgatgatgctcgccgaccgcgccagcggcctggcccgctggcacgacatcgccatcgccgccgatttcagcgccctgcgcaccgcctcacgcaggctgcgcatccaggccgacggcctgatccccgaccgctgggaacgccgctccggccgcctcgccggccgcatcatcccgatggccggcttccgcggccgcctgatcctgcaggatctggacccggccttcgccctgccgctcgccatcgccgccgatgcccatctgggacagggcgcgacggccggcctcgggtggttcagcgtctcggaagactgacggcagaagaccgggctgccgcccggacccgcccggaggcgcggcctccggacctcgggcgtggatggggagcggagccattggtcatggcttcaaactcaagcgcaggtacgaagcaaacctgccaaaggtttccatgaccggagccattggtcatggcttcaaaccgagatccacctcgacgtcgagtccacctgtttccatgaccggagccattggtcatggcttcaaacaccatcatccaaactccgtgggggagatatggtttccatgaccggagccattggtcatggcttcaaactgcgccattacgcgacggagcttctggtcgagtttccatgaccggagccattggtcatggcttcaaactcccctccttccaacccattgtcaactggcctctgaagatcccattttccgtcggcatccttgatgcttcatacgatagcatgatgtcctccggtgattttgatattttatattatatttcaataagataataatatccactgggtatccggccctcagaggggggcttctgggccgcagggggcgtataggtgcagaagcctgtggccagagagaccagcacgaccaggacatgccccaggccgatattgcgcagggccgcccggtcggggtcgcggccggggtggacataggtggtgtagcaggcaatgcgcctgtgcagccagcggcgcagcccgccctccggcagacggcggcaggcggcgtcgaggtaccgcgccagccggttcggtctggcggcggacgggggctcggccgggtgggggcggccgaacagctctcgccggtacaacagcgccgagacgccgcagccgatgatataggccacggcccagaccggcagatgagcgatggccgaagccccggacagcagatcccagatcggcgcctcgcccttggcgtcgctgccggcgacgaattccttcagccccagcaggccgatcgcgatcaccaccggcaggcccaggccgaacagcaccgcctgaacccgggcgccgcggcgttcgatcattgcggcggcttcttcggtcaggctggcgagccagctttcggtgcgggtgatcttgtcgtcgatcagccggtattcggcatcgagccgcgcctgacggcgcatcagctcgaacagctcccgcccctggacctgggtggtgacatcgccataccacaacccatcattgaagcggatcagccgccggcgcagatcccggaactgcgcgcgctgatcgttgaccgggtcggcatcgccttccaccaattgtggcaggcggcggaccacgtcggcggtgaactgcgtcagcacaccggcctggatctgggtgatcaggaacagccggcgatacatggtcggcatctgcaccgcatggatcacattgcgcgcgaaccagccactgccccacatcacgaaggaatggctggtggcggcaaaccacgagccatcggcatcgaagcgaccataggcggcggcggcaatctcggcgcgggtggccccggggtcataggcggggccgctgccatagggatcgacggtggcgagccggccgcgcagccagagccggcgctcgaccgcctcggcctgatcgggcacctgcccgagcgtcaccagggagtggacgacatgggcgcgatcatcggtcagcagccgcggtgccagccttgcccggtcccagcccagcgccgcgaaggcgatgtcgatcagcgcgccgaaccagccggtcagccgctgatcatccggcgtcacggcatggccgcggatcatatgccccagcatcccggacgggccatgaaggctgatcgcgacatggccgccggtcggcttctcgggcagcccggcctctgcgaagcctgaatgggtgaagcggccaagggccgcccagtccagcgcatcggcgacggtgaaaaccggcccggcgggtggggtcagaagcgcccgccagccctgggggacatcctcgttcgcggccttccagggctgcatctgcgcggccaggctcagatgttcctcgcccgaggggccggggttcagccggtcgcccagaatgacctccaggatcagcaccgagcggaaggccagatgcaggcgcaagcccaccaccggcgcgcagcgggccgaggcgcggctgttgtggacatagcggagcgacagcggacctgtcggctgcccgttgagccggccgcccgcgccgacatcgatcatcaggctgatcagggcatgaccatgggtcagcgcgtcggcaagcgccgtgcagccgtcggccggcccggtctgaccggcggaaacggcgggggcgaagatgtcgcgcacctgatcggccagatagatccgttcctcgtcggtggcctgcagaaggtgaaccgggcggttcgggtcgcgggtcgcggcacagagcgcctggatgtcgtctgccgtcagctcctgcttcaggcccaggatctggctgaaggacagccgccagcccgccaccggccggttgccgttcagcagattggccaggatcctgtcggcaagggcatccagcgccgccgcatcggtgccggtgcggtcttcggcgccgaagaacaggcactcgccgccgccgccgtaataatggagccgaccggtcccccaggccgcccgcagatcgggccggaaccagtcgcgcatcagcccggcattgcggcgggcgccgtaatgttccagggcgacggtccggggcgccggcgcctcgtccgcggcctccccggtttcgggccgccgggtgaccaggatcagcagatcggtctcggcatcgggccgtccgccgccggtctgccacatcctgagcaggatcgcctcggcggcgatgtcgcgatcggtctcgggcacctcggccagaatcagccgttccccgcctgaggcccggtcggcgcccggggtaaatgcccgcagccggagcggttcccgcgcgacatcgtccacccggcccagccaggcgttgacttccgtcgctggtgcgcgacagatccgggacaggatcgccccggcatcgacgggggccatgccatggctttcatggtggtcgcgcatctcctgggcgatcaccgcatcccaggcgcggatccggagcatgatccggatcagcacctctcccgccagcacctcggggagatgcgtctcgcccgctctctcctgcgcctcgccatgcgtcggtggggctgtggcatccgggcatggcaggttccaggcctcggcaggcaggcggcggctgaccgtgccccagtcgacctggtcgcaggggctgatgtcgacaccgacgagctgcgagagcgctttgcaggcggcggccgatgcagcggccttgcggcagaccatcgcctccagcgcgccgatcagcccggccatgccgcccagatcattggcgatgatcagccggtccagcacggggatctgatcccggtcatggccgccgaattgttccagaagcgacaccggccgttgcggcgcagcggcaaaccccgccgccgcagcgccggtgcccgggccgtcatccaccaccacatggcccggatggcagcgcagcctgaccccggttgccgcaatcaccgcggcggcgtcggcatcggcgatccccgccagcaccacctcgcgcaggcgcggcgtggcgactgtctcggacgccgccagccgggtcatcacccggtccagcagatcggccggcatcccacccgtctgccgccaggaccccgcgaccgcgagcgtttcagtcccgcgcccgctctctgccgccaggacctccgccacccgggcggtcaccagatcccgcaccaccaccacgaccagccgcatggcgccccccactccgatcaaccctgggacgaggctatcatccggacgggtgagcgggaagagtgaagggtcacaggatcggagggggagaggatcgcttttgaaaaggaagagggtaagacacaggaagactcatgaccggagcgattggtcatggcttcaaacgtgttattgccgcggcggggcgggaaatagtttccttgaccggagcgattggtcatggcttcaaacctgttcatcgatgccttcaagctgggcatcatgtttccatgaccggagcgattggtcatggcttcaaacgcgtcgactcctacaacaaggagcacggcctggagtttccatgaccggagcgattggtcatggcttcaaaccactcaatcgccaaaacctatcctctcgagtttccatgaccggagcgattggtcatggcttcaaacacgggccgttcccgttcctcgacgtcgccaggtttccatgaccggagcgattggtcatggcttcaaaccatgaccatgaccgtttccgatctcgttctggtttccatgaccggagcgattggtcatggcttcaaacgagacttcgcatgcggtcctcgtttttcgccgtttccatgaccggagcgattggtcatggcttcaaactatacactgtataaggaggcgaagcagcggaggtttccatgaccggagcgattggtcatggcttcaaactccccctcttccaggccattgtcaagatatcctgttttggtccattttccgtcgggatcgggatcatttcatacacaggtattcgtcccttgaagacatccaggtttctgcaataatatcagacaattatgaattccactgggtctttccgccatgttcgaccgtctgcttgctcccgatcggctctgggaagcctggttcaaggtgttgcgcaaccgtggcggtcccggtggcgatggtgaaagtctggatgccttccatatcggtgtcgagccccggcttgcccggctggcggccgatgtgcggggcggaacctaccggccagggccctatcgtctgctcgatgttccgaaggatgatggcggcacccgccggctggccattccctgtgtcgcggatcgggttctgatgacatccgcggccctggtcatggggccgatgcttgatgcgaccttcgaaccctcaagccatggctatcggccgggccgtggggttcgcaccgccattgcccgggtcgagagcctgcgggatcagggtttccactgggtgctggatgccgatatcaccagatttttcgatcgcgtgccccatgaccgcctgctcgatcgcttgcaacaggccaccggggatgctcgtctggtcgatctcgtcggcctctggctggatggctatgatcgggaaggcgaagccggacggggggacggtctcgggctgccgcagggctctcccgtctcgccacttctggccaatctctatctggatacggtcgatgaacgcatcgcggccgccgggcttcatctggtgcggtttgccgatgatttcgtgatcctggcggcagacgaggcggcggcggaaggcgcgcgcgcccatgtcgccgccctgcttgccgatcacggcctgcatcttcatccggacaagaccagggtggtcagtttcgatcaggggttcgcctttctgggcaagctcttcgtccgctccctggtgctgccccggcccgatgacgatccaacgccggaggcggccatgcctccggcgacggcatccccggtgcctgacccgatcgcgatgacgccaggcgatcccgaagcttcgccgatcctgcggccactctatgtcgtcgaacccgggcgccggctcagcgtccgcaatcaggccttcacggtggaagagatcgagacggggcgggagctgatcgcgcttccggcggcacgtgtcggtcgcatcgaactcggtcatcgggtcgccgccgatgcccggtccctgcgccatgcggcggccgcccgtattcccgtcgccctgctcgacggcctgggcggggtcgaagcctggctggagccagatggcggtgcccgggggcagcgccatcttgcccaggcgcgtcatatcctgaaccccgacagccggctcaccctggcccggctgctggtggatgcccggcttcagaccacccaggccctgctcaagcgtctgaaccgacgcaagcgtctggcaacggtcgatgcggctgccgatcggctgaagcggatccggcggaaactgccgctggccgccgatatcccgcagctgatgggacatgagggcgaggccgccgcgatctactggccggcccttggagccctgatcgaccatggctgggtcttccgtcgcagattgcggcgcaacgcggctgacccggtgaacctgatcctggactggctggcatcattgctggcccgcgagattaaggcccttgccacccgccacgctctggatccgggtctcggtgtgcttcacgaggtgcgcgacggccatgatgcgctggtctcggacctgatcgaaatcttccgggcgccactcgctgaagcctgcacggtctatctgttcaacaaccggatcctggggcccgatgacatcatccgctatccgccgccgccggatgcccccgatcaggcgggtgtccctggccagccggatggcggctggcgggtgctgccggaagcggggcggcgggtgatccgcacctgggaaggctggctcgaccggccggtgaccggcccggatgggcggcggcgggcctggcgcggcctgatcgacacccagcttgccgcctggtgccggcatatcgaggacgacgcacccttcgtcccctatcacctggactactgaatgcccgcctgccagcagaaagccgccctcatgtccgagacccgcttcgtgatggtctatgcctatgacatcgtcgccgaccgtgaccgcgaccggatcgccggcctcctggaagatgtggccgtgcgcgtgcagcgcagcgtgtttgaaattcgccagacccgggaggaggccgaccggctcatcgcccgcctgaccccgtatcttgcccccggtgacaagctcagggtctatgccctcggggccaccggtcttgatcacagccgtgttttcggcgggccgccgcttccggaacccgcggattactggttgctgtaaacctcacccgatgcgacgccggaaagcgtgggaacccaggttccccgcggcgcaaggggcaagcgccagcggcggtgccgccgtcgtcgatcgcggggtctccccagccttcggcggcaggccgcctgcaggccggcgcgcagcgccgccccgggctcgggcccggggtgggtgatccccctccccgcgatcgacccctctgagctgcgccgcttcccctccttcgttcgccccttgggcgttgtcggtcgatgaaatcgaccgacacatcaagacggaggagaccatgaagcaggatcttcacgccgaggtgaccgcccggatcgtggcgcagcttgagacgggtgtgcggccctggatgcgcccccccgaccgcaaccagaaaaatcgacgggggagagcgttgcaggccggccgcttcgggccacgggtgagccctatcgtggaatcaacaccctcattctgtgggaggcgagcctcatccgcggctatcatgcgccgacctggatcaccttccggcaggccggattcttaatgggtgtggggcagaaggcggcacagtccgtcggggtgagcgcgggaccacggttgtctacagctctgccctcacccgtaccgatgtcgatccggagacgggcgaggaagcagagacccggatcccgttcctgaagagctatacggtgttcaatgtcgagcagtgcgacggactgccggaccgattgacggctccgcttcccgcgtgccccgaacctgaacggatcgctgccgccgaagccttcatcgaggcgacgggcgcccgcattgaggccgggggtgggcgtgccttttatgcgccggcccgggatatgatcggcatgccggcacgcgctgccttccgcgacgctcatggctggtacgccacccttttgcacgagctgactcattggaccggtcatcccgcccggtgtcatcgtcagttcggccggcgcttcgccgatcaggcttacgcccgtgaagagctggttgccgagcttggcgcggccttcctgtgcgcggatctgggcgttgcactcacgccgcgcgaggaccatgccgcctatctcgcgagctggctcgatgtgctcagggcagacaagcgtgcgatcttccaggccgcgagttttgcggcacgggcggtcgactatctccatgcgctgcaggcggcggcatcggggcaggctgtcgcgtagccataaaaatgcacttacatcactgtatatacagtgatgtaagtgcatctcaatatatcattggcctctgatgggcggaaggacagtgacgggcatgggcagggcaatcgggtgaaacagtgcgtgacaggacggaaaaagtctgaatctctcgttgtcgacgttgctggcttgggagggatggatggaaccgtgtggggccttgggcgaagcgattgggtttcttgagcattttgaggagcttccggacgggcggcaagctggcaagattgtgtatccgcttgatgaggtgctgctcctgagccttctggcggtgctggcgggagcggagaccttcacggacatcgcgcgctttggccaaaagaagctcgatctgctgcggcgcttccggccattcgcggatggcacgccgccgcacgacacgctgggtgacatcttcgcgtcgctggacgcggagagctttcagcggtgcttcgtgtcgtgggtggcgtcggttaccgggacgcctgagggcgtgatcgccattgatggcaagaccgtgcggcgttcgggcgggaagaaggacgcgaaggcgcccatccacatggtctcggccttcgccgcccggcagcgtctggtgctgggtcaggtcaaggtggacgagaagtcgaacgagatcgtggccattcccaagctattggacctgctggcgatcgaaggggccatcgtgaccatcgacgccatgggatgccagcgcgacattgcggccaggatcaccgacaagaaggccgattacgtgttggccctcaaaggcaatcaaggatcgctgcgcgaggacgtcgccctgttcgtcgccgaacagcaggccaagggcttccaggatacgaccatcagccagcacgagaccgtcgacggcgatcatggccggatcgaaacccgcaagaccaccgtcatccatgatgtcgcctggctccgggcgcgacatgactggcccggcctcaaaagcatcgtcgtcgtggaaagcacgcgacggatcggcgacaaaatcgacagcgaaacccggctctacatcacatcattggcgctcatcgccgctctcgtcgggccgatcatcagaagtcattgggccatcgagaatagtctccactgggtcatggatatggtcttccgtgatgacgaatgccgggtgcgtacccaaaacgccccagccaacttcacaaccctgaagcacatggcacataacctgctgcgacaagcaccgggaaaggactccctacgcctccgacgcaaggtcgccgcctgggacgacgacttcctcgcaagcctcatcgcagtttaaaaactttcacccgattcccctgcgggcatgggagcgtggcttgtcttaaaatctccgtccgaagggccggtgtcgatcggatgaattctggtagtctgaggctgtcatggtggtgttctgagcgaataccatgagatgcctgcgctgcagggacgggcttgttctttggggtgagtttaagtaatttcaatgggttgaaggtaagaggttcccccgcacgggcggggatagacccgactacggctatcaccccgtgcggctggtcaaggttcccccgcacgggcggggatagaccccagcacactccgattcggcattccctctcgctggttcccccgcacgggtggggatagatcggctgacgagcagagcccacgttcgtgcgagccctgcggccttcagtacgtcggagaggttgaggggagcatcagacagttcaggttcgcttgcggtcctggttcgccagacctgcattgctgacgatcgtcgcgtggctggggtgccggtagccgtctgcaagatcatgcgatcggggcgggggatcgccaggcgccgcccattttcttttaagaatcaggccgacggtcgggccgcgctcccgcgcgatatctcttcagatcgctctttttgcgtttcatgctggttggcccctttgccttcacgagccagtttcgcttcccccttccaccactgggaagaacagcatgtctcatcatgcataaaatcatatttgcatatatacagctaaacactaatgcatctatgtagatacgtataagagcctgaaggagaccgtcgatgcccgtcatcgcactcgccaacagcaaaggcggggtggggaagtcgaccactgccctggtccttgcgcaggtgtttgcggcccagggcgccggagtgacgctgctcgatgccgacccgaaccagccgcttggggcctgggcggcacgggatcccgagcgggtgccggccctgctccgggtggtgcctgatgtgacggaggaaaacatcctcgatcacatcgacagtgctgcggcccgtgatcccttcgtgatcgtcgatctggagggcacggccaatatggcggtgtcctatgcgatcggccgggcggacatggtgctgatccccatgcgcggatcccaactggatgcggatcagggggcgcgggtcatcaaggtgatcgcccgccaggcccaggcctttcgcaggacgatcccctatgcggtcctcttcacctgcacgagcgtcctcaggggacgggacttccgccatattgcggccagtcttcaggatgccggcattcccattctgccggcggagatggtcgagcgtgcggctttccgggcgatcatgcagatcggaggcaccatctatgacctcggccctggttctgattcaggttcgggcgacgtcgccaatcccgaagcggcgatcgagaatgcggaagccgtcgcggcagctgtggtggactatttgaagggacatgtgaagggagatggggcatgagcgagagcaagcgtgacggcgcccgcaagcgcgccaccctggatctcagtggctttgctccaacgccggcgaagccggccgcggccgatgtcgctgccgcaatcggacgcgaggccgggttcacctcccgggcggcttcaggttccactccggcgcccacctccactccgacacccgcgccgcgccgtgatgcccgcatgaccatcgtgctgccggcgggtctgcatgactggctccgcgagcaggcttttcaccgcggcacatcgatgcgcggggtgatcatggcggcgctcaagggggccggggcgccggtcgatgacgacgatctccacgatcgacgccagacacgcgactgagttcggcagaggtcgggccgcgaggggatggggcaacacgcacccatccccttttttgtgtttttgggtaggcgcgatgtgcccacgcgacggttgcgaatcacatctggtcaatcttgtcccgaatcggctagcattcggcccgatggtgattcgagggctgcgcagcaacctttcgcggatccgacgaaagccagatgtaaccgacaaccccgccgggtaatccacgatgatttctacaatgattctgggactcctttgaaaaatgggttgccggggcgcggaaagaggcttcacgtgaaagctatgatgagatcttcgcgctcggagatacggcacgccgtggccgcccactgctcccgacagcacgctgccgggaatgggatgctgtatgtctatgtgccgaccgagctggatcgactgaagagtgtgcggggggtgagcagtcgtgccccgcttgtggaagaggcactgagggaatttatcgaacgcaatcaggccgaaaagtaaaagcctcggtcgttggtgcgaccgaggctttcagagattgagtgtaagacccgcgaagccgctaaactagcgcgtatcggacaagtatagatccaatgatagcggctggcggccccctcggcaagatccatcttgcgcgagcggatgtctttgtgcccgatctccggcctctggagaggacggacaggagtatgaaaaccgcgacaggcgcggtgcgcgatgagccggcggctcatgcgcgaccaggcggccattgccgatggcgacggtgtcggcgaagacgagatggatcgcctgctggatgccgaacaggagcggttgcgcgctgaggggtattgaccgcgacctgatgggccgccgccgggctggccgacgggccaccggtctgatgatccgtgcggccgcagccctgatggcgctggtgctgacgtctggcggcgccggggcggccgggacggtgacgccggagatctggccggtgccggcgcgtgcgctggcggccgatccggtgctggaggcgcagatcgatgctcttctgggccggatgacgctggacgagaaggtcggccagacgatcatggccgatgtggcggaggtgacccccgccgatctggcgcgctggccgctgggggcgctgttcgccgggggcaattcctcccccggcggtaccgggctggtgccgcgcgagcgctggctggcggcggcggatgcatatcatgcggcatcgctggcacgcagcggcattccggtgatctggggcaccgatgcggtgcacggccacaatcggttgatcggtgccacggtctttccgcacaacatcgcgctgggggcggcgggcgaccctgatctggtgcgccgggtgggccgggcgatcgcggccgaggtggcggcgaccggcctggaccagagcttcggcccgacgctggcggtggcccgcgatgcccgctgggggcgtgtctatgaaagcttcggcagcgaccccgctctggtcgcgcggctggcgggggcggcggtcgaggggttgcaggggcgggtgggacaggatttcctgaaagatggccgggtgatcgccaccgccaagcatttcatcggcgatggcggtaccaccaaaggcactgatcgcggcgatacgcaactgcctgaagttgtgctgcgcgacatccacggcgccggctatccgccggccctggccgccggggtgcagacggtgatggcctcgttctcgtcgtggaacggcgccgcgctgcatggccatcaggggctgctgacccgggtgctgaaggatcggatgggcttcgacggcatcctgctgggcgattgggacggccatgccgcgctgccgggctgcaccccgggcagctgccccgcagcgatgaccgccgggctggacatgttcatggccgccaccgactggcgggggctgtttcaggatacggtccggcgcgtgcagaccggcgagatcgccatggcacggctggacgatgcggtgcggcggatcctgcgggtcaagctccgctccgggctgttcgaccggcccgcgccgtcggaacgcgccgccggcctgcccgaaccgggggccgcagcccatcgcgccctggcgcgcgaggcggtgcgccgcagcctggtgctgctgaagaacgacggaaacctgctgccgatcgaccccgggctgcgggtcgcggtggtcgggcccggcgccgacgatatcggcatgcaatccggcggctggacgctggactggcagggcggcatcggccggaacgggatgtttcccggcgcgacctccgttttcgacggcatccgggaggccgtgacccgtgccggcggcagcgccgaactggcgcccgacggccgcttcgccacccgcccggacgtggtgatcgccgtcttcggcgaaaccccctatgccgaaatggccggcgaccgcccggatctggatttcggccgcagcgacggcggccgggcacaggcgatgctgcaaaatctgaaggcagcgggcctgccggtggtcagcgtgttcctgtcgggccggccgctgttcatcggcccggagatggcggcatcggacgccttcatcgcggcctggctgccgggcagcgagggggcgggcattgcggatgtgctgtttcgcgccgccgacggaaccattgcccatcccttcaccggtcggctgccgatggcctggccgggggccggcgatgcggcccggattccggaatgagaatgccaatcctcgctattgataaccattcttaaaaatatgggcacagtcgctgacgacgggagcccccatgatttctggagcggcggcaacagggcgagcccaatcgttgcccggtacattgcgcggattggtccaggagggtcgtgatgccgaagatgatggtcgtgtacaaggtcacgtggccgaatggcaagatatatgtcggtagtgacatgaccgactcgattacctatttcggtagtccggacaagagcctcatcgaagctgactttcccgaccgtcagtcccgtcgcgacatgaccgtgcggcgtgagatcttgtgggagtctgagactgccaccccatcagatgtcctgcgacgggagcgtgcattgatcattgcacttcgcgccaatgatccgacggtggggtacaatagaacacctcgtctgcgccggggacgctgacctcgaagcgatcagagatgtgcgcatccccgaaggcccggatggcaggatcgatggcggaacgggcggcggcagaatagtcacccggccgatgacgtcgccacaagcggccccgggtcatagccgagccggcgcagcatgctgcgtgcggtgcattcggcggtggaggtgaccggcttgccgagcctctggcccgccgccgccagcacgtcgaaactgggcatctggacgcaggccgacatcaccacgcagtcggcaccatccgtatccaggtcgcccagggcggcgagcagccggtcgcccgggatgcggccgacctcctgattgtcggtgacgctgaaattgcggtagtcgaccacctcgatgccttcggccgcgacataatcggccacgatgcgggccaggccgtcggcatagggcatcaacagcgacacccgccggtggcccagccgggtgagttcgtcgcacagcgcgccggcagaggtcaccaccggaaaggggcgcccgccttcggcggcgatggcaccgagggcggcttcggagctgcggtgatagcccggccccatcgccatgatcgcgaccagacaggcatagccggcgacatcgatcggcgcatccgagagttcggcggcacagcggcggctgtcggcatccatcgccgccagctcgtccagggtgacgtgcttcatgcgcatgcgcgaggcgtggaaggtgaagcgcagatcgtcgcgcgccgccgaccagcggttcaggaaggcggggatctcggtttccatggtggtgttggaactgggcacgatctgcccgatccggtggatcctgggggtggtcatcacgcgtccttcgcaggctgaggggaacggaaagtcagacgctgccgcagggtttctgacgcaggtgccggaaaggcgatgcgtgtgtgcgctgcggcgtgataggaagggggcagtcatcgaagagggaagaggcaggcatatggccaggacggcgaaggccgggacgaacgggacgcccgaagcgcctgagacgcaggccaccgatgccccgcgcgacatgcgtaaggcgctggtggagaagcagatcatggagcaggcctgcatcctgttcgcccgcaagggcttcgacggcaccacgctgaccgatgtcgccgacgccgtggggctgacccgtgccgcggtctactactatttccgcaacaaggaggcgctgctggaggcgatcgtggtcgaggcgaccgccgccccgctggcggaaagcgccgcctggcgcgagacggcgcccgaggacccggtggagcggctgcgcagcttcgtcgagatgcgggtgcggggcgtgctcacccgtcagctcaagatgcggatgatcgaggtgaccgaggccgtgctgccgcccgacatggccgcgcgccatatcgaggccaagcgccgggtgctggcggagtaccgcgccatcctgcgcgagggcatggaggcgggggcattccgggcccaggacgaacgcgtggccgcactcgcgatcatcggcatggtgaactggacggtgaactggttcgcccccggccgcggggccgatctcgccgccgtggcgcggcagatcgccgacatggcggtccagtcggtgatctcggcgcgcagcgaccgcaaccggctgtcggacccgaaagccgcgctggcggcgctgcgcgacgatgtcgaacagctggctttactgctggcggccgatcgcaaggtctgatccgaggatcgctcccccgtatcggtctccgtcaggccggctgattggtcccgatcaccgtgacggtgtcgcggccccattcggccacttcgccgtccaggccgccggtgaacatcccgtaccagagcgcgggcttcatccccaatgccttgcgttcgaacgtcatcggaccatcggtttcgatcatccagtagcccttgcgggggtcggagatgcgatagccgtcacggccgcgcgacacgtcgaccagcggcctgaattcaggcacatccacaacataaagacggggcatcacgcttcctccagccaggcgtcgaccagggcggccttgcggcgccatacggcatcgatatcggtcatccgcgtgccggaggcgcgggcggcgtcctcaagctcgatggcggcacgcaatgtcagctcggcgtcctcggcatcgatccgttcgatcgcgcgcagacgcagcgtcacctccagcggataaccgttggggtcgaggaaatagatcgattcgataccttcatgccgggtgtagggcgaaacgatgacgccccgggcctccagcgtgtccttccagcgctccagctcctcgcggctttccaccccccatgcggtgtgggtggccgcatagaaatagtggtcctcgggcaggtacttctcagggcggtcggtgccgatgtagtagaagaaggcgatggtcgcaccgttgccggcatcgaaaaagaagtgcaggaagtcggggtggtccggctggccccagccgcgggcgctgatcgtgtggatcagcttcaggccgaggatgtcgcggtagaaggtcaccgtctcgcgcagcttccaggtcggccgggcggtgtggtcgacgccgtgcaggcggagctgcaccccgtcttccgaggcggacttcaacgcctgcacatccggatcctgggtgcggtaggcgcgattggtcgagaaggccgtatcctggcgagccttctgatggatggtgtctgcggtcatctggcgatttctcctccggtgtcaggcgaagcccttgtccgccagccaggcggcgacggcgtcgccggccacgatctggccattgggcttttcggggtcgaccgcgcggccgtgatgattgccgtggacgcgcagccgggttttgtcggcggcaccgatcaggccgaagagacgctccgcctcggccgggaagacgctgttgtcgccggtatattcgatcatcagcaccggctggccgatatcgggcgcgcagctgtccatcgaggcgttggtcgaaaaggccgaccagttcgacagccagctttccggcgtgcagacccgggcgaagccgaccgagccgtaattgctgaccagctgattggcgccccagagcgtgccataggcacggtccgacgggtcgagcgagaggtcgaagcagcgcggatcggcatcggtgcgccagacctggaagatcggcgagaaggcggcgaggatcgcatcctcgcggctgccatcggctttggcggccttgcgtgccgcggctttgcgggcgagcagggcctttgccttctcgtcgatccgccgcacccgtgcggtctgggcggcgcgatagcgggccaggaaatccggagcgtaggaggatgagtccggcgccggccggaagccgttgtcgggggagaagggatcgagcgccggatcgaccgagagggggtcgtcttcgtcggtcaccgacgggtcgatgcaggcgagcagcagggccccctggcccagatgcgacgagaccagcaccaccccgtcgggcgccggcatcgccgcacggtcgagcccggtgggccggccgccgggggagcgggcgatccggtcttcgggtgcgcgggcggcctgctggcagtaataggcggcaagcggcccgccgcccgagatgccgagcagaacggtctgcgcgtatccggcctcgcggcgcaggaaatcctggccggcggccatgtcgtgcagcgcggtttcgtgctccagccggatgtcgttgccgggcgcgcgcgatccctgcacccagaccgcgaccccggcggcgagcagatcgggcacgatgtattgggtgacacccagctcgcgcgggtgcatcaggcagaccacgctccgctcggccccgcggcggaacaggaagccggtcaccggcgcgccgtccgccgtggtgagcgcatgggcggtcatcgacgtgccggcgggcaggcgcgccggatcccatgtggtgccgcgcagaccggcggtggtggtcgcctggcggcggggagccgtgtcgggactggtcatgaggcggtcatcccttcgcgaaccgcgtggcgggggaaagcttgtggaggatttcgggcagggggcccgaccgtgccgcctgatcgtcgagcacggcgcagagcgccggcggcaccggcatggtgacggtgcggtcctcgtcggagacgcggatcgaactcacccggccgatgaagaccggccggccgtcatcggcacgccgggcggcgatcaggagatgcgtggtatgggcgccggcgccccccggatggatctcgatgtcgaagacgtcgccgggccagagggggctcagaaactccatctcgatgcctttgcccggggcacggtggctgatgccgggcggcagggcgggcttcagcacgtgttcgccgaagagatggcaggcatccaacatgtagagcgggaagcgcccggcatagaccaccccggccggatcgcaatccgaccagcgggcggtgcggcgcaccacgaagggatgcatcgagacgatgccctcctggaccgggagatggtcgggggcggcggtcatgcggtcagctccagcccggcatcctgcgcgcggcgcggggcgatgtggcgggcatagaactccggcgcatactccttcagccggtcgtcatcgacccgcccggtgcgggtgaggaagtcgtgaacgaagctgaccagatcggtctgcatcgcctggcgcacgccttcataccagtcatagctgcgggcggtcgcctcggtgaacaggtcgcgtaccggccggcgggcggcgacatagcggtcgagcgccccggcgaccgggccgccctcgatcagggcatcatgcagggccacggcgtcgtccatggcgagccgggtgccggagccgatcgagaaatgggcgacgcggagcgcatcgccgatcagcaccgcccggccgtcggtccagcgctcggcgatccgggcatcgaagcggcgccagatcgagttgttctccagcagccggccgccgtcgagcacatcggcatagatctcttcgatcagcgccttgcgctggccgtcggtcatgcggtccaggccacagccctcccaggttgcggcatcgcattcggcgacgaaggtgctgagcccgtcggcataggtgtagtaatgggcgatgaaacagccgccgcgatgatagcggaagatcagcgcattgggcttcagcgcccggtcgacgccataccaggcgaagcggttgcccagctggtgggacctgaccgggaaggcatcgggccagatggtgcggatcacggaattggcgccgtcggcgccgacgatcaggtcatagccgtccagatcggcggccccggtgatccggcggtcgtgcaccacctcgacaccgacctcgtcgcagagccggcccaggatctgcagcagggtcagccgggcgatggcgcccgacgagcccggataggtcagcaccaggctgtcgccgttgaggccgatcttctggctgcccgagaaggtcatcgcccgggccaggcggtcgagggtttcagggtcgacctcgcgcaggcggtcgcgggcggtgccggccagcaccacgccgaagccataggtggcgtcgcgcggattctgttcgaacacccgcacctcggcatccgggcggctgcgcttgatcagccgggcgaagaacaggccggcgggaccaccgccgacgatggcgatcttcatatctgaggctccttcactcgcatggccgcgatcaggcgagcgcgtcggaggcggcgggggcgcgctcctcgcgcaggatccgggcgatgcgttccttcagcaggggtttggacggcttgcccgagccggtgagcgggaaatcggccaccgtctcgatccgctcgggccatttgaacttcgccatgcccaggttttcgaggaaggcaccggtctcgcgcaggtcgggggccgtggtgccgggcaccggcacgacgaaggcgcacatccgctcgccatagagcggatcgggcatcggtacgcacagcaccgcggcgatccgcggatggccgagcaaagcgcgttcgacctcggaacaattgatcttctcgccgccacgactgaccacatccttcacccggccgtcgaaggtgagatgcgggacgccgccgatatggcggatgctcatcagatcgcccgatttgacatagccgtcggcggtgaaggcctcgcggttacgctcttccgcgtcgtaatagccgcgggtggagctggggccgcggaagaccatttcgccgatcacgccgtccggcagcggctcgccggtctcgggatcctggatgcggatgtcggtcagcggatcgatcggccggccgaccgtgtccgacaggatgtcgaggccgtcgccggcggcgctgtagcagatgatgccctcggtcatgccatagagcgtgacggtgggcgcgcccagcttctcggccagcggccgggcatttccggcggcgatctgcagggcggcgcgcagatccccgacctccagcagatcggccgagagcaggcggtacatcagcgggccgggcaccgccatcagcgtcggccggcgggcgcggatcagatcggccatgatctcgggcgtcggcaccggcatgcacacgacctcgccacccgcccagaaggtcgagccccaatagcagacgatgggggcgttgtgcatcatcggtgcggccgagaacgacaccgtccggtgatccagcccgtgaaaggcgccggcactgcggatctgccagagatattcgttgtggaagcgcgggatgatcttgggaacgccgctggtgccgcccgagagctggaacaccgccacctgcgctggatcacgctccaccccggccaaccgctcgcgcgccgtggcggtgtcggtcgcatcgatcagcgcctggaggccgtgaaagcccgggcggtttccggtcgggccacgggcgacgatcacgtcgtcgagcccgggtgccacctgccgcatgtcttcggcgaagccggcggcatcgaatttggcctcgtcggtgcagatgaaatgtgcccgggcgccggaatgctgcgccagatagccgatctccagggcgcgatgcgcggtcagcgtgcagaccgggatcacccccgccttcaggcagccgagcaggcagagcaccagctcgcggctgttggcgatctggaagatcgcccggtcgagcggtcgcagacccagcccgagcagggcgccgccgaggcgggtcgacagggcatccagctcccccagggtccagctgccgtcgggatcggtgaccgccacccggtcgggatggcgtgccgccatctgctcccaggcttcgggcatggtgagggtgtcgaagaggccgagcgcatcatagcgggcggtgtcggccgccgacggatagacgacacccgggatcggggtccggacgctgggcatggtttcctcccgtgtctgttcttggatcagaccatagcgctctccggcgtcaggaatcaacgataacgtagattattcttcagattcgtagaattttgtcgatcagagcatctgctccagccgtccgatctggttgcgcatgccgtcgagcagggcgtcgatcgagccggccgggctgtcgctgcggtcggtttcgagcgcgcggaccgccatgtcggcgaagatctccgccagttcggccggggccggcggccggtcggggctgtgccattgcgccgtccaggcggccatgccgatcacggcgagggccgccacccggtcgtcgaccgggcggaacacgccggcccggatgccgtcgcggatgatccggcggcaatcttccagatagcggcgcttcgatgcggcatggcgcgcggcgagcgcgggcggcagggcggcctcggtgaccgcgatcatccgcatcagcacctggcggtcgatgacgctgacgacatggcggcgcaccatgtcgcggagttcttccgccgggcccgccgccgcgcggtcatggcagccaagcagggtctggatcgggcgttccgacacctcggcgacgatcgcttccagcagcgcctccttgttctcgaagtagtagtagatcgccgcccggctcaaccccaccgcatcggcgatgtcggtcaggctggtgccgtcgaagcccttgcgcgcgaacagcgtgcaggccttgtccttgatttcgcgctccagcagggccttgcgccgctcccgcaccgtgccggatccggttccgtccatctcgctcatacctgtctcccatcgggggcgtcgctcgggaaattgcgccgcgccgtgtcgtggctgttgacatcctcgcagattttaaacgagatagttaaaagtttcacgcaaacgtagatttgcggaacctgacgggagaaaacgaagatgatgggcacatacaaacgcctccgcatggctgcggtggtgacggccggcttcacccttgcggctttcaacctcgcggcgccggccgcggcgggccagacgctcacttacagcgaatacggcaccgaacgcggcgttcagggcatcgtgctggcgaaattcgccgaccagctgcgcgaggccaccgatggcgcgctgaatgtgcggatcacgtatggtgctgcgctgatcgcactgcgggacgtgctgcgcggcgtcggtgacggggtggccgatatggggaccgtggtcggtgtcagcacgccggcggagctgttcaactttcgggtcggcgatctgccgatgggcagttccgatccctgggtcggcatgaaggtgatgcaggaactggcggcgaccaacccgacgatcaaacgggaattcgccgatcagaacgtccggctgatcgccaatttcaccaccacgccggtggtgctgatctgcaccagcccggtgaccggcctggcggatctcaagggccggaaggtccgcgccaacccgccgcattcgctggcattcgaagccttcggcgcgatcccggtgtcggtcgccttcaccgatgtctaccagtcgctggatcgggggttgatcgactgcgcgcagacctatgtcaacgccatcatccccttccgccatttcgaggtggcgaagcatgtcaccatcctggatttcggccagaatctggctttcggcgtggtgatgaacgagcgcagcttccgccgcctgccggccgaacgtcaggcggcgctgctcaaggccgcagacgcgctgtccaccgccggcgcccggctcaacatcgagacgatcgcctcggcgcgggccgagcttgaaaccagccacggggtgaccttccacaccctctcgcccgaggatcacgcccggctgctggaggcggggaagatcaccgtcgatgccttcctggagaagggcgatccggcggtgctcgaccagttcaaggcgctgcaggcgaagtatcaggccgagctggcaacggagggctatccgtggacgcgcaagtgagcgcggccgtccggccggtgccctggctggatctggccgaaaaggggctgggcgcgatcggcgtcgcggcactcgccttcagcgtgatctatgtcggcatcgcggtggccggcacgctggtgggcctggtgccgccggacgaggacctgctggtggccgaggccatggtggtcgtggccttcctgccgcaatggctgctggtccgccgccggcgccatgtggcggtggaggcgctgacacgggccctgccggcgggggtgcagcgggcgctcgatgtcttcgcggcgctctgcggcatcgccgcctatggcatcctcggctgggcggcctggatcgccttcgaccgggcctggctcagcggctcgctctatatcggcgagcttgaactcatggcctggccggggcggctgctggtggtcatcggcctggcgggcggcctggcggcctgcctgctggagctgttgcgggcggtgacggcaggggcggccagggcggaagggcaggccagggaagggggaccgggagatgaactcggcctatgcgatcggcgccagttttctggccgtgctcggcttcgtggggctgcgcgttcccatcgccttcgccctgatcctgggggcggtggccgggctgttcctggtctatggctggtacccgggcgaggccttcgatcccgaagccgcactccggccgatgatgtcggtgctggccgacgtccccttccgcttcgtccacagctatgaactcagcaccatcccgctctatatcctgctgggtgccgtggcgcataaatcgggcatcaccaccgatgttttccggtcgatgcgggtgctgctgggccgcatgccgggcgggctggcggtcgcctgcatcttcggctgcggcgggttttcggcgctgtcgggatcgagcctcgcctgtgccgcggccatgggccggatctcgatccccgagatgatcgacaacggctatgaccggcggctcgccgccggcacggtggcgatgggcggcacggtcggctcgatgatcccgccctcgatcccctttctgctgttcgcgatcctggccgaggtgtcggtggggcagctgctgctggccggcattctgccggggctgctgaccctgctcggctatgtgatcacggtgcagatctgggtgcggctgcgccccgaagcggcgcccgggcgggcggtacgggtctcgggccgcgacatgctgggggcgatcctcggcctctggccggcgaccctgctgttcgcgatcatcgcggtcggcatcttcaccggcctgttcaccaccatccagtcggcggcggtgagcgtgatcgcggccaccctgatcggcatcgcccgcggcgcgctccgcctcagcgacatgtacgaggcgctggaggaggcggtctcgcaatcggcccagctcttcatcatggccttcggcgccaaggtgctgatcaccctggtcgccgcctcgaacctcacctccggcctgatcggctggacccagcatgccgggctggagccctggcagatcatggcggcgatcatcgtgctgttcctgatcctggggatgttcctcgatccctcgggcattctgctgctgatggtgccgatcaccctgcccatcgtgtcggatctgggctacgacctgatctggtatgcggtgatcgtggtcaagctgctggagatcggcttggtgacgccgcccatggggctgaacgccttcatggtcaatgcctcggtgccacgcagccatgcggtggatctgcgcgaggtcttcgccggcatcgcccccttcctggtgctggaagcggtggtaaccgggctgctgctcggcttcccgatcatctcgctgctgatcccgggcatgatgtgacctccgcccgtcccgctgccggtcagcggatcttttccgcaaacgaccaggcgaggtccgccagcggcaccgccttgcggccgacctcttcggcatcggcattggcggcggtgccgtcctgcgcgcggcgggcgatgccctgcaggatggcggccaggcggaacaccacatagacatcccaggacggcgagggcgcaaagccggtgcgggccagccacatctccagataggcgcgttcgtccgggatgccggcggcggcgaaatcggtgccggccaggccgcggaacaggcccggggcgatgcgccaggtcatcatgtgataggcgaaatcggccagcggattgccgagcgtcgacagctcccagtccagcaccgccaccacccggggttcggtcgggtggatgatcacattgtccagccggtagtcgccatgaaccaggcgggtgtcgtcttccgccggcacatgttcgggcagccattggatcagccgttccatggccggattggccacggtctcggatgcccggtactggcgggtccagcgggcgatctggcgttcgacgtaattgccgcgccggccatgatcgcccagcccgatcgcatccgggtcgagcgcatggatgcgggcgatggcgtcgttcatcgacgagaagatcgcgccgcgctcggccggggagaggtcggggagacgcggatcccagaagatccggccgggcacgaaatccatcacataaaacatcgatctgaacaccgccggatcggtgcagagcgcatgcaccggcggcaccggcacgcccgtgccctgaagtgcggccagcacgcggaattcgcggtcgaccgcatgggcggagggcagcacctcgcccagcggcttgcggcgcagcacataggttccggcctcgctccggatccggaaggtcgggttcgactggccaccggcgaagcgctccagcgccagccggccatgccggccggggacgtggtcggcgaaccaggcttcgagggcttcggtgtcgggtgtggtggtctcgggggtgatgctcatgggccggcggctcctgcgaccttgttttggtcatcagtttacccgtgggtcgagccgggttccagagggttgcgggagggggtcccccggcgcagactgtgcacccacatccggagccccgcccatgacctggtcccccgcccgatatctgaccttcgaggccgagcgcacccgcccggtggtcgatctgctggcccatgtgccgaccgatccggtccggagcgcggtcgatctgggctgcggcccgggcaattcgaccgaggtgctgatccgccgctttccgggcgcgcgggtgaccgcactcgattcctcgcccgagatggtggcggccgccagggcaagattgccggatattgatgtcgcgcaggatgatgtcagccgctggcaggcgaccgggcccttcgacgtgatcctgtccaacgccgtgctgcaatgggtgccggggcatgacgtgctgctgccggcgctggtggaacgcctggccccgggcggcagcctggcggtgcagatgcccgacaacatggccgaacccagccatgtgctgatgcgcgaaaccgccgccgaaggcccatgggccgaccggctggcgggtgctgcccgcgcgcccctgccgcccgccgcctggtattaccagctgctgcgcaatctggcgtcccgcgtggatatctggcgcaccacctatatccacgtcctgcccggcgggccggatgcggtggtggagtgggtgaaggcgacggggctgcgccccttcctggacccgctgagcccgggtgagcgcgacgacttcctgaaccgctaccgtgcgaagatcgccgccgcctatccggcgcttgccgacggtacggtgctgctgcccttcccgcgcctgttcatgatcgccacccgctgagccggagccccaagccccatgtccgacgagctgatcctttacaccaacccgcaatcgcgcggcatgatcgcgcgctggatgctggaagaggtgggcgtgccctatcgcatggtggtgctggagtatggcgcgccgatgaaggcgcccgattatctggcgctcaaccccatgggcaaggtgccgaccctggtccataacggcgcggtggtgaccgaatgcgccgcgatctgcgcctatctggccgaaaccttccccgaagcggggctcgccccccgtccccatgaacgcgcggcctggttccgctggctgttcttcggcgcggggccgctggaggcggcggtcagcaaccgcgcactcggcatcgaggtgccggcggaacgcgagcgcagcatcggctatggcagtttcacccgggtgatggacacgctggaggtggccgtttccgccagcccctaccttgccggcgaccgcttcaccgcggcggatgtgtatctcggcgcccagatcggctggggcctgcaattcggcaccatcgaccgacgcccggcctttgaaacctactgggcccgcctggccggccggccggcgttgacgcgggcctcggcgaccgacgacatggcggggtaggcatggccgtgggctatgtcagtcaatgcgccggtacaagctcgatgcgataaccatcgggatcttccaggaaggcgatgatctcgcccagcccgccccgttgcggcgaaagatgggccattggtccagccgggcggatcaggtttgcgcccctggcttcgagacgggcgcactgcgcgtaaacatcgtccacggcgattgcgatatggccccaggcattgccgcgatcataggcggtgatgtcccaattccaggtgagttcgacggtcgccccggtcgtctcttgaccataccccaggaacgccagcgtaaagcgtccggttggatagtcttcgcgccggaacaatgtcatgcccagcacttgcgtgtaaaaacctatggaacggtcgagatcggcgacccggatcattgtgtaggcaacgcgcatgacgcggctcctcgggaaactggtcaggtagcgggctggtccggatggcgggggagaagcggcaggctgccgggaaagtcggccctgccggtcagaccacctgtctgccggatcgggccgattggcgacctggcctgccgccccactgcgcgcatcagtcaagcgcgggccgcgcgcaacggcaggtcacccggctgaaatcgcgtcgcccagttcggcattgctcaaggccctgccaccgagattccaggttccgtcgacggcgtggacaccatccgaccagatgcgatccttgctgagcacgccgccggacaattcgtgcaggatttcagtcgcgtcgcccaggaaggcggtctggatcgcgcgatccgcgagcgcgaatgagggggtcttggtctcgatccacgcgccgtcgaccggcttgccgccggcgtaggttttgcccttgggcagcacgttgacgtgcgaggtgacgttgggggtcatgacgctgtttccggcgagtccgtgatggcgcaggaacgacgcgacgatgcgctccaccgcaacgccttctttttcggcgggaatgacgccttcggtcagtgtgaggacgatgggcatggttttcgactttccgtggggaggcaggttcgggcgctgcctgtcgcaggcggacgttacgtaacgaccgtgatgcaactattgaataacgatcgttattctgtcaatgtcaaaaataacgatcgctatgagaggacgctgatgcgctactcggaccgtcagaaagccgaggcacgagaccggttgctgaatgccgccgggcgtgcattccggcgcgagggctatggcggaatcggggtcgatggcctcgccagggaagcgggtgtcacctccggcgccttctatgggcatttcaaatccaaggatgaggcattcgccgaagtcgctgttgcgggcctggaacagctggaggcggcgatccgggatctgcaaacggcccatccggacgactgggcagagcgcttcatcgatctttatcttggcgagcgactggcctgcgacctggatgtgagctgtgcgctccagagcatgacgcccgatgtcatgcgatccggtgaggcgacccggcagcgctacgaggtggttatccaacgcatcgtcaagctggtggcaggcggcatagccgggcccacgtcagaggcatcggaacgcatggccattgcgcttctcgccatgctgtccggcggcgtgacgatggcgcgcagccttggatccgaggcaatgcgtgcggcgtttgcgcggcaactcaaggacgccgcgaagcagttgctcaaatcggactgaggacccggcgcccgttcaggctacggaagccgcgagaccatcgtccgggcgcgccgccgcagcacccgccacccgccccagcgtcaccgcggtgagcaggccgttgcccgagagatagcccgcggctttggaccccgagacaccgcaggcggcgccgccggcggcgtagaggttggggagggggtggcctgaggtgtcgaggacgcgggccgtggcgtcgacgaccaggccgccctgggtatggaagagcgcgccggtgaccttgaccgcgcaatagggggcggcgagcgggcgcgtggtggtgaagtcgcggccgaaggcgtcggggatggtgccggcgcgggccgcgtcgaccgcggccatggtgcgggtgagtgtgtcggcgggaacgttcatgcggcgggcgagggttggcaggtcgtccgccgtgatcacggcgcccatggcctcggcgcgcttgaaatcttcgaactggcgggtgatggcggcgatgcggccgtcgaacaccgtccaggcgaggccgtccggctggcgcagcacctcggccgcctgttcggaatagccggtggcctcgttggagaagcgctcgcccgccagattgacctgaatgccgccctcggtgatcgtcgcccagctgatcaggatgccgaccggatgggcgaccgagccatggccctgatggccgggcagatggcgggtggcggcgcccagcgcctggccccagagcagcgcatcgcccttgttgccgtcatggccgaaatagagcgcatcggcgagcgacgggatgtgctcgcgcaccagcgacttgttgccgccatagccgttgcaggccaggatcagccggccgcagccgacctcgtcgaccgagccgtcgggccgggtgaaggcgaggccggtgacgcggcccgccgcatcggcataaagccgggtgacggtcgcctcgcacaggatgtcgatgccggcggcctctgccgcaccgcgcagcgcatcgatcaactcctcgcccgagcgggtcggcaggccgtgcatgcgccgggcgctgtggccgggatagctgaaatccgccaccaccgagaagggcaggccgtagcgcgcgcccagccattcgatggcggggccggcttcgcgcgtcaccagcgccaccagatcggggtcgggctctcccttcgccttggccatgatgtcggcggcgaaggcctctgccgtgtcggcgatgccggcggctttctgccaatgcgtgccggcggccgggatcagcccggcggagagggcggtggagccgcgcggcacgacatcgcgttccagcaccagcacctcggcacccgcctcgcgcgccgccagcgccgcaaccagaccggcggctccggcgccgaccaccaccacgggcacggtgaattcgaacagcttcgtgccgtcccggaccacctcgctcaccatcagcctccctgcttgcccctaccggaccccgttgtcgacaggaccgcaacctgttgcatgaaacggagtgtaacctgtatcagatctgatacaagatttgtcatacgcgggtaaagcgtcgtaggcttgatgacaggcagatgcgccggggaggacggatggacgggaggttggcctttacgccggtcaggctgggcgggcttcggctgaagaaccggatcgtattgccgccgatgcagcagtatcagggtacggccgagggtttcgccaccgcctatcacctgcaccattatgcccggcgcgcccggggcggggtggggctggtgatcctggaatcgaccgccatcgcgccggaaggccggctgatggccgatgacatcggcatcttcacagccgcgcatatcccgtcgcttgcggcgatcgcagaggcggtcaaggccgagggcgtgccggtgatggtgcagctgagccatggcgggcggaagtcgcggccacagggcggcggccggctgctggcgccttcgccaatcccgtacagtgcagattatggcatgccggaggcgatgaccgcggtcgacatcgaccgggtggtggcggccttcaccacagcggcaaagcgcgccctggccgcgggattcgacggcatcgagctgcatgccgcgcacggctatctgctgcaccagttcctctcgcccctgtccaaccatcgcaatgacggctatggcggcacatccgacggccgggtgcggcttctggccgaggtgctggctgccgtgcgcgatgcggtggggccggatgtgccggtcaccgtccgggtgtcggccgcggattacgacccgggcgggctgacggcggccgaggtggcggagatgctggccgggctggtggggcaggggctggacggcgttcatgtctcgtccggcggattgacgccgacaccgcccgatgcgaccggccccggctaccagctgggcttcgcccgcgagatccgtgaacgcaccggtctgccggtgatcggcgtcggcaacatccgcggccgggcacaggtggaggcggcgcttcagggcggtatggccgatctggtcgcgatcggccggccgctgctggttcaccccgatctggcgcgggtgttgtgacagccattgcggtgcaggcttgacaagcagggtactgcggttcgaataatacaggcagctgtattatgaatgggacaggagaggggccgcatggcgggggtcgagccgttgaaggcacgcaggctctacctgctgctgcgtgaccgcatcatcagcggcgaggatcgcccgcagacccgcctgcccagcgagccgatgctggccgaacagcatggcgtgtcgcgggtgaccgtgcgccgggcgctggacaagctggccggcgaagggctgatcgagcggcggcccggatcgggcaccttcgtggcggggcggcgcacagaggcgccggtgacggcggatttttccaacctgctgacccatctggtcgaaatgggccggcggaccgaggtgcgcctgctgtccttcggctatgtgacgccgccaccggcggtggccgaggcgctgggcctggcggcgggggagcgggtgcagcgggcggtgcgcctgcgcctgatcgacggcgcgcccttctcgtatctcatcacccatgtgccggagcgcatcggcgtgtcctattccgaggcggaaatggcctccacgccgctgctggaactgctggagcgatcgggcatcgtggccgaccgcgccagccagaccatcggcgcgacacttgccggccccgacctcgcggaagcgctggggctggaaatcggtgcggccctgctgtcgatgacccgcgtggtgcaaggcgtcgacggcgagggcatcgagcatctgcacgccttctaccggcccgatctctattccttccggatggatctggtgcgcaccgggccgggggatgcccggtcgtggacaccggtggggccggcccgcaagggcgccacccgatcccgcggccaggccgcggcgcgggcggagaccgaaacccatcagcggcggagcacggtgcggcgggggagcacgccgcgcaagacgacgccgtgatcgaagcccgccccccaagagggcgggacgggatcgacacacaaaagacgatgacagcggccggcggtgggacgacggccggcagaggaggcacgatcatgactttgttcgacaaatcgatcagccgccgtaccgcgctgaagggcgggatggccgcggcggcggtgatggcggcaccggcggtgctgcgcgctgccgaaccgccggcggtgaagatcggcgtgctgcagccggtgaccggcgcgctggcgatggacggtgaattcggccgcacgggcgccgagcttgccatcgccgacatcaacgcctcgggtggcatcaaatcgctgggcggtgcgaagatcgagatggtcttcggcgatgcgcgatcgaaccccgaagtcggcgtgcaggaagtggagcggatgcagagcgagggcgtggccgccgtcgtcggcggctttgccagcccgatctgcctggccaccacccaggcggcggcgcgctatgacctgccctatatcgttgatgtcggcgtgtcggaccagatcatcagccgcggcctgaccaataccttccgcttcgcccccggtttcagcatctgcacccgcaccgcgatcgacaatctggtgcggatcaacaacgccgccggccgcccggccaagaccgtggcgctggtgcatgaagacgggctgttcgggtcgggcctggccaagctgatgcagaccgagctgcccaagcacggcttcgagatccttgagaccatcgccgtgccgacgccgtcgcgcgatctgtcgaacgtggtgctgcggctgcggtcgctgcgcccggatctggtgatccccagcacctattacggcgaaaccgtgctgctggcgcggaccatgcagcagcagcgcgtgcggccgaaggcggtctatgccgtggtcaatggtgcggcatcgaatatgcgcttcgtgaaggaattccccgaagcggccgagaacatcatggacgtgaaccactggcacgatccgcgcaatccgaagaatgccgcgctgcagaagcgggtggccgatgccggcaagcagtggaactacaacaccccgctcaactattcctgcatgatgctgctggccgatgcgatcgagcgtgcggcgagcgccgatcgcaccaagatcatcgaggtgctggcctcttcgaccttctcggaccatctgatgccctatggcccgacgaagttcgagggcgggcagaaccagggtgcggcaccggtgtcgacccaggtgcagaagtcccagatccgggtggtctatccggaaagcttcgcggacgccaagccgatcttccctgtcgagagctgatccgggcgaccgggcggcgcctggcctctgccggcgccgcccggtccccgtttgccgaaacggatcgcacgatgtactcccttcccatcgtcgcggaagccatgctgaacgggcttctgaccggtgcggtctatgcgctcatcgcgctgggtctgacgctggtgtatggtgttttgcacatcatcaattttgcgcacggcgccctgctgacctgcgcgatgttcgccgtctggctggtctacaccgccttcggcctggatccctatctcgcgatcctgccgctgacgctggtctttttcgccatcggctatggcgtgcagcgcttcatcatcgggccggccgcccatggcgatgacggcaatatcctgctggtgacgctgggcctgtcgatcgtgatcgagaacgtgctgctcgcggtcttccagtcggatacccggtcgctgtcgaccgattattccttccaggtggtggagctggggccgctgctgatttcccaggcccggctgtatggctttgcaggcgctgtggtggtgagcgcgctgctctggctgctgctggcacgcaccgataccggcaaggcgatccgcgcagtggcgaaagagaagctgggcgcacggctggtcggcatcaatgtcgcccatgtcttcgccgtcaccttcggcctgggttgcgccacgctcgccatcgccgcctgcctgctgatgccgaccttctacgtcaacccgcgcgtcggcggcgccttcgtgctggtcgccttcaccatcgtggttctgggcggcatggggtcgatcaccggcgcgctgctcggcgggctgttcatcggcgtggtcgaaagcctgtgcgggctgtatctgggcgaaagcctgggccagatcggcatcttcctgatcttcatcctggtgttgctgttccggcccaccggtctgttcggagcaagggcgtgatgcgacgcggctatcttcccatcgccctgatcctggtggtgctggcggccctgccgctggtggtgacctccaacgtcatcctcaatttcgtcgtcttcgtgctgatcatcaccctggtggcgcagggctggaacctgctgggcggcacgggcggccagtcatcctttggccatgccgcgtttttcggcaccggcgcctatgcctcggccatccttcagacccgctatggcgtgaatgcctgggcggcgatggcggcgggcgtgatcgcgggcgccgtggtcggccgggtgatcggctatctggccttccgcgccgggttgcgcggatcctatttcgcgctggtgacgctggccttcgccgaggtgctgcgcattctggccaatgcctcgggcttcaccaatggggcggccggtctgctgctgaagctggatgtcggcttctggaacatgcagttcagcagccgcggcgcctttctgtggctggcgctggcctttgtggccgccggtctggtgatctgccagatgatcgccaattcccgcttcggcgcccagctggtggcggtgcgcgagaacgaggaagcggcgcgggcgctgggcgtcgacgtgctggcggtgaagctgcgggcgattacggtctcaggcgcactgaccgcggccgcaggctgcctctatctgcagtatttcctctacatcgatgccaacatcgcctacgggctgtggatttcggtcgaggcgctgctggcgccgatggtcggcgggcgcggcctggtgctggggccgatcatcggcgccttcaccctgcacgggctgggtgaggcgaccaagatgttcaccggccgggtgccgggcatcgatctggcggtctatggcgcggtgctggtgctggtgatcgccttcgctccgggcggtgtgctgggcctgctgcacaagctgcggcgcggcgggcgtgccaaaggaaccggaaccggcggggagggcgcgtgatgctggaagttcaggacatcaccatgcgcttcggcgggctgaccgcggtgggcggcgcctcgctgaaggtggtgcccggacggatcgtcgggctgatcgggcccaacggcgccggcaagaccacgctgttcgcgatcatcgccgggtttctgaccccgaccgccggccgggtggtgctggaagggaccgacatcaccggacggcctgcgcacgaacgtgcgaaactcggcattgcccgcaccttccagatcgtccagcccttcgccgggctgaatgtgcgcgagaacatcgccgtcggcgcctatctgcgccatgccggtgccgccgaggcccatgcccgggccgaggccgtcgcccgccggctggggctggggggggatctggacaagccggcatcgagcctgacggtcgccggccgcaagcgtctggaactggcccgggcgctggcgactgagccgcggctgctgctgctggacgaggtgctggccgggctgaacccgtcggagatccgcgacatcgtcccggtgatccgcgcgatccgcgacgagggcatcaccatcctgatgatcgaacatgtgatgcaggcggtgatgaacctgtgcgacgaggtctatgtgctggcccagggcgagatgatcgcagagggcacgccccgcgaggtctgcgtcgacccgaaggtgatcgaagcctatctgggccgcggcgccgcggaacggctgaaggcggaaggggcacggccatgaccggggggcaacacgtgctggaggttgagggcctgaaggccggctatggcggggtggaggtgctgcgcggcatcgacctggcggtggggccgggcgagatcgtcgcggtgctgggatcgaacggtgtcggcaagaccacgctcaacaaggtgctctcgggcgtgctgccggcgcgcgcaggccagatcaccttcgaaggccgccggctggacggcgtggatgcggcggcaatcgtcgaggccgggctgatccaggtgccggaaggccgcaagatctttcccaacctcgacattcaggaaaatctggaactcggcagctatcgccgggcgcggaagaaccgggcgcgcaatctggaacgggtctacgagaccttcccgcggctgcgcgaacgccggacccaggcggccggtacgctgtcgggcggcgagcagcagatgctggccatcggccgcggcatgatggccgagccgcggctgctgatcctggacgagccgtcgctgggcctgtcgccgctgctggtcgaggaaatgttcaccctgatccgccggctgaatgccgatggcatgccgatcatgctggtggaacagaatgtggtgcagtcgctggagatcgcgagccgcgcctacatcgtcgagaacgggctggtgaccatgtcgggcaatgcggcggaaatcgccgccgatcccgagctgcgccgcgcctatctcggattgtaaggagccgcccccatggccatcgtcacccccggtgtcgtgccggcctcggttctgctggcagagccgcgtccggcctggctgaagcgcttcgccgaggcggcaaccaccatccgcttcggcgatttcgacgccgatttgtccgctcaggcgcggctggtggtgctggactgcctgggcgccatcgccgccggcatgcaggaacccgagatgcgggcgctgaccgcgcgcctcgcccgccgcggcgggcgggtcacggcccccgccgtgggcgccgggctcgccctccgcgccgatgatgcggcgctggccaacggcatcgccggcaccatgctggaactggacgagggcaattccttcgcccgcggccatcccggcatccacgtgctgccggccctgctggcggtgcggcccctggcggaggtgtccggcccggacttcctgcacgccttcgtcttcggctacgaggccggtgcccggatcggcgccgcatcccggctgcgcaatgcgctgcacccccatggcacctggggcaccgtgggggcggccgtgggcgccgccctgctggacggcgccggggcggaagaggtgatcggcgcgatcaacctctcgtccagcctgtcggtcggctccagcctcaggaccatgctggagggggcgacggtgcgcaatgcctatgccggcatgtcggcacgcaacgggctgaccgcctgggatctggtgacggcaggcttcaccggcgagaccgacggggtgcgcagcgtgtatggcggcgtgctggccgaaggcttccgccccgaggagatggtggcggaactgggcacgcgctgggagatccggcgcaactacttcaagcgccatgccgcctgccgcttcacccatgccgccctcgacgtggtggcggggctgatcgccgggcacggcccgatcgcgcccgaagcggtggccggcatcgaggtggtgacctatgtctgggcggcgcagctggacggggcccggcccgacaacatgctggcggccaagttctcggtgccgttcgcggtcgccaccatgctggcccatggggctgcgagcgtgccggccttccgggcaccggcgctgaccgatgcgcggattctggatctggccgggcgggtgacggtcgacgaggacccggcgatgagcgccatgctgcccgaccggcggccggcacgggtcaccatccgcctgaccgacggccgggtgctgacggccgaaaccttcaccaatcgcggcgatgccgtcgacccctacgggcccgacgaggtggtcgcgaaattcatggaactggccacgcccgtctggggcgcggcccatgccacccgcatcagggaggcggtcgacggcctggaccgggccgccgatcttgcggatctggatgcgctgctcaaagagccggcgcgcgaggaacattgagatgagcctgaagcagagactgacgaccgccgcccccgtggtcgcccccggcgtctatgacgccctgaccgcatcgatcgccaccgctgccgggttcgaggcgctgtacctgtcgggtgccgccatcgcctatacccgcctcggccgccccgatatcgggctggtatcgatgagcgaggtggccgaggtcgtcaccctggtgcgcgaccgcgtgccgacgccgctgatcgtggatgccgataacggctatggcaacgcgctgaacgtgcagcgcaccgtgcgcctgttcgaacgcgcgggcgcgaccgccatccagctggaagaccagaccctgcccaagcgctgcggccatcttcaggacaagagcctgatcacggccgccgagatggccggcaaggtgaaggccgcggtcgatgcgcggcagagcgacgagaccctgatcgtggcccgcaccgatgcggtggcggtggaaggcttcgaccgtgccatcgaccgcgcccatctttacgccgaggccggcgccgacgtgctgttcgtcgaagcgccccgatcgcgcgaacagctggtggcggtgacccgctcgctgggcggtatccggcctttgctggtcaacatggtcgaaggcggcgacacgccgcttgccagcgccgaggatctgggcgggctggggttcaggatcgtgatcttccccggcggcatcgtccgcgcgctggcccatactgcccaggcctattaccgctcgctgaaggccaacggcaccaaccagccgttcaaggaccggatgttcgacttcaacgccttgaacgcgctgatcggcacgcccgagatgctggcgctggggcggagctatgaagagccggaagagggggcggtggcgtaaccgcgccccggacaccgcccgagagaaaaccagggaggcagatccatgccggtcgtcgagaccaccgtcatcgaaggctatgacgccgccaccaaggcccggctgctgaagggcatgacccgtgtggtgcggtcggtgatggccgcgccgccggacggggtggtgaccatcctgcgcgaggtggccgccagttcctatgcccgcggcggcgtgtcgcgcgtgcccggcccgccgctgccgccggcaacggatctcgccggggcgctggcggcggcgctggggcgcggcgatgtggcggcggcggcgccgctggtcgccggggacttcgtggcggtgacggcagagggcgcgcggctggatctggcggcggctgctgctgcggatgccgaagccggtcggcgctatgacggcttcgtcgaggcgctgaccgatgatggcagcctggttttcggccatgggcgtcttgccgacggccggcgcttcatcgaccgcttccgcctggccgggccggtgatcgccgaccgcgagagctggtgagcggggtggaggccgggacccttccggtcgtcgtcgtcggggccggtgccgccggcctgaccgcggcgctggccgtccgcgatgccggggcaccggtggtggtgctggagcgcgatgcggtgcccgccggcaacaccgcgctgaccctcggcatgctgccgggggccggcacccgctttcagcgcgcggccggcatcgaagacgatgcggcgctgtttctggccgatatcctggccaaggccaagggccggaccgatcacgatcttgcccgggcgatcaccgcggcctcggggccggcggtggaatggctggcggatcgccacggcgtcgccttcgagctgctggacgacattctctaccccggccattcgcgccatcgctatcacgtgccgcccgaccgcaccggcaccgccttcatggccgatctgctggcggcggcgagccgggcgggggtgcagctggtgacggaggccatcgtcgaggcgcccgagacggatgcggacggccgggtcaccggggtggtctggcgcgacgatgccggacggcggcatcacacggcctgccgggcgctggtgctggcgagcggcggctatggtgccgacccggaggccgttgcccgatacatccccgagatggccggcgcggtccatggcggccatcacggcagccgcggcgatgccctcgtctggggcgagaggctgggcgctgccctggtcgatccgggcagctatcagggccattgcgtcgccgacgggccgaacctgccggtgacctgggcgctgatcatccgcggcgggtttcaggtcgggtccgacggccggcggttttccaacgagatgagcggctattccgaacaggcccatgcggtggcggcgcagccgggcggggtggcctggacgatctatgaccggcgctgcgaggaaccggcgctgaccttccgcgactatcaccgcgtgctggagagcggtgtggtgacgacgggtgagacggtggacgacctcgcccgggcctgcggcctgccggtgggcgcgctggccgaaacgctggccgaggtcgaggcagtgaccaggggccatgcccccgaccgctttggccgggttttcgacggcacaccgcccttgcagccgcccttccgggcggtgcgggtcagggcggcgctgttccacacccagggcgggcttgccatcgatacccgggcgcgggtgctggaccgggcgggccggccgctgcccggactgttcgccgcgggcggtgcggcgcggggcctctcgggtcctgcagcctggggttatctgggtggcaatggtttgttgactgcggttgtgccgggccgtttcgccggcaccgcggccgccgcgtgttgagatgcagggagccgaaatcatggccagggttctggtgatcgtgccgtttccgatggatgcggacaatctggagatgcgccgcgcgcagctgcggtcggtgcggctgggaccggggatggatttcgacttccgcccggtccggatcgcgccggtcaattatgtcagccagcaggacagcgtgctctcggatgtgggcattctggaggccggcatccgcgcccaagccgagggctatgatgccgtctgcatcgacacggtcagcgatggcggcatggcgccgctgcgctcggtgctcgacatcccggtgatcggggccgggcgtcatgccatgctgaccgcgctgatgctgggcgaccgcttctccatcctcgccatgtgggaccgctggcggcatctctataccaagacgctggccgaactggggctgggggcgaaatgcgcctcgctgcgctcggccgatcttcagcccgacaatcagagcctgatggcgggcaaggaagaggcgttctttccggcgcttcatgccgcggcgctgcgctgcgtggaagaggatggcgccgatgtcatcgtgctcggctccaccaccatgcatcaggcccatgcctatctggccgaacgcctgccggtgccggtgatcaaccccggcccgctgacctaccgcctggccgaaatcgccatccgccagaagcttacccacagccgggcgagctttccccgccccgccgccccggccgacgcggcgctggccgccatgggtgtggcggcgacgcggctttgacagggagagaccggatgtcccggattctgatgatcttcaccgccgaccacccggcgcccgaaagtgccgaggcggaggtggtgacgctgacggcacccggtctgccggccgggctgatcagcgcccatgactggacgctggccgatctggcggtgctggcggcgggccaggatgctgcgaaccagggggcggcggcagagggctatgccgcggtctgtgtcgccgaccccggcgattacggggcgaatgcgctccgctcggtgctggatgtgccggtggtgggggccgggcggagcgcactgttctatgccctgacgctgggcgcctgtttcggcgtgctggcaccggcgggcggttacacgcgggcgaagaagctggtgcaggaatacgggctggcgacgcagtgcacgggggtacgccggatcggcgcgggcgacgacgccatcctgaccgcggcgcgcgctgcgatcacggaagacggcgccgaggtgctggtgctgtggcagccgcttacggcagccgcgaccgcccggctggccgcggacctgccggtgccgctgatcgagcccgccagcctgtcgctgcggctggccgaggcctttctggggctgggcttggcccagagccggcggacctggccgatgccgcaggtcgcgaagcctgatctgatcgcggccctggtggccgcaggggcggaggcatgatcccggcggcaccggttctgaccgaaccttccgaaaccgcccatgcgctggcccggctggcgctgacggtgcggctggacgatctgcccgccgcggtggtggcccaggcgaagcggatcctgcgcgacaccgtgggggtgatgctgggcggagcggccctgcccgagatccgcaatctggccgccatcgcccccggcctggcggtgggcggcgcctcgctgttcgggaccggcacccgggcggcggcccatatggcggcgctggtcaacggcaccggcggggtgtcgctggaactggacgagggcaaccagttcgcggtcaaccatccgggcgtgcacatcatcccggcgctctgggcgctggcagaggaagagggcgcatcgggcgccgccctgctggaagccctggttgcgggctacgagatcgccgtccgggtgggggcggccacaaagctgcgcgggccggtgcatcccttcgggacccataccatcatcggcaccgcggtgggggcggcgcggctgctgggccatgatgcggcactgacggcgcgcgcgatcgaactggcggccgggctgccgatcgcgtcctcgcagatggcggccaattccggcgcctcggtgcgcaacctcttcaccggtttcaccaatcataacgggctgctggtggcgaagcttgcccgcgccggcttctgcggcgagccgggggcgctggaaacggtcttcgggcagatcctgggcgagcggttcgggatcgccgtcgaggcacggatcgaccatttctacctcacccgcaactacttcaagatctatgcctgcagccgctggaaccatgccccgatcgaggcggcgcgcgatctgcgcgcggcccacgggctgacgccggcgatgatcgatcgggtggtcgtccacacctacgatccggcgacccggctgggcggcggccgggtggccaatgcctatgcggcgaagcactcgatcccgttcaacgtcgcggcacggctgatgcatggcagcaatgatgtcggggtctacagcgatgccgtggtccgcgacccggcgatggtcgatctgatcgcccgggtgacggtgcgcgaggatccggcgctgaccgcgctgctgccgggggtgcgggcggccagggtggagatccgtctgcgcgacggccgggtggtctcggcacaatccgacaccccgatcggcggcttcgacaacccgctgcccgaggccgatctgcgggccaagttccgccggctggcggggttcacgctcgacgaggctgcgatcgacgccctggaagccgatctggaccggctcgaaagcctggcgcggatcagcccggtctgaacactggcgtcggaaccatgtccggccatggcggtttctccccgatgatccgcaacgaggagagatcctgtatggcgaccgatccccgcaccgacaccgcccgccccgactctgcccgcatgaccccgcccgcctcgccccgccgcaggcgcgggctgatctggatcgggctgctggtggtggcggtcgcggtggtgctggcccttgcggtctactgaccggccgccatccgggtgaggagagctgtcatgaccggcaacggaccgggcggcccggataagacgggccccagctataccggcgatgagaccagccagggagagatcatcctgcggacgaagcgccgccggcagatcttcatcggcgggctgatcctgatgggggtgctggcggtggtgttcagcctgatctgacccgcttaagcccttgaaccaccgcttcccgcggtgggtggcttgacattctctccgccgggctgaatgttggccctgcctgcgcgttcatacgggcaggcagcgtgaatgtgagcccggatcaattcgacgtcgtcctgtcatcccaggcgcctgcgtccggggcagcaagctttcggcgttcagacgccggcagacaggataagatgatggaacaccctctcgcgctgaaatcgatccccgcgaacaccctgttcggggagggcgatgtcttcgtgctcttcggggaaatgttcgggcgtggctatgccaccggcctgatcgaggccgcgaaggcggccggcatgacggtcatcggcatgaccatgggccggcgggacaatggcggcgcgctcaggcctctgaccgacgaggaactggcggcggccgaggccgggcttggcgggcggatcatcaatattccgctgatggccggcttcgacatggatgccgcccccggcgagcccacgcccaccgacatgctgggcgagatgacgcttgagaactggcagggcttcaagctggaccaggaccggatcgcccgggcccgcgaggtgggcgttgcccgcttccgcgacgccgtgacccgggtgatggcagagctggacgggatgatccccgccggccgcaacgtgttctttgcccataccatggccggcggcatcccgcgggcgaaggtgttcatggcgatcgccaaccgggtctataagggccgcggcgcgcgctacatgtcgtctcaggcgctgatcgacagcgatctgggcaagctgatcctgcagaatttcgacgaggtcaccgccaacagcttcggccatctgctggagctgagcgggcccttgcgcgcccgcatcgaagccgagggcggccaggtgcgctataccgcctatggctatcacggcacccgggttctgatcgacggcgcctatcgctggcagacctataccaactacacccagggctatgccaagatgcggctggaagggctggcccgggcggcatgggacaagggcgtgaaggcggtggtgttcaactgccccgaaatccgcaccaattcctcggacgtcttcgccggcatcgagctgtcgctgctgccgctgctgacggcgctgcgccacgagggcggcggcgcctgggtcgacgacctgtggcagtattgcgagaccctgctgcaggacggcatcagcgtcgacacggtgctgcagatggtccacgactatcagcacaacccggccatgcagccctattacgatttcgccagctggcccaaggccaacagcgccgagcaggtggaacagaccgtcggcacctcgcaggacatcgtgaacctgcacaaggaccgcaagaccctggtcagcgacgtgctgagccagcatgtggtcgccgccaccggccggctgatcttcggcgccaccagcgcccccgaagcgccggtgctgtggctggaccatgacatcgtggcgcagcagctgatcgcgatgcacggcgcctgaccacgggtgcccgatatgcgaaaaggcccggccgggtaacgccacccggccgggcctttcttttttttccggtcgcctctcagcccggcaccaccggtgcggtggggaagcgcggcgggcaggtgagttcataggcgcgggccgcgcgcagcaccagctcgtcgcggaagcgggggccgacgatgtgcaggccgaccggcagcccgtcatcgccgaagccgcactgaaccgaggccgccggctgctgggtcaggttgaaggggtaggtgaagggcgtccactgcatccagtgatccagccccgagcccgggggcacgtcgtggccggcttcgaaggcggtgatcggcaggctgggggtgaccagcaggtcgtagcgctggtggaaggcggccatgcgctcgcccagcgccacccgggcatcgaccgcgcgcatatagtcgacgatgtcgatgcccgtgcccagttccgccacccggcgcagccccggatcgatcaacgcgcgctgatcggccggggtattggccaggatcttggcggcaccggcgaaccagtgggcgttgaagatctcgatcgggtcttcgaagccgggatcgacctcgtccacgatcgcgccgagtgccgccaggacctcgaccgccttgcggacctcgcgcgcgacatcctcgcggacgttcacgtaacccagggtcgggctgaaggcgatgcgcagcccgcgcacgccctggtccagccccagccgccagtcgcgagagatcggcgcacccatataccagtcgcggtcatccgcctggccgaccaccgtcatcatcagcgcgacatcggcgatggtgcgggccatcggccccagatgcgaggtggtgcccatggcgctggccggccattgggggatgatgccgaaggtcggcttgatgccggcggtgcctgtgaagccgcagggaatgcggatcgagccgccggcatccgagccctgatgcagcacgcccatattgagcgccgccgccgcaccggcaccaccgctggaaccacctgccgtggtatttacattccatgggttgcgggtgatgccggtgagcgcgctgtcggtgacccccttccagccgaattccggcgtggtggtcttgccgagcagcacggcacccgcgccccgcatgaaggcggtgaagggggcatccacctcccaggggccgtcggcggcgatggtcttcgatcccttgcgggtgggccagccgcgggtgaaggtcagatccttgatcgaggacggcacgccgtcgaccggcccgatcggccggccggccatccagcgcgcttccgacgccttcgcatcggcgcgggcgctgtcttcatcgaccaggacataggcgttgaccgcgccgtcgaagcggcggatgcgatccagcgccgcctcggtcgcctcgaccggcgaggccgccttgcgggcatagaggccgagcagttcgcccgcgccgagttcgcccagatctgtagatgagaggggggtggaggactggggcatgggctcttatccttttctgaacggcgttcaggcgtcgagcgccagatagcggtcgcggacgctgcggtcggcgcggaaatcggcattgctgccggcatagacgatacggccctgttccaggacgtaatgccggtcggccagcttctcgcagaccgcgaggttctgttcgaccagcagcaccggcacgccgctttcgcggatccggcccaggatgcggacgatttcgtccacgatcaccggcgccagcccctcggtcggctcgtccagcaacaggatgcggggggcgttgaccagcgcgcgggcgatggccagcatctgctgttcgccgcccgagagcgccttgccgccattgcgccgccgttccttcagccgcgggaacatggtgtagacgtcgtcgagcgaccagcggctgcccttgcggaccgagatcttcagattttcctcgaccgagagcatgccgaagatgccgcgatgttcctgcaccagcgcgacgccgcggcgggcgatgtcgtgcgaggggcggccggtgatcgcggtgccgtcgaagctgatcgtgcctttcgtctccaccatgccggcgatggatttgagcgtggtggtcttgccggcgccgttgcggccgagcagggtgaccagctcgccgggccgcacctccagcgacacgccttccagaacatggcttttgccgtaataggcgtggacctgatccagcgtcagcatgccccggcctcccccagataggcggcgcgcacccgcgggtcgttgcgcacggtccgggggtcgccctcgaccagcaccttgccctgatgcatcaccgtgatcgtgtcgctgatcgacatcacgatgcccatattgtgctcgatcagcatgaccgtgtagtcgcggccaagctcgccgatcagcttcgtcatcaccggaatgtcgtcgatgcccatgcccgaggtcggctcgtcgagcagcagcagtttggggcgcgcggccatggccatgcccacctccagcacccgctgctggccgtgggagagttcgcccgccgccacatcggcgcgggcgcccagctgcagccggtcgatgatctcgtccgccaccttcagatgatcgggccgggcgccgaccgggcgccagaaggcgagcgccttcgccccgtcgcggccctgcgcggcgaggcgcagattctcgcgcacgctcaaggtctggaacaggctggtgatctggaaggagcgcgacatgccgagcccgacccgatcctgcgacggcttgcgggtgacgtcgctgccgtcgaacaggatccggccggcggtcggccggcgttcgcccgtcaggcagtggaaggtggtggtcttgccggcgccgttggggccgatgatggtgtggatggtgccgcggcggatcctgaggtcgaccccgtccaccgccttgaaggcgccataggcgagttccagcccggaggtctccaggatcacgtcgccggtctgccgggtgtcggtcatctggctggtactcatgcctcgggccctccgcgccgctcgcgcagttttgcgaccacgccttcgataccgccccagaggccgccgcgcatgaagatcaccacgccgatcagcgcgatgccgagcagcatcagccagcgcggccagatggccgacagccagtcgcccagcagcacgatcgcggtcgagcccagcagcgagccgagcagagagccggtgccgccgatgatggtcatgatcaggatgttttccgacatcggcagttcgatgttcgagagcggtgcgaagtgcaggagcatggcgtagagcgcgccggcgatgccggtgatggcgcccgaaagcgtgaaggccaggatcttgaactggcgggtgtcgtagccgaccgcggccgcccggtcggggttttcacggatcgcgaccagggtgctgccgaagggcgagccgatgatccggcgcgcggccacgaacagcagcaggaacagggcggcgacgaagatgtagtacgagaccgccggttccagatcggcgatgaccagcccgcccagcgccagcggcggccggggcacgtccagcagaccgttatcgccgccggtccagtcggaggcggtataggcgatgaaataggcgagctgggtgaaggccagcgtcagcatcacgaaatagatgccggtccgccggatcgcgagcgcgccgaccagggcggcggcaagggcaccggcgatggcggccaccaccagcgccgtgatcagcccggcgcccagatggatcatcaccagcgacgacagataggcgccgatgccgaagaagatcgcctggccgaaggaaagcaggccggtatagccgagcagcagattgcaggcgagcgccgccatggcgaagatcacgatctcggtcgcgagcgtcgcagacggcaggatcagcggcagggcgatgagggcggcgagtgccgccagcgtgatgccgccgaagagagaggaggaggaagcggaggcgggagagcgtgtcgtctgcatggctcacgcccttccgaacaggccataggggcggagcaggatgaccgcggccatggcgccgtagatcatcaggctggcaccctggggccagatgctggtcatcaggctctgcaccagcccgaccaacagtccgccgaccagcgcgcccccgaacgagcccatgccgccgatcaccaccgtgacgaaggcgatgccgagcacttcggtgccgacgaagggatgggcgccgcgcaggggcgccgagagcacgcccgccagcccggccagtgcgacgcccagcgcgaaggtggccgaaaacagccggtagatgttggtgccgagcagggccacctgttccgggttctcgctgcccgcgcgcaccttggcgccgaaggtcgtgcgttcaagcagcagccagagggcgaagccgaccagggccgcgaagccgatcatgaacagccggtattccggataggcgaaattgccgaagcggaccacgcccttcagcatgtccggcggcggcaccgacttgccgaccggaccccagatcatgatcgcgctttcctggatgatcagcgcgatgcccagcgtgatcaggatctggaaggtgtgcggcaggtgatagacccggcgcaccagcacccgttcggtgacccaggcgatggcgccggcgatcagcgggcctgcgaccagcgccgcccagaaattgccggtggcggcgacgaccgtgaagcagagataggagccgatcaggaaaaaggcgccatgggcgaagttcacgaagttgagcaggccgaaaatgatcgtgagccccacggaggtgaggaaatagatcatccccaaccccagaccgttcaggatctggaagaggtagacgttgagcatgggtgaccggtctccgtcccgtgacgtcgaggcggcagggccggcccgtcagacgggcgcggccccgcggggggcgcgaagagtgtgtggtcaggccatcttgcaggcgatggcatcgccctcggggaaggacttgcccgacgagatcagctcggccagatcgtcttcgtcggccttggcggaggccgctttgcccttcagcaggtaataatccttgatcacctgatggtcggcggcgcgcacggtttcagagccggtcgggccgtcgaaactcatgcccgagagggcggcacggaccgcggcaccgtcggccgagcccgccttggcgatggcatccaggatcaccttcgtgccgatatagtcggccgccagcggatagtttgcggtgatgccataggcctcgcgcacccgggcgaccagcttcttgttcatcgggctgtcgacctggtgccagtactgggcgcccagatacacgccctcgatcacgtcggagcccagttcctggaactggtcgagaccggccgaccaggcgagcaggatggtcatctggcttttcaggccgaaattcaccgcctgacgcagggcgttggacgactggccgccgaaattcaggatcagcagcacatcgggtgccgcccccatggcattggtcagatagcccgagaattcctgttcctgcagcgaatgatagctgttgccgacatgctcgatgcccttctcttcgaagatgcgcttggcattggccagcagcgcctcgccgaagacgtattggggcgtgatggtgtaccagcgcttcgcctcgggcatgcgttcgatcagcggccggacggtctgttcgatggcgccgtaagtgggcaccgaccagcggaaggtgccggggttgcagtcggtgccggtcagctcgtcggcaccggccggggtcatgaacacgccgccggccttgtcgacctccttgccgaccgccagcgccgaggacgagagcgtgcaaccgttgaagaagcgggcgccgtcctgctggatggcttcctgcaccttgcgcaccgccttgccggcattgccttcggtgtcgatcgccttgtagccgacgggggcgccgagcaggtcgccgtaatcctgaatggcgagcttcgagcccatatcggcgaatttgccatagctggcaaaggcgcccgacagcgacttgacgccgtggatggtgaccgcatcggcggcgagggcgcgcctgcggatgatggcgggggcggcgagcagcgtgccggcggcaaggccgcccttgagcagcgtgcggcgggtggtggtgatcatcgtcatcgagcctccatgtcacgtccggggcgtgtgttccgcccctcggacccttttttgatcggaatacagcgattcctcgggtcatcctccggtgccgcccggttctggttctgacatgccgccgcgcgctctccctgcgcgggccgccggtgcggcaggtggtcgtcgtctcggagcccgccgggggtcagcccgatccgggttccagcaggaagcggcgcgcgacttcggcctcgagcgcgtcgaggtgatcttcggcgtcgcacatatggtccagcatcagccggcggacctctgccgcatcctcgcggcggagggcgtcgatcagccggcggtgatagtcgacattgttcaggccgaactgccggcgttcgggcagatagacctttttcagcacgacgacgtcgcgcagcagctcgttcaggaaccggcccagaaagccgaagatcgggttggggcagacatcggcgagcacgttgtggaaatcgatctcggcgatgcgctggatccgctgttcctcttcggtcaccggttcatgggcgcagagggcgatattggcttccagcacctcgaaatcggcggggccgagccggcccaccgccagcaccgccacctcgggctcgatgagcttgcgcagggcgtagatctggtggccgtcgggatgtcggaactgcaggaaattgcgcagcgcccgcgaggcatggtcatgggtcggccgggccagccaggcaccgccgccgggccccgtgcggctgaccaccagcccctccacctccagccccttcagggcctcgcgcaccgtgcccttggaacagccatgcagccggatcagctccgcctcgccgggcagccggtcgcccggtttcagctgctcggtgacgatccggcgcttcacatcctcgacgatcagctccgacagcttggggcgccgccgtgtgggggcgccacgcctgccgcctgccgatcgcccctcagccatatgccccgtctccgcatcgatcctatttattatgataattaggtgccgggaaaagacgccctgtcaagcggctctgacggcttcaggcgccgcctgggcgaaagcgactgcaggctgatagcgtgatcgcgtggttttttgctcccgtatactttggtagaattaaaatgatgtcggcgggtaaggtgcagtcgacgaccttggcatgatggagcctgatgatgcagatggataacttgactccggccgtggaaacggctgcggtccctgatcggggcgcctggacgcggccggtgctggaggtgctgtcggcgggtgagacggcgggcgctttcggccccgtatatgatgggagcggccagtcctgatcgtttccgggacgagatgatcactcccgaaacaaccataggaggcatagccatgcgggataaaatcgaacgccatcgtcgtcgcttccggccggctgccggtaccggctgggcgcggcccgtgctgaccgtggttctctacgaagaaaccgcggagaatcctggcgcagggggtgacggctcgggacgatcctgagatctccaccggcgggcgtgcagatgcggcatcctcgcgcataaatctggtgtccgacgtgttttgcctgttatggttgtggtctttcaggggggccttccggccgcccgggtggataacacggccggcagatgcaggatatcgacaggcaaaagcccgcccccggggtggcggccacgaccgacaggatcagtcgccggcacaagcgctggagccggcccgtgttcgacatcctgtcgctgaacgacacggcgatcagcggggccacgatatcggactactacagcctgtcctgatctggtcctggcctctccacctgagggagcacagctgcaggtaaatgaacgtgagcctgtggttgctgatcagtgcctgatgcggtatgaccgaaaaagatcggtcggcatgtgtcgccgatcggtcgccgttgtactggagcgagatgatgcagatgaacgccaagccggtgacgaccgccgcttcagttcgtggtgtctggagccggcccgagcttgaggtgctgtcgatcgacgagaccgcgatcggtgctggcgtcgtgaatgacggttccggccagtcctgatctccgtccccgatccatcgggaaagatgccgggctgatcggggggaccgcctgcatgggcagcctgatggaagtgttacgacttctgttctcgccgcgcgcacggctggtgctgatccccttcgtgctggtgctgctgctgtttgcggtggtcctcgtggccacccaggggaccgcctggtcgcctttcctgtatgccgtgttctaggccggcaaccctgtcgaaaaccaatcggacccggagttgggcatatgcaggacatggacatgcagaagaccgcgccgatggcgactgacgaggaccgcaagctgtggggccggcccgtgctcgcggtgtcggctgcgaacgatacggccttcgccgttgccggttcggatgacggctcgggactttcctgagcccgcccgtgccgacctgaacaccgccgtctgaccggggtgcgtcgatgcgtcgcgtgatgcgtgccctggtgctggtgctggtcggcatcatcttcggctgcctggctggggaagggctggtgcggctcggcaccgccaatcagaagaactacgtcatcgagatgtggcgctatgcaaagctgctgaagcgcccgagcgacgaccccgccatcggccatgaacatgtgccgggcgcatccgcgcgcctgcagggcgtcgaggtctcgatcaattccctggggctgcgcgggccggaaccggtgcccggtcgtccggccgtggtactggcgggcgacagcatgacgctgggctggggtgtggcggaaagcggcacgctggccggtcagcttgcccgccggctgggcgacgatgttcaggtggtgaatgccggcgtcggcaacatgaccgtgccgcagatcgtggcccactggctggagatccgccggcggatcggcgacgcctttccggtgcggacactggtgctgctgccctcgtcgcgcgccgggctgccgcagcccgcgggtgatgccggctggctggtgcgccacagcgagctggcggcgctgatcgcgaccttctgggcccaggcgaccagcggcgccgccggccgcgacgagatggtcgccgcctatcgcaccgcctggaccggccccgaggggcaggcgcgcattgcgcaggccttcgaccggctggccgccgaaacccgggccgacggcatccgggtgatcgtggcccagatgcccgacaccaatgatttccgcgactatgccttcggcttcgtgaccgggaccacggggcgcgaagccgccgcgcatggctgggacttcgtcgatctttacccgctgttcgccggcgagacggcggcggacttctggacgatgcccggcgacatccaccccaatgccgcggcctatgcccggatcgccgaccggctggcgccgctgctcgccgcgccggcctcgtgacccccggccaggccccatgctgttccagctgcccagcttcttcgtctttctggcggtcttcgcggccgggctggcgctctgcccccggcggctggtgctggcctatgtcttcacggccagcctggtcttctatgcctggtggtatcccccctataccgcgctgatcctgggctatgtggcggccgcctggatcggcgggcggctggtccgggcgcatccgcggctgctgccggtggtggtggtgacggtgctgctgccgctgctgctgttcaaatacaccgatttcgtgatgacgacgctggaagagctgaccggcgccgggctgccgcatctcggttggggcctgccgctgggcgtgtctttcgtcaccttttcggtgatcagcctgctggtcgataccgcgcatcacccgaaacgccccttcccgcgtttcggcatcgttgcggtctatgtcaccttcttcccgcatctgatcgccgggccgatcctgcgcctgcacaagatggtgccgcggctgtcggatatccggatcgatcgggaggcgttcacggcgaatgccgggctgttcgccatcggtatgatgaagaaggtgctgatcgccgacccgatcgggctgtggatcgacggggtgatcacggaacccggacagctgggcctcatcgaggcctggttcgtgatgctgggcttcgcggtccagatctattgcgatttcagcgcctattccgatatggcgatcgggctggccggcatgttcggcgtggccttccccgagaatttccacaaaccctatgccgcgacctccatgaccgaggtctggcagcgctggcatatgaccctcagcttctggttgcgggattatgtttataaatacctgcgcgagccgctggggcgggtgctcgccatcctcggcaccatggcggtgtcggggctgtggcatggcgccgcctggaccttcgtggtctgggggctgatccacggcacgatcatgatggcggaggccctgaccggccatgccgtcagggcgcgccagtcccgcggcctggcccgggcgggcttcattctggcgaccttcctgacctgggcggtggtcaccaccttcttccgcgcgccgacgctggaggtcgccgcatcggtgatcgccggcggcttcggcgcgcatgggccgggcctgctgccggcggatgccccgctgctggccgggctgatcctggtgactctggccctgcacccgctggatacgatcaaccgcatccgcagcgcgaccgcccgggtgccggcggcgctggccctgccggtgatcctggtcctcgtcgccggctgcgcgatgatcgcggccggccggccgcaggcgtttttctatttcgacttctgatcagtccgggaggggcgcgggcggcagctgccggttcagatcctctgcgatccgccgggccaggagctgattgcccgcatcgctgagatggccgtagaagtcggagaacagcccccggccgtcggaggggaaagcctctgagagatccagaacatcgggcagccctgccgccgccagcttctgtcggaaggccgtgagggcgggcccgagcgccgtcgcataggcgcccaccgccgcgggatcgcggaccacctcggcctctgcgggggtgccgaacggcaccggggggagcacgaatgtgacccgcacattccggcgctgcgcgtaatcgagcaggccccgcaggtcttcaagcacgcgggtcgcggcggtttcgcgaccatctgccgtggcacagggatcctggcgcaggccgtctttccgatgccggctgcccgaggacgtcagctgccgggcgatctctgcaatcaccggccgcgtggcggcgggcggcggcagcctggcggccagcacgcagacgcggacaagatcgaccgatccgttgaccacgatcacccgatcatacgcttctccggcggcgagccgggcgtcgagcatcatgacattcgcagggatcgtgtgcccgggcatgctgaaattgcgcaccagcgtgccgggcagctggcgttccagcgcagccgcgagcgtctcgtcatcgtcattggagaagccgaaggactgcgaggccccgagcagcaggacccggcgtcgggcgtcttcgggcgcgaccagatgccgatgcaggcgctcgccctcggggccgatggtcacgcccggcactgcggccggcagaatgacgtcacccaggccagggacgtatcgtttggggagccccccgatccgggccaggcgggtggctgtcgcattgccgtcggtgccgcctgcgatcacccctttcagcctgccggcgataccagacccgatatcgagcacgccgtcgatcagacagacgaccaggaacaggccgaagagcagggagacgatctttttcatcaggtcggtcggtccggtatcggaggagatcagtcgggggcgaaagcgcggggaacggcgcgggatcctgatcggatatgtcgtgtgtggccggggcccggcggtcatcccttcctgtccggtgcctcatgcccggtgtcgggccagtctgcccgcagggctgcatcagatccagttgaagcgcgcggccgtctggaaaagcctcgaccagatctgcgggccgaccagatctgcgggcctctgccgtgaacgccgacgtcttaccggagttgcgccggaacgggtgatgtgccggaaggggggcagcacatcgatgacgtgcccggattctcgattggcgaccatcatgacaacggctatggtgtgatgcatgtgtggaggtggtttcacggtctgtcgtcggatcgccttcgagcgtcaagcggagacgtattgaaatggacacgcagatgaatgaagacgtcgccgtcggccggcggccgggcggtatctggtcgcggcctgtgctggaggtgatgccggcggctgagaccgcaatcggcatcgctaccactctggatggcggcgccggcctgtcctgaccagcagcggcgggccgtgcgtcaggctgcttgcggtggcgttggtcagagcacggccctgagagacccgatcagtcgggacggggcgcgggcggcttctgccggttcagcgccccggtgagcagcggggccagggcctgattgccggcatcggtgaagtggccgtggaggtcgatgaacatgccgggccggccggtgccgaagccctgcgtcagatcgacgatcccgtccatatccgcgatccgcgcccgcagagcggtgttcagcggatcgatgacccggcgatagcgctgaaactgcgccagatctgcgaatgtgccgtcaccggcatcggcgacatagggcatgggcacgatcgccagtatggccggcaggttgtggcgccgtgccgccgacagcacctcgttcatatcggccatcagccggttcagcacggcggcccggccttcgggcgtggtgcagccgtcgtgggatgcggcagccggacggtctgacgctccaccggtcagccgggcggcgatttcggccaggaccggccgggggcggggcgccggataggcctgcggcaggcagtacatgatcaggtccagcgtgccgttgacgatcagcacctgatcgatccggtcacccgcggcgatgcgctgctccagaaccatggtgttgccgggcagccgctggccggggcttgcgaaattgcggaccaccgtgccgggcatcgcgcgttccagcgccgccgccaggctggcatcgtcctgattcaacgatccgaaggcctgagaggcgccgagcagcagaacatggcgggtggcctcgtccggtgccgtgacatgggtatgcagcctctccccatcctcaccgatggtcagtcccggcacggcgcccggctggtagatgctgccggttcccggcacatagcgctgcggcagggcatccagacgggccagtgcctcttccctcatctctgcataggggtcggcattgcgcgcggcctcggccatccggtttcgcagcccataggccagccccagcccgatatcgagcacgccgtcgaccagggctatgagcagaaacagcccgaagatcagggaggcgagctttttcatggggggatcgatccgggaggggatgagggccggccgccatgaatacagggagcaaatcctgccgtcgatggttaagggggcacagtcttcgataaaggagccggctcatgcctgccaaatccaaggcccagcagaaagccgccggagcggcgctctccgccaagcgcggcgaaacgaagatgagcgatcttcagggcgcgtcgaaatcgatggttaagtcgatgagcgagaaggagctgcacgacatggccgccacccgacgcaagggcaagccagagcacgcctccaaatccgactgaggggaaggacgacaccaccatggccaatgcgagcaaaaaacatatcggcatcggatcccagggcaagggcagtggtgcaggcgccatgaccgacctgcccggggatgtggagatgggcgacaacgaggtgctgtcgaaccgcgacaaggcccagggtgcgaagacccgcggcttcgacggcaaggccacccggaccgaccaataccaggaccacgaagctgaccgccggacgcgggatgtcggggagggccggggcgggggccagagagatggggaccacaggtgacggcgccatgaccgacacgctctcccccgccttgccggccgatctggaccggaggattcacgaggtgatgggccggatctgcgcgcgtggataccgcctcgccaccgccgagagctgcaccggagggttgatcgcatcggtgctgaccgacgttcctggctgtgcccatgtcttcgagcgcggcttcgtggtctacagccccgaggccaagcgcgagatcctgggggtctcgcagctgctgctcgacggccccggcccggtgtcggaaccggtggcccgggccatggccgagggcgcgctggcgcggtcgatcaccgagatggcgatcgccgtcaccggcttcgccggcccgggcgggccgggcgatgaaccggggctggtgcacgtggccgtggccatgcaccgccgcccgaccctgcaccgggtcgcccgcttccaggacggcagccgcggtgcggtgcggctgggggcgttgagcgtggtgctggagctgatggaggcccagctggagggagcgcctgcggcataacgaccatgcatcccggacgcagtggttgccgggctcccatcggtgatataccgttctgcggaattcgccctaaccgcagacggacagtacccgtgagcactgagcagaccatccgcgccgccgcgtttcgatccaagatcatgtcggccgatgatgccgcggcgctggtgccgcccggcgccaatgtcggcatgagcggcttcaccggctccggctatccgaaggcggtgccgcaggcgctggcgcggcggatcgaggccgagcatgccgccggccggccgttcaaaatcggggtctggaccggtgcctcgaccgcgcccgagctggacggcgcgctggcaaaggcgaaggggatcgaactgcgcctgccctatcagtccgatccggtctgccgggaagagatcaatagcgggcggatggagtatatcgacatccacctgagccatgttgcccagttcgtctggttcggctttctgggcaagctggacgtggccgtcatcgaggtgacggaaattctggaggacggcacgctggtgccgtcgacctccatcggtaacaacaagacctggatcgacctggccgacaaggtgatcatcgaggtcaattcctggcagaaccccgccctgcggggcatgcacgacatctattacggcacccgcctgccgccgcaccgcacgccgatcccgatcctggccgccggagaccggatcggccagccggtgttctcggtggatccggccaaggtggtggcggtggtggaaacccacggccccgaccgcaacaccgccttctctccgcccgatgccacctcgcaggcgatcgccggccatatcctggaattcttcgagcacgagatcgcccgcggccgcctgccgcgcggcctgctgccgctgcaatcgggggtgggcaatgtcgccaatgcggtgatggccgggctggggcagggcagcttcgaggggctgaccgcctataccgaggtgctgcaggacggcatgctggagctgatccggtcgggcaggatgacgctggcctcggccaccggcctgtcgctcagccccgaggcgacccggatcttcaacgacgaggccgaggcgctgaagaagcatgtcgtgctgcgcccgcaggaaatctccaaccaccccgaggtcatccgccggctgggcgtgatcgccatgaacggcatgatcgaggctgacatctacggcaacgtcaactccacccatatccgcggcacccggatcatgaacggcatcggcggctcgggcgatttcgcccgcaacggctatctgtcgatcttcatgaccccgtcgaccgccaagggcggcacgctgtcggcgatcgtgccgatggcgacccatgtcgaccataccgaacacgatgtgcaggtgatcgtcaccgaacaggggctggcggatctgcgcggcctgtcgcccaaacagcgggcgcgggtgatcatcgacaattgcgcccatccgagcttccgcccggcgctggacgactatttcgcccgggcgcgggcgcgggcggccggccagcatacgccgcatctgctggatgaggcgttccatttgctgaccccgatgccgtcttctgataaaagatgacatcaggcttgagcaatgggaggggaaacgatcatgagtgagcgcgccgacgaaatcatgcagcagcccgtctggcagcggccggttctggagatgatgccggccgaagacaccgccagctcgtccggcgccgttggggacggcagtctgggcctgtcctgaccttctgtctttccgacggttttcaaacgcccggatgtccgcccgcatccgggcgttttcgtgcgcagaagcggccccatgcgcatgtttcgcgatcgctgtgcgggtttgcagggtccggatgttgcaatactcatctggaaaaccatgcccggggggactattcctgggtcaggagtgagacgccccctaagaacgccaggccggaaagagacgcatgaccaccacccccgccttcgacacgatcatcgtcggtgccggaacggccggctgcctgctcgccaaccggttgagcgccgatcccggccgccgggtgctgctgatcgaggccggcggcaaggacgactatatctggatccatgtgccggtcggctatctgtactgcatcggcaacaagcgcaccgactggtgcttccagaccgagccggatgccgggctgaacggccgggtgctgcgctatccgcgcggcaaggtgctgggcggctgttccagcatcaacggcatgatctatatgcgcggccaggcccgcgactatcgccagtggtcggaaatcaccggcgaggaggcctgggactgggaccaggtgctgccctatttcaagcgccatgaagaccatcacaagggcggcgacgatctgcacggccatggcggcgaatggcgggtggaacgccagcgcctgcgctgggacattctggacgcctgggcggaagcggcggtgcaggccgggctgccggcgaccggcgatttcaatcgcggcgacaatgaaggcgtcggctatttcgaggtcaaccagcgcaatggctggcgctggaacgccgccaaagccttcctgcgcccggcgctgaaccgccccaatctgacggtctggaccaaggcccaggtcgcccggctgctgaccggccgcgatgccgacggccatctgcgctgcacgggcgtcgagctggttcaggatggccagcgcaagaccgtgacggcgaaatccgaggtggtgctgtcttcgggcgccatcggctcaccccagatcctgcagctgtcgggcatcggcccggcggccctgctggcccgccacgggatcgaggtggtgcatgatctgcccggcgtcggcgccaatctgcaggaccatctgcagatccgctcggtgttcaaggtgaagggcacccgcacgctcaacaccattgccggtaatctgatcggcaaggcgacgatcggtcttgaatatgcgctgaagcgtaccggaccgatgagcatggccccctcgcagctcggcgccttcacccgctcgtcccctgagaagaacgccgccaacatccagttccatgttcagccgctcagcctggatgccttcggcgagccgctgcacggcttcgatgccttcaccgccagcgtctgcaacctgaaccccaccagccggggcagcgtcaccatccgcagcggccggttcgaggatgcgccgctgatcgcgcccaattatctgtcgaccgaagaggaccgcaaggtggcggcggattccctgcgcgtcacgcggcggatctgcggccagacggcgctggcgcgcttccagccggaagaatggaagccgggcgtgcagtaccagaccgacgagcagctggcgaagctggccggcgacatcgcctcgaccatcttccacccggtcggcaccacccgcatgggccgcgccgacgatccggacgccgtgctggacccgcatttccagctccgcggcatgcgtggcctgcgcgtggtcgatgccggcgccatgccgaccatcaccagcggcaacaccaactcgccgacgctgatgatggcggaaaaggcggcggagtggatacgggcgggggtgtgatccgccgcctctgacccgagaccgaccgactgtccttacgacccgccccggcgcatgccgcggcgggtcgttgcgtttcgttcgcccgccatttcatcacatatctgataccgtcttcacatccacgatgaatatctggacgccccggcatggtggcgcctacagttctttctgaacgatgcgggggccgcagcgatgcgccgccggcaggcatgtccctgaaaatatggatcatatcatcccggccgcgccaacggccgggcagggagaagtcatgccaatgcatgtgtccgccgtctcgtggcggcgggcgagcatcagcaccagacgccggttcacggcgcggtcatgccaggaggaaatgatgacgttttcacgctggggagcggccggtgccggcgccgtgctcgcctggacggttgccatgggggccgcgtctgcggcggataccgtcgacttccggatctcgctcgacacctcgcccacccatgtccgcacgacctgggtgcaggaattcgccgagcggctgaaagaccagtccggtggtacgctcaacgccacggtctatcacagcggccagctgttcaaggatgtgaatgtcgccaaggccctgcgtcagggcagtgtcgagatggccgtgcccggtacctgggtgctgggcgggttcgagcgccgcttcgacaccgcgaccctgccgatgctctatggccgcgggcccgacgactatcacgccatttccgacggcgagcccggccggctgatcgccgaagggcttgaggagaagctggacgtcaaggtgctgggcaagtggttcgacctcggcgccagccatacctatttcgccagccgcaaggtcgagacctatgccgatatgaagggcgccaaggtgcgcttccccggcggtgccggactgtcggcgcggctggaatatctgggggcgacgccggtcctggtgccctggcccgatgtgccgctggccatgtcgcgcggcaatttcgacgggctgatcaccaccaatgagagcgtgaaaagcgccaagctttgggaatccgggcttaaatacgtcttcgaggactaccagaccttcggccagtacatcccgatggtggcgggcggcttctggaagaagctgacgcccgaccagcagcagatgatgacacggatctgggacgaggtcacgaccgaggaacgcgctgccgccctcactgcccaggaagaggcgggggacgaggcgaagcgccagggcgtgatcttcatcaccccgacccctgaagaacgcgccgacatccgccggcagatgatgcaggcgcaggacgagatcgcgaaatcgatcggcatcccggccgatttcgtgacgctggttcaggataccctgccgcccgactgacggtctccccctctcgcccccgcatccgcaccgagagacgatcgtcagcccggaggcgcccttgaaccgcgttctgaagctcgtggaacacgagctggtcgggctcgtcgcgaccatcgcgatgctgcttgcgacctggcagctgctcagccgctatctctacccgcccgcatcgacccactggatcgacgaggtggtcatctacctgatcatctgggcctcgtgcctgagcttcagcgggctggtggcgggcaatgcccatgtccgtgccgatctggtgctgcgcctgctgccgccgcgcatgcagcgcgtggtggaaggcttcaacacgctcgcggcactcaccctctgcggcctgctggtctggttcggcggccggatcgtgttcgacgcctgggatatcggcgagaccagcctcagcgaattgcagtttccgatgtggatctactacctggccctgccggtgggggcggcgctgatggcgctgcgctatctcgcccgcctggccggcctgatcaccggatccgttgccgggcaggacgtgctggatgggggaggccatctgtgagccaggcgctgttcggactgttcttcgtcttcctcggcgccggcatgccgatcttcgtggtgctggggctgaccgccgcggtactgctggcggccgacggatcctctctgctgctgcttgcccagaaggtactggacgagctgaattccgagctgctgatggccttgcccttcttcggcatggcggcggtgttcatgcagcgcggcggcatcgcccgcgccctgatcgacgtttccgccgcctggatgggccgcctgcccggcggcctgggcgttgtggcggtggccggctgcacgatctttgccgccatcgccgggtcgagcgtggccacggcgctggccatgggcacgatcctggtgccggcgatgatccagcgcggctatccggcctcgttctccaccgcgctgatcggcaccgggggcacgctcggcatcctgatcccgcccagcctgcccctgatcctgttcgcgatcatcgccgaggaatcggtgccgcggctgttcctggccggcgtggtgccgggcgtgctccaggcgctgatgctgatcctgttcgtgatctggaccgcccgccgcaagggctatccgcccgagccgcggatgagccgggcggacttcgtccgggtcaacctgaaggccctgccggccttcgcggtgccggtgatcgtggcggtcggcatctatggcggcttcgtcaccgtgaccgaggcggcggtgctggcggcgctggtggcgatgctggtgggcatgaccgtctatcgcggcttcacccttgcccaggcgccggcagtgatgggccatgcggtcaggtccgccgccagcatcatggtgatcatcgccatggcgctcgccttcggccattgggtgacggaaagcggcgtgccggcggcggtcgtcgatttcgtcacccgcaacgacctctcggcctggcagttcctgctggcgatcaacctgctgctgctggtgctgggcatgttcctggaggtggcctcgatcatcctgattgcggtaccgatcctgatgccggtggtcacggcactcggcatcgacccggtccatttcgcgatcgtgatcgtggtgaacatggagatcgcgctgctgaccccgccggtcgggctcaatctctacgtcctctccagcatttccaaggtgccgatcggcgaggtgatccgcggcatctggccgttcatcgccctgtttgcggtctatctggcgctgatcacctatgtgcccgccctgtcgctctggctgccgaccctggtctatggcggctgagcttcatcccattccctgtcgaggagacgagatgatgacctcgatcgatggttccggcggcatcaccggagcgttcacccgcctgctggccgggctcggcactgcagcgatcgacgaggaggcggcgaccgttgcccggcaatgcctgctcgactggatcggtgtgtcgctggccggccggcatgagccgctggtcgacattctggtcgagacggcacgtgaggagggcggcgacggccatctgccgctgcccggccggcccgagaccctgccgctgacccaggcggtgaccgtcatcggcgccatgtcccatgcgctggattatgacgacgtccatctggcgatgcagggccatccgagcgtggcggtgatcccggcagcctgggccctggccctggcagagggccgggacggcgccgccctgatccggtcgatcgtgggcgggttcgagatcgcctgccggacaggcctgctgatgggaccgtcgcattatgcccgcggctggcatgccaccggcacggtcggcaccttcggtgcgatggcggcctcggccctgctgctggggcttgacgaggaccgcatggcccatggtttcggcatcgccggcacccaggccgccgggctgaaggcggtgttcggcacgatgagcaagccgctccatgccgggcgcgccgcggccaacgggctgacggcggcccggctcgccgcccgcggcttcaccagccataccgacatcctgggcgcggcccagggcttcggcgacacccagtccgacgggctggatcccgcggcggcgcttgccccggcgccgggcttcatgatccgcgacaccctcttcaagtatcatgccgcctgctacctgacccattccgcgatcgaggcggtgcacagcctgggccggatcgaccccgaggcggtgcggcgggtgacggtccgggtcgatcccggccatctcagggtctgcaacattccggccccggcgacggggctggagatgaagttctcgctgcgcatgactgcggcgctcgcccttgccggcgaagacaccgcgcgcgaggcgctgtttgccgatgcgaccgccgcccggcccgatctcgtccggctgcgcgatgcggtgacggtcgagccgcgcgcggcgccgagcagcacactgtctgaaatcgaggtcgagcttgccgacggcgccacccgccgcgccgctttcgatgtcggcgtgccggcggccgatctcgaccggcaatggcagcggctgtcggccaaattcctcggccttgcccggccggtgctgggcgaggcccgcagccgcgaggtgctgagccgggtgcgtgaactggatgcccgcaccgatctcggcaccctggccgggcttctggccgccgcctgacttatccccaaggagtaccgaacgatatgagtgacagcaccgacaagagcggggatttccgggagagggcgatcctgctcgcccgcggcaaccgctacgaggatttcgagccggggcgggtgttcgagcatcatctggggcgcacgctgaccgagggcgacaacatcgccttcaccacgctgacgcttcattacaacccgctctatttcaacgaggctttcgcccgggccaacggccatgacgggctggtggccaacccgctgctggtcttcaacatcgtcttcggcctgtcggtcgaggatctgagcgagggcggtggaccgttcctcggcgtcgacgacctcaacttcctgcgcccggtccgggtcggcgagacgctgctcgcccgcagccgggtgctggaccgccgtccgtcggacaagttcaagggctacggcatcgtgagctgggcgaccgagggcttcacgcccgagggcctgaccgtcgtcaccttccagcgctccaacctcgtgaggtaccggcagtgagcacgcgtcccgaaaccggcggctatatgaccgaggaccgccggatgatccagcaatctgcccgcgatttcgcgatgcgcgaggtgctgccggtcgccaaccggctggaccccgaacagggcgacatcccgatggcgctgcgcgacaagatggccgagatgggctatttcggcatcaccatcgacgagaaatacggcggtctgggcctcggctgtttcgaatactgcctggtggccgaggaactggcgcgggcctggatgagtgtggccagcatcatcgcccgcggtaacggcatgatcggcttcgatgcgatgagcgaggcgcagcgggcggagatcatgccccgggtcgcctcgggccagtatctcggcgccttctcgatgtcggaaccgaatgcaggatcggacgtcgccaatatcagctgccgggcgcggcgcgacggcgacgactggctgatcaccggcaacaaatactggtgcaccttcgccgacggtgccgactacatcatcgtcattgcccgcaccgaccctgatgtcgacccgaagcgtcgccacaaggggctgtcgatcttcctggtcgacaagccgcgcggccagctgccgcccggctgccagggtaacccgatccccaagatcggctatttcggctggaagacctgggaactggccttcgacgactgccgggtaccggcttcggccatggtgggcgaagagggcaaggccttctatgccgtgacccatgggcttgagaaggcccgcgcccataccgccgcccgtgccatcgggcttgcccgcgcggcgctggaagatgccaccgcctatgcgcaggagcgcatccagttcggccggccgatcggcgatttccaggcgatccgcttcaagcttgcgaccatggcgaccgagatcgaggccgcccgccagctgatgtatttcgtctgcaccgagatcgacagcggccggcgctgcgacaaggaggcggcgatggtgaagtatttcgcctcggaaatggccgagcgggtcaccagccagggcctgcagatcctgggcggcgccggctacaccaagctgcacgccatggagcgccactggcgcgacgcccggctgaccaagatcttcgagggtacctccgagatccagcagcgcatcatttccgaccatctgctcggacgctgaggaggcggacatgttgagcacgctcaccgcatcttcgaaatatttcgaggatttcacccccggcgaggtctaccgccatgcccgcggcaagaccgtcaccgagatggacaacgtgatgatcaccaacatggtgatgaacaccgccgagggccatttcaacgagcatctgatgaagggcaacgagatcttcggccagcgcgtggtgttcggcggcatcaacatctcgatggtgatcggcctcgccgcccaggacaccgccgccaatgccgttgccgaactcggcatggataagatccggttgcgccatccggtcgtccatggcgacacgctctatgcctatagcgaggtgctgtcggcggaggccgccgccgaccgcgacgatgccggcgtggtgaccttccgccattggggcgtcaatcaggacgacaggctggtcttccagggtgagcggcgggtgctgatcaagcgccgcagccattggggggagaaatgagcacccccccgggcggcagccttccgggtgcgctcgccgggctgaaggtcatcgatctgacggtgatgctggcggggccgttctgcaccatgctgctggccgatcagggcgccgacgtgatcaaggtggaaccgcccgagggcgaccatacccgcaccgtcggcccgttcatgcccgatgacggactgcgcgccttcggcggctatttccagagcgtcaaccgcaacaagcgcagcattgcgctcgacctgaagagcgcggccggccgggccgatttcctgaagctggtcgcaggcgccgatgtggtggtggagaacttccgcaccggggtgatggaccggctgggcctgggctacgagaccctggccgcggtcaatccccggctggtttatgcctgcctgcgcggcttcggcgatccgcgcaccggtgccagcccctatgtcgactggccggcctatgacgtggtcgcccaggcgatgggcggggtgatgggcatcaccggccccgcccccgaccagccgctgaaggtggggccgggcatcggcgacacggtgccggccaccatgctcgccttcggcatcctggcggcggtgcgccatgccgaccgcaccggaaagggccagttcgtcgacatcgccatgtacgacgccattctggcgctgtgcgaacgcatcgccttccagcattcctatgccggcgtggtgccgcatccggaaggcaacggccacccgctgctctgtcccttcggcctgttccgcgcggccgacggctgggtgtcgatcgcctgtccgcaggaccggttctggcgcgacctctgcaccgccatgggccggcccgagcttggcaccgatccgcgctatgcgctcaacaacgaccgggtggtgcatcgcgccgaggtgatcgaggcggtgaccgcctggaccacgacccgcagcaaggcggaactcggcgcagcgcttggcgggctggtgccgttcggcccggtcaacgatgccgccgacatctttgccgacccccatgtcgcggtgcgcgaaatgctccagccggtcgaccatccgggctccgcccgccggggcatgattgccggcgtgccgctgcgcatgaccctgacccagggccgggtgcgcgcccgggcgccgctgctcgacgagcatgccgacgatatccgcgccgaattcacacgcgccgcgccctcccttcagaagacctcgaaccaggaccagacatcatgaccgacagcctgaagacccgcccccgccgcctgcgccgcagccagctgagcgtgcccggcagcagcgaaaagatgatggccaaggcggcaggctcggccgccgaccatgtctttctggatctggaagacgcggtggcacccaatgccaaggtggcggcacggtcgaagatcgtgaccgcgctgcgcgacctcgactggggaaacaagacgcgctgcgtgcggatcaacgacctcggcaccgaatatgcctatgaggacgtgatcaccgtggtcgagggcgcgggcgcgcatctcgacaccatcatggtgccgaaggtgaagaccgcgcatgacgtgatgtggatcgacatcctgctcggccagatcgagcgcaagctcggcctcacccgccggatcggggtcgaggtgctgatcgaggaggtggagggcatgatgaacatcgatgccatcgccgccgcctcgccgcgcctggaatgcctgatcttcggcatgggcgactattcggcctcgcagggcatcgatatcggcagtgccttcggcccctcgggctatccgggcgacatctggcattatccgcgctaccggctggcgatcgccgcccgcgcccatgggctggatgcggtcgacggcccctttgccgatttccgcaacccggaggcctatcgcgaggaatgccgccgggcgatgaccctgggctgcgtcggcaaatgggcgatccatccggcccagatcgagccggcgctggaggtcttctctccctccgccgaggctgtcacccgagcgcgcaaactcgccgccgcctatgccgaggcccaggcccgtggcgagggtgcggtgcaggtggacggggtgatggtcgatgtcgcctcgatccgcatcctgcagaacgtgatcgacaaggcggagatgatcgggatgtgatgcgggcggggcatgccggtcggcatgcccctgcctgcgccaccgcatcatcctgaagggggagcctcatccatggccgaaggcgatggtgtcgtcaaatccgcgggccgggtgcttggcctgcttcaggtcttcgccgaacatcgccggccgatgcgggtgtccgagatcgcccaggccatgggcattccgcaatccagtacctcgatgctgctgaagacgctcaccgccatgggctatgtcagcttcgatgccgaggccaaggccttccggccgaccctgcgcgtggccctgctcggggcctggctgaacgaggaattcgcgaccgaaggcagcgtcgacgagatgatggtcgagatggcccgcgccacggccgatgcggtcattctggcggtggagaacggtgtctggtcggaatacatccatgtggtgcagtccgagcaggatctgcgttatgcattgcggccgggcacgaagcggcccttgcccgcgaccaatctgggccgggtgctgctggcggccaagcccgatgacgagattgagcggatcgtccgccggatcaatgccgaggcggcagcgggtgaccggcgtttcgatgtcgcgacaacgcttgacgcggtgcatgcgatccggcgcgacggctattccttcgcccataatctgatctcgtccggggcgagcgtcatcgcgctgccgatgccggttccgcccggctacaagccgatggcgatcggcatcggcggccccaccgaccggctggagcgggggcaggagatgatcctggcggagatgcgccggctgctgtcgcagtatctggggggctgagccttgtccgcgatgctgccgccgctgctggtgacgctgatcgcccataccgtgctgtcgctgtcggcggcatcggtgccggtgctgatgccgatgatcgccggcgccgatgccgcggcggtaatcggctcgttcaccgcggttctctatgcgagcgcggccctcacctctttgtccaccggccatctgatccagcgcatcgggccggtgaccgccatccagatcgcgctcttcgcctgtgcggccggcgtgctgctctgccagatcggcagcctgccggcgctgatcggcggggcggtgctgatcggcatcggctatggcccggtgacgcccgccggatcgttgctgctgagtttcaccgtgcccgtgcgccgtttcgggctcgccttttccatcaaccgcaccggtgtgccgggcggcattgcgctggccggcctcatcctcccccggaccggccaggctttcggctggcatctgtcgctggccggcattgccggtgccgccctggcagccgccctcgcccttggggcggggcggttcctcgaccgtcccatccgccgtccgcccccctccggagggcggatggggcggtctcttgtctcaggtctcgtggccaatctggcccatgtcctgaccgatcgggcggtggcgccgctctcgctcgcctcggtcgtctatctgggggcgcagagctgccttgccgcctttctggtcgccttcctgatggggccgatggggatggcagcagtggaggcgggcgccctgctggcggcagcccaggcggtcggcatcggtgcccggctggtgctgggcatgatgtcggatcttctgccctcgcggctggtcatggtcgggttgatcggtctggtgatcgcgctggcggccgggctcaccgcggcgatgtcccccggctggccggggatcatcgtcaccgcggtggtgttgctctacggcgcctccgcactcggctggaacggggtggtgctggcggcactcgcccaggcggcgccccgggagcgggcggcggaaatctccggcgcctccacggcggtcgcttatgccggcgcggtggccggccccggtctcttcgccctggtgctggaggcggcgggcttcgccgccgcctttgcaaccgtggccgggatcgcggtcctggccgcgctggtcattctgcggcgggccacggcgtaacctttggcacgttcagtcgcggaagctggccggccgcttttcgaagaaggcggtcatcgcttcggtcaggtcgtccgacagcagcatggcggcgttccaggtggcgatgtagttcagcccgtcggcgacggaatggtcgcggacataggtgatcatctccttggtgccgcggatggcgagcggcgatttggcggcgatcccggccgcgatcgcctgcacgccctcgttcagtgcgtcgacggtggggaagcggcggttgatcagctgcatggcctcggcttccgccgcggtcaccttgcgggcggtataggccagctcgcgcgccatgccttcgcccacgatcttgggcaggcgctgcagggtgccgacatccgccgccaggcccatatcgacctctttgaccgagaaccaggcgtcttcggcggcatagcgcatgtcgcaggcggtgatcaggtcgatgccgccgccgacgcaggggccgttgacggccgcgatcaccggcttgcggcagcgttcgaccgaggtgacggtgtcctgaatgtccaggatctggcggcggagcttttcaccccgccttccgtcgcagccgtcggccacctcgtccttcatcgcgcccagcatggccagatcgatgccggcggtgaagaagcgcccggcgccggtgatgatgcccacgcgcgcttgcggagtctcgtccagccattccatcgccgccttcagctccacccacatcggcgcgttcatggcgttggccttgtccggccggttcagcgtcacgcgggcgacggcattctccagcgtgacggtcagggtggtgaagtccggcggcgtgacggcggcggggcgggaggcggacatcggggcgtttcctcgtcaatcagacgttcgtttcaatttgcccgattgtccgtcataccccccgtcagtgcaagggcgtgcgcgcaaggctgcgcgccctgtcagcggcttccgaacaacttgccgacaaccgaccccatcaccggcatcagggtggagagcagggacccgaagaggccgaccccgccggccaccccctccagatcggcatcgctcaaactatccgtgccggcaagcggcggcaccggcaggaccagatggtcgacggtgctgcgcgccgcgacggcggcggcctctgcgggggcggtgatttcggcggtgacctgcacgccctcggccaggatgaaaccggcgcgggtcagctcggccttcgggtcggccaggaggcggtgatgatgtgctgcatcgcggctggccgccgccagcagccgggccagatcttcaagcgtcgcggcctgcggcgcggccggtacgggggcgtgatgcggggcggccattggggggctccgggcgtcgtatcggaaagaaggggggtcgggacggaggagcccggggaggggggcgccgctacgagttgtagacggcggagatgtcgttgatcgtcttggccgccgcccccttgacggaatggcctgtgaacagcccgacggcgaacagcacgccggcgcccatggccatcagatgggccatgaaccggccggccgcaccgctgccggccacggcctccagatccgcatcgctcaactcgccgtccgacagcggcggcaggggcagcaccaggcatgacggcgtggtgcgggcgagcacggcggcaaaaccggcggggaaggtcacctcggtcgtaacctctaccccctcggcgatcggcaggccggcctcggccaggaccgcccgcggggcggtgcgcagccgaccatgcagatccggatcgcggccggcggcttcaagcagcccggccagctgtcccaggatctcggcctgacgggcgtccggcacggtggggtgaagggtgtctgccatgagggatctcccggcctgcatgcatgtccaggcgacaagaatagcaatggggcgcgcggcccgacctgacgctgcgtctcgactaacgtgccgggcgtctcaatccggcgcgaagcggccggcgcttcgggcgcgcgtcagcccccgccctgggcggcctgcgcatcggcattgtgctgggcgaccgccccggctatgtcgaccttccggtaaaaaaatctggttgaaggctgcccgtgcggccccgaacaggctgccgaagaaattggcgagcgcgccgccaccggagacgccgtccagatcggcatcgctcagctcgcggccgtcgaccagcggcggcaccggcaggaccagacggtcgggggtggtgcggcccgccaccgccgcggcccgggcgggcggggtgatctctgccgtcacctcgacggaatcgtcgaccggcaggccggcttcggccagtgcggcgcgcggatcggccagcaggcgcccatgcagctccggatcgtgggcggcatggttcagcagccgggccaggcggtgcagggcatcggtgtcggtggcggcaggtgtgtcggacatcgggacagtcttccgctggcgtgcagtcatgtctgcagcatagcggggatggccgggccggacttttcactgcgtctctaaaacccggccgcccgtctcattcgtttcggcgtctcgttcgttccggggctacttcgccaccccgatcttcggcaccggcacaccctgctcttcggccgctttcagctgcaccgccttggcgcgcttaaagccctcgcgccccgacagccgctcccaataggcccggacattggggccgagttccccggcgagccccaccgaatgggcaagcaggatggcatagccgaccgagatgtcggcggcggtgaagcggtcggcgcagagatattcctgttcgccggtcatctgctcgatcagccgcagccgggccaggaaccatttggcatagtcgtccgcggcctggggcagcttgcgctcgtcgggttcgaagaagcgatagcgcagcaccagggtctgcggaaaggtcagtgtcgcctcgccgaaatgcaggaagttgaggaaggggccgtaatcggcctcgtccggcgacaccgccaggctggtcgggccatagcgggtgacgagatactggcagatcgccgccgattcggtcatccgcttaccctcgtcgaacagggccgggatggtgccgagcgggttgatctccagatagctcttctggaacacccggggcgggaagggcaacatcttcagctcataggccgggccgccggtctccaccgccagctcctccagcgtccagagcgggcggaaggaacgggcgtcgtggcagtgataaagcgtcagcaaggcgtctgatcctcccgggtgctgtccgtccggcgtagacgactgcggggcttacagccccatctgccggctcgccagatccttcatgatttcctcggcgccgccgccgatggcattcaccttcacttcgcggtagatccgctccaccgccgccccgcgcatatagccggcgccgccgaagatctgcacggcttccgaggcacaatacgccatggtctgcgtggcctggttcttggccatgcagatctgggcaaccggattgtcgccggcttccagcgcccagaccagtctttcgatgaaggcttcggtcacttccacacgctgggccatgtcgaccagcttgtggcggatgacctgatggccggacaaaggcttgccgaaggtggtgcgctcgcgggcataggcggccgcctcgtcgacgcagacccgggcgaaggcgcaggcggtggtggcgagcgaaatccgctcgtcgttgaaattcagcatgatggtccggaaggctgagccttcctcgccgatcagattggcgaccggcacccgcacctcgtcgaaatgcagcgtcgcggtatccgatgcccaccagcccatcttcttcagcggcgtgcgggcgaagccggggcttcccgcctcgatcaccatcaggctgataccgtcgcggccggggccgccggtgcgcaccgcgaccgtgtaataatcggcgcgcatgcccgatgtgatgaaggtcttctcgccgctgaccacgtaatggtcgccctcgcgccgcgccttcgtgcggatgctggcgacgtcggagccgccattcggttcggtgatcgccagcgccgagattttctcgcccgccagaatgcccggcagcacccgggccttcagcgcgtccgagcccgccttcaggatcggcggcgcgccgatggtgtgactgagcaggctggcgggcacgccgcccgccccgcagcgcgccagttcccggccggcgatcatggccatgaaccggtcggccgggatgccgccatacgcttccggatagccgaggccgagcagcccgatctccgccgccttcaggtagaggtcgcgggggaattcgcccgcctcgtcccagtcgttgacgaagggggtgatctcccgcgccacccagcggcggagcgtgtcctgccactccagatgatcgggggagagatagggggagcgcaggaggttcatggggggcgtctccgtctggttcagcctgcggcagccgggccggttcagcctgccgcagccggggcctcgatctcgaccaggatctggccggcgccgacctggtcgccttcgccgacggtgacggcggtgatccggccggcgaggtcggccttgtgcacatgctccatcttcatcgcctccagcgtcaccagcggccggccgggttcgacctcgtcgccgatggcggccagaaccgcgaccacgcggccgttcatcgccgcccggatccggccgtcaccggcggcctccccggcgcgatgggccggttcgaacgagcggtcgtcgatccggaccggccggccgtccagatgcagatgcagcacatggccgtcgcgggcgaagcgcagccgggtggtggtgccgtcgatggcggcgaccagcgcgccggccacgccatcggcttcgggcacaagctcgaccggcgccagcgccaccgtctcgccatcgacctcggcggtgaactggccggggccggaccgggcgatggagacggccgcggcagtgccgtcgatggcaagcagcaccggcacgggcagggtatgggccaggctgcggccggcgaccttccgcccgtcgccggcaatgccgtggagcagcagggccgcaaccgcggcggcgcggcgatcggccaaggcgtcgcgggccagcagctcgtcgccatgggtgccgatgaaggcggtggtcgcctggccggctgcgaagaccggatgggccagacaggcggccaggaagccctgattggtggcgatgcccagcgccaccgtgtcttccagcccgtggatcagcttgcggcaggcatcggcgcggctggcgccatgggcgatgaccttggcgatcatcgagtcgtaatagggcgagatttccgggtcgccgcccagcgcatggtcgacccgcagcgccgccgtcggctcccaggcccggaagcggccgctctggggcatgaagcccttcgccggatcctcggcacagagccggacctcgatcgcatggccccgcacctgcacctgggcctgggtgatcggcagcgctgcgcctgaggcggcgatcagctgcagttcgaccaggtcgagcccggtaacggcctcggtgacgggatgctccacctgcagccgggtgttcatctccatgaagtaatagcggccccgggcgtcgagcaggaattcgagcgtgccggcgccctcatagccgatggcccgggcggcctggacggcggtctcgcccatccgtgcgcgcagatcttcgtcgaccgcgggcgagggcgcctcttcgatcaccttctgatggcggcgctgaaccgagcagtcgcgctcacccagatgcagcacattgccatgacggtcggcgatgacctggatctcgacatggcgcggcgacaggatcgccttttcgatgatcacatccgggttgccgaaggcgctctgcgcttccgatcgcgcacttttcagcgcggcgggaaaatcggcggcgttctcgaccagccgcatgccgcggccgccgccaccggcggtggccttgatcatcaccggaaagccgatccggccggcctcggcggcgagccgggcctcgtcctggtcttcgccctgatagccgggcacgcagggcacgccggccgcttccatcacccgcttggcgccggccttgtcgcccatggcgatgatggcggcgggcgaggggccgatgaacacgatcccggcctcggcgcaggcgctggcgaaagcggcattctcggccaggaagccatagcccggatggatggcatcggcgccgctggctttggcggcggcgatgatcgcgtcgatcttgagatacgaggcggcgggtgcggcttcgccgatgcgcaccgcccggtcggcctcgcggacatgggcggcgccggcatcggcatctgaatagaccgcgaccgtgcgatagcccaggcggcgggcggtgcggatcacccggcgggcgatctcgccgcgattggcgatgaggatggtggagaagggggtaggttcggccatgaccctgacactctgacggaagacgggaaggggtggggcaggccgcaggcgcatcatgcaggcgcgccgcggcccaccggtcacggcctggcgaccgagaactgcatccggcggggctggcgggcctcggcctcgcggcagatcgccagcacctcggccagcaccgcgcgggtgtcgcgcgggtcgatcacgccgtcgtccagcaggcgggagctggtggcgaagacgctcatctggccgtcgaagatgtcgatgatccgcttctgaagggcatccagctgggcctgatccggctccacgcccttgcgcttcgcggccgcggccgtgacgatcgccatggtttgggccgcctgctcgccgcccatcaccgcggtgcgggcattgggccacgagaagcagaaacgcgggtggaagccgcggccgcacataccgtaattgccggcaccgaaggatgcgccgcaatagatggtgatctgcggcacggtggcgctggtcaccgcctggatcatcttggagccgtgcttgatcatgccggcctcttcataggcgcggccgaccatatagccggtggtgttgttgaggtagatgatcggggtttccgactggcagcaggcctggatgaaatgggtcgccttgttggcgccggccgggtcgatcgggccgttattggtgatgatgccgaccgcgaaaccctcgatccgggcatggccgcagacggtggcagggccatagcgctcgccgaattccaggaagtcgctgtcgtcgacgatccgggcgatgacctgcttcatgtccaccggccgcttgtggtcgaccggcatcagcccgaccagctcttccggatcgaggcgcggcggcagcggggcctgttccggtgcggcgcgcaccaggcccgcatcccagtccagccccgccacgatgtcgcgggcgatggcgatggcatggcggtcgtcctcggccagatagtcgccgaggcccgaaatgctggtgtgcatcaccgcaccgcccagctcctcttcggtcgcgatctcgccggtcgcggccttcagcagcggcgggccggccagaaaggcgcgggtgcggtcgcggaccatgacgatatagtccgacagcccggtctgataggcgccgccggccgtcgacgagccatgggtgacggtcaccaccggcagacccgcggccgacaaccgggccaggttgcggaacatgctgccgccatggacgaaatcctccacgcggtagttcatcagattggcgccggcgctttcgaccagctggacatagggcagcttgttttccagcgccagttcctgggcgcgcagctgcttggccaggcccatgggctgcagcgcgccggcatcgatgccgctgtcggaggccgacaccatcacccgcacgcccgagacgaaaccgatgccggcgatgacgccgccgcccggaatgctcttctcggggtcggtgctgtccatcagatagccggccaaggtcgacagctcgacgaagggcgtgcccggatccagcagcagggcgacccgttcgcgcggcagcagctgatggcgcttctcgaaccgcggcttcgaccgggcagaggccgcccgcgtccgtgcctccagcgcccggacgcggtcgatcagcgccgtcatgtcccggcggttcgcctggaagctctcggctccggtcgagatggaggacgttatctgcgtcatgggccgggcacctctgccgtgcggatggaatggtcgtgtctggtctggtcctgcgggggcggtcgccggcctcgggaggagagcattgggggatgcagccggcaaccgcccggaccacagcctatcgggcccgggggcggcgcgtcttgcgttcagtggctgcggggaaggggcgaatcagaggcgggccgatcaggggcgggccgatcagaggcgggcgtgagtgcgacatggcgccgcgccggcagatgtgccggcgccctccgacccggaagaccatggcgtccgactgttgaattccgtagaatacagatgtgaaaatcgcagggcgttgccccgaactggaaagctcatcaagtgatgaatacgattgtcgaagacaaggggattgaaacgatggcggccgccgccgcgcggccggcctggcgcagcccgaagctggacatgctggatgcggcagagacccttgccggctccgatggcaccactgacggaggcatcttcagctgaccgcatcggggcggagggccggcgaatacgggggcgccggtccttcgcacgaatgttcaggtttacccctgattgccgattgcggccgttccgcaggggcgcgggtcgtcgaggcgggcgaggatccgcgacgtcgaaccgaaggcctcgctgcccgtcttcggcgctttcgacccctgccggcacccgtcgagccagacatcggaaaagcccagaggcgcacaggctccggctgccagacgccgaatgcgggcggcgcgttcgtccagcctgacgtcgttttgggtgagatcataggatgccggcgctatcagtacagcgaccagccggataaattcggcgtcggtcagttcggctggaggccgcccatagatcgtcgagcttgccgaatggaagccgaccatccagccatcggggccgttgcccatttccagcgtcgccagccacagggcgaggatctgctccttggacagacggctctccagcccaagcgcataaccggtctggcggatcttgccgatgccgggtcgaaattcttcaaaggcgagccgcttggctgcggattgggtgatggtggtcaggccggcgcccggagtcgagaaatcgacgccggaatgtgtcgtgaaattcgggtcttcgacggcgagcaggatagccagatgggctgtccccaaggcgttgcccccgcggccttgagcaatcagcgcgtcggcacgagcacgcaaacccccggcatccgatcgcgcatcccagtatcccctggcgccatacccaatgagtccgatcagcaaaagagcaatcagacccccgatatatctcaatatccgcatcattctgtcttcttatgttcggattcttgcgtcgagaattcccttaatatatgcaaggctgtgatctggatgtgataaagcgatggtcgaaatatttaagggatatgggccattccaaggcagaatgcgaggaatggcctgggcaggtcggcaatagcgctggtatcaggctcaacgggccggtcagcatcccggatgccgggcgaggatcttcgcgccggttcggatcgcctgaacagctggggctgccgctatcggcgatcatgtggcgagacagcgtcgtaatcaatcgtggcacgccggcggctccggatcttcaccgacttgaaggcgggcgagccaggcatcggcttcctctgcggtcagatgcaggcctgtgcgctgataacggtcccaggcgtgccgggcatcctgatggaaggcatctcgcttctcggcccgatcgacatagtcggccacggcctcacgcacgatgtcttcggccggctgccgacgggccgaggcgaggcggtccagacggtccttcaggtccttgtccatcctgacggcagtgtgcgtcatcatcgcctccctccagtcacagatctcaagcacagatctgtcgcatgcccgcatgtcatgactctgaatatggatgtcgtggcgtgtctatagtaaggcaaacggcgacccgtcagccaacgggctgcgcaatgccccgcctgcctgaagaagagagcgcgtcagccgatccaggcgccgatggatgccgttgacaagggcatctgccgctcccgtagcctcgttgccgacataaagccaaaggttcagaaggcctgtgcgcctgtggtacggtgaccgcatggtcaatcgtgtcgggccctgagcagccgggccttcagcagccgtcgcccctcgtggctgatgttctccggatcgaagggggttgcggggccgctgtcgatgccgtcctgcaccagcgcgcgcaactcggcaagggtgtggccgaaaaggatatgctccgcccgcgggggatgtcgatcggtcggcatcaggtgcgctctgtagccgtgaggtgcaaggcattcaattattgcacactggcggctccgcgtcttcccccgcttccacccgggcgggccgggcatcagctgtctcggcggtcagatgcatgcctgggcgctggttaagtgtcccaggcatgccagacgacatccggatggcatcgccccgtctcgtgccagaacactgcaagttgcgttctcaggcgaacatgaagttggcggccgagagatctgagatgcggatgttcagcagagatagtgacccggtatcgtcgagcgcgagggttgcatcgctgtcggtatcgatcagcttcctgcggacatcttccagcttgcgcaggttggtgcgcgtgaggtcgatgatgtccgcctcagggccatgggcggtgaagtctgcaatgacgtcatggccctggccggcttcccagacgaacaggtcacggccgcggccgcccaggaagatctgatcggtgttgctgccttccagccggtcgtcgtgccggccgcccaggacgacccgggacgaggtgacgacgtccatgggctggtccgggttgctccggagccgggcgaaataaacatcggcgatttctccgaagctgccatcatcacggagaaagctgcccgacaatggcagccagttgccctgatcgtcgatgtcctgcagacgggcatccagccggattgcggtgatgccgtgcgtagacaggccggttatctcacctgcttgtgatgtcccgtcaccgtcgatgtccatccagaccttgaggtcggcgaagattgcatcggcagcgtcgatgacgccgtccatattgtcgtcatgatccgccagaatggagaagccgtcacgatcacgactgccgaacaattcggacagatcatcgatccggccattgccattgcgatcgacggcaaggaatccatcttcggcggatagccagccatgggcgttggtgttgccgtcaccgaaatcgaaatcggcatccgagtcgagcatggagatggtatggaggccgtcgccgttcaggtccaggacaagtggggtcatgtgttccgccgactcgcgcatgaagtcaccgacgttatccagagcttttttgagttgctccccgaattccggtttgattgcgtcgaagatgtccttcttgctttcgtaaagatctgccagctttttcatgctttcgaatatattgttcgcggcgttgagcgtgtccctgtaatcttgtgggctctttgagagatccaccagggttcgctccatcatctccatggctgtcgtaaaatcaaaatcgttgccttccatctgaatgagctcatgcgcgtcaaattcaacaccatagcgttcgaacagagagttaaacgtgccaatatctgcgttcagcccgttcagcagatcacgagcctcttcaagtgcagcaaaatcctcgttgggtgtcacaattatctcgggtagaaggatagttccatcggatagcctgatcgggccatcctgagatcgcgtgtagtcgttcaggtaatcgaccatgtcagctatgctaccggtcaagttgccgcctgttgcccaatcgatgccgtaggagattccaactccgacgatcacgcccgttccaaggccgaccatcaatgatgcgcctgctgaaagtcccatggcgctcgcacttgcgacagcccaactggttgcggcctccatggcatatgatgttgctgtattggtggcataagcggctaatacgccacggattccatcttcttgatacgttgcataatattgcgccggcgtcagtgtcattctacttgcgagactaaacgcacttctgattgcggcaacttcttcgacgctccaggtgggcaggctggctgaggcatctgccaggctgtcaaataccgttgaaagatgcccgacccagtaattgaattcctcgtaactgatctgtgaattattttcgctcatgatctcttttcctgtttctcttatcccaggcatggcggatatcaccctggaactcccccatcagtgagacgcctgcaacggcgaacacacccacgatccagatgtcgccgaacagcgcccagaggccgatgccgatcagcacgagcgcgaagccgatcgtcagacgcggcacggatcgccggtagatcggggtatgccggcagaggaggtcgacatagccccgccagatgcggccgatcctggaagcaggccggctcgtttcagtatgttttgtagtcacgaaacaactgctccccaatcagcaccaggaccagtgccgccggcccgccgatcaccacgcccatcaggccggatcctgtcagcatgcgggccagggcgacgcccaggatcagcagcaggcccaggctgaagcccagccctgcggcgcggcgggccgggcttcggcgggtgatgcggaccagacgggcggtcatcagccagagggccaggaaccacaggaaggtgaccacggcgcccgcaatcagcgtgtccctcgggtaatccgtctgcatcgccaggaacggcccctggctgagcggcaggacgatcagcgcagtggcaccggccgcgaacaggatcgccagcaggatctggccggcaagccgtgccggcctgcgagggtcgggaagggccggaacgggcatccgttgcatctcctctcaggtctcctcggggatgggaatcaaccctaaagcggatacccggcacgataggaaccaggtgcctctccggtcaatatgcaaatgagaatgaatcgcgtataaatgggccatgcatgcatgcggctgacagatgtcagccctcattgcctaaatacctaaacacaggcattataccccgacccacaagaacgcgccccgcccatgcaggcggtggccagggaggaaatgcctgatgcccatcgccgtcgagcgtcgcggacgtgtcgcgcagatcgtgttcaaccggcccgagaccggcaatctgatgaatgcggcgctgttcgcggcgctgcgggatgccctgcgcgccgcggcagccgatccggcggtgcgggtggtgcggctggggtcgaccggcgatgccttcacccgcggcggcgatctgcatgaattcgtccagaacccgctgaaaggcggctgggagcagtcggcgctgtatgaatgcacgctggagctggcgcggttccagaagccgatcgtggcctcggtgcaggggccggcgatcgggggcgggtcgacgctgatcctgaattgcgacatcgtcattgcctcggaccgcgccggcttcgtgttcccgttctcaagcctcggcatctgcccggaaatcggctccagctatctgctgccgctggcggtgggggagcggcgggcgcgggactggatgctgaccagccgcaagatcggcgccgaagaggcgctggccgcggggctcgtgaccgaaatcgtgccccatgacatgctggaggcccgcgccgatgcggtcgccgaccagatcgccggctacgccggcgaggcggtgcgggccaccaagaaactgctgcaggacgtccatctggcggcgcttgaaggcgccatccaggccgagatgcgcgcgctggccacgctgatggaaggccccgccgtgcgcgaagccgtgggtgccttcttcgagaagcgcaaacccgatttctcgggcctcgcctgagggggagggtggggcgccatggcgatgtgtgacggcggcaatccgcgggtgatgctgatcggcccggagcggctgttctatgccggtctgctgggccgtcccaccacccgcaatctgggcgggatcggcatctatgtggcgcccgaaggccggatcgcggtgcaggtggcggacggccccgaccgcgtcggcagctgcgcggtggtgcccgcctacaccccccacaccatccgcgccgaaggccgcgacatcctggcggtcaagatcgagcccgagaccgtcgatcccgacgggctgcccggcttcatccgccgggcgctggccacgcccgaggccgccggcatcgttgaagcgccggaagcggtcgcccgcatccgcacagcccatgccgatctcgccgcccgcccgggcggcgcctgccccgacagccccgatttcgatcgcgcctttttcggcgccgcgatcgccccccgcccgatggaccgccgcatccgcgcggtggtgcgccaggccccggcggacatccaggccttcccctcggccgaggcctgtgcggcgctgtgcgagctgtcggtgtcgcgcttcctgcacctgttccgtgaccagacgggggtgagcttccgcaactggcgcgcctggaaacgggcgcggatctcgctcgcccatgtcaaccgcaatcccaatctggcgcatctggcgctggatttcggctatcccgaccagacccatttcagccggtcgatccgcaacatcttcggcctgcgcccccgcgacatcgtcgccggctcccgccggctcgacatccgcctgaccgacggtgtgctgccgccggccatgcagccgcccgccgtcgcagggctttcccgaagctgatcccgaccggtcgggatgggcggtccctcgaccagaggtgacgtgaccccatgacccggaccgacgcttccaccccaattttcaccgaccggctggccaccgaccagctggccgccgacctcaccgccgcccatccgcgggtgatcgatctggtggcgcgtggcgcccgcctgaacccggacggcgtggcgctggttcatctgccgacccccgaccatccgggcacggaccccgtcagccatgaccggatgatggggctggtggcggctgccgctgcgcgcttccgtgccctgggtgtcggcccgaccgatgcggtcgcgatcctgctgccaagctgcccggcgctgatggtgtcgctctgggcggcgatgtgggcgggggtggcacagccgctgaacctgctgttcacccgcgatgccatcgccgcccagctgagggcggcgaaagcgaaactgctgatcgtgccgccggaaggggcgccggcggggctttatgaaaaggtcgcggggctggaggcggagatccccgggttgcggatcctgaccgcgccgatcgatggcagcgtcgccctggacggcgaggcgctcaagcccgatcccgactggcgcacccggctcgacgagaggcgcgtcgcggccgatcccgaccgggtggcggcgctctatcccaccggcggcaccaccggcgcgcccaagcttgcccgattgaccgagcgcagcatggtcgcctcggccctgggttccatgctgtcgatcgactatcgcagggacgaccggctgctggccggcctgccgctgttccatgtcggcggtgccttcgtgggcgcgctggccgccgccgccgccggggccggcatgtggttcccgaccatcgccggcttccgcaacccggccgtggtcgcggccttctggcagatggtcgcccgccaccggatcacggtgggcgcgctggtgccgaccagcctgggggcggttgccggcacgccgaccgacggcgccgatctgtcgtcgctgcgggtggtgctgaccggcgcctcgacctgcccgccggaagtggtgaaacgcttcctggccgcctggggcggcgatgccgtgcggcaggtctatggcatgaccgagttttccggcgccatcgcccaggttcatcacgacgtgatgcccgacggcgccgcggtcggcctgccgctggcccaggtggaggtggcggttctggccgacggcgtgctgcaccgcacggcgccgacgcctgcgggcgaattgctggcgcgcggcccgcaggtcttcgccggctatatcgacccgcgccagaccgaggcggcgttctacgacggctggctgcgcaccggtgacatctgccggatcggggagagcggccagctgcacatcaccggccggatcaaggatctgatcatccgcggcggccacaatatcgacccgctgatcctggaggatgccgccatggcccatccgggcgtcgccatggccgcggcggtgggcctgcccgatacatatgcgggcgaggtgccgatgctgttcgtggtgccggccgaaggtgccgatctggccgatctggcgggcttcatggagagccggatcaccgagccgccggcgcggcccaagcgtatcgaaccgctcgccgagatgccggtgacgccggtcggcaagattttcaagccgcggctgcgcgagctggcggccgaggccgctgcccgcgcgctgctggcggcgatcgatccggccgcggccacggccgtgagcgccgccaccgacggcaccaacggcctgcatctgcggctggacctgccgcccgactggcctgccgccagcgcggcgcgcatccgcgccgcgctgggagaactgccgctgccggtggtggaggccggctgagccgggagaatcagacctccgccgcgccgccgtcgcaggggatggtggcgccggtggtataggcgccggcgcgcgaggccaggaagatcgcgacgccggcgatgtcctcgggctggccgatgcggccgagcggcacctcgccgaccacctcgtcgccgcgttcggccaaggtcgccgccatcatctggctggggaaggggccgggggcgatggcgttgaccaggatgttctcggccgccagccgtttcgccagatggcgggtcagcatgatgcagccggccttggacgaggtataggcataggtttcaaggaaagtggggttgatgccgttgatcgaggcgatgttgatcacccgggccggcgaggcggccgaggccgaggccctgagcagcggcagcagttgctgggtcatgaagaagaccgacttcatgttgaggtcgaccaccttgtcccagccgctttccggatagtcgtcgatggcggcgccccaggtggcaccggcattgttgaccaggatgtcgagcttctgttcacgcgcggtgatctcggcgaccaggctttcgatgccggtcagggtcgacacatcggccggcagtgcgatgcaggtgccgcgttccgacagcttgtcggcgatctgctggcacaccgtcgccttgcgcgacgacacatagaccttggcgccgttctcgacgtagccggtggcgatcatctcgccgatgccgcgcgatccgccggtgaccagcgccaccttgccggaaatgtcgaacaggttctgcatgggccgcagcctcccttggatacggttcttgtggttccgcgggagcataggcgtgtgcggggcggctggacaaggggcggcggcatccggttcgctctgcggagcgtggggcggccgttctgcggatcagagggcgatatcgaccgtggtgccggcgccgggggcgctgtcgatctggaaccggccgccatgcagttccaccagatggcgggtcagcggcaggccgagcccggtgccggcatggcggcggcccatggcgttgtcgacctggccgaaaggggtgagcgcgatctgcacctgatcgggcgtcatgccgatgccgtcgtcgcggacccggatcctgatcagccagggggtgcctgcatcgaccggcacggcggcgagttccagccgcacctggccgccctcgggcgtgaacttcaccgcattcgacaaaaggttgagcagaatctggcgcagccgcagcgggtcggcgatgatccgctgcggggcatcgccggcatccagcaccagctccacccgggcctcgtcggccatcgggcggatcatgtcgatacagccctcggccaccgacaccggatccagtgcctcaagttccagctccaacccgccggcctcgaccttcgagaagtcgaggatgtggttgatcatgtcgagcaggtggcggccgctgaaggtgatgttgcgggcgaaatcgacatagcgctcatggcccaccgggccgaggatccggcttgcgatcgcgtcggcatagccgatgatcgcattcagcggcgtgcgcagctcgtggctgacattggcgaggaagcgcgacaggatggtgttggcgcgggccagttccgccgtgcgttcctccacgcgccgttccagatcggccttggcggccttgagcccgtcggtcagcgccaactgccggcgctgggcctgttcctgcgccctgagatagacgaaggtcaggatgatcaggcccagcaccgaaatgccggccagcagcccaccggcgcgaaagctggtgaggacatcggcggtgtgggtgtccagttcctgctgttcgccgttgcgcagatcgatcaacaggctgcggatctcgtccatggaggcggcgccctggccctcgcggacctgatcgaccgcggcggcgagcccgcccacccggcgcaggatgatggtttcctcaagctcggtcatcttgcggaagacgagcccgggcagccggtccagcagggcgcgctggcggttgatgccgctgaacagccggtccagctcgtccagatggcggtcgaccagggggcgggcgctgtaatagggggcgagataggcttcgtcgccggtgagcagaaagccgcgctggccggtttcggcatcggtcaacgcggtcagcagcccgtcggcggcggcaatcaccgcccgggtctcacgcacgcgatcgaaggcatccgccatgcgggtgccggcaatggcgaaggcgctgcagatcgccagcgccaggatggcggccacggcaaccgtactgcggaacgtccagcgtcgttccgacgtcttcagatcctcgtcctctgccacccgatcatccgacatgaggatcatccgtccacaggcaggcgccgctcccctgccacctccggcatggacacccatccccttgttgcatgatcatcacgaagaaagtgtaaacaaatcgcctctgttcccctgtttgtggtgcaaagccgcgctgaatgatcaagaccgtcggattgttcgtgataaccgcgcttgccgagattatcggatgcgtcctgcccgcgctatggttgcgtggcgcggccggggcctgggtgctgctgccgggggtggcggcgctcgccctgttcgtctggctgctgaccctgcatccggcggcgagcggccgggtcttcgcggcctatggcggcatctatgtcgccacggcgctggtctggctgcgggtggtcgacggcgtgcggttgagcctgtccgactgggccggggcggggctggtcttcgccggcgcgctggtcattctggcgcagtggcagcggtagggatgggggcagaggtagaggcgggggaagataggggatcggcggcgagccccagcgtcccccgtgcccgcgcggcccggtcgtccggcgcgccatccgccgccagatgatgccagtccgtcgggccggcgctgccggcggcgcgggccagctgggcgcggacgacatcggcatcggcatccgacgggtcgccccgccttgcggtcacacgttccaccagcaccgcctcgggcgcttccagccacagcccgtcgaagggcaggtcggcggcttccgccacggcacggatgcgcgcgcgggtgtcggcgcggtcgaagaccgcatcggcgatcaccgaatggccggcggccagcgccgccgccgcctctgccgccatctctgcatagatccgttcggacacctggggcgtgtaggcctcggcgggcaggcgggtggtggcggcctggccgaaggcacgcttgcgcagccggtcgctggcgatgatccgtgcccccggtgcggcgcccagatcggccgcaagggctgcggcgatggtcgatttgccgctgccgctgaacccgcccacggccaccagccggggcggggcgggggccagcagccggcgggccagatccagataggcgccggcctcggccgcgatccggtcgcgatccgcgccgctcgcatccatcgcggcggcggcccccacatgggcgcgcaccaccgcacgcatggccaggaacagcggcatcagcgccagccccgggccccggtcatgggcggcaccggcattgtcttccggggcggcatccagatagcggttgaacaccgcggcggcggcggccgggcggccccgatgcagcaggtccatgatcagaaaggccagatcatagagcacatcggtgatcgccagatcgtcgtcgaattcgatgcagtcgaaggcggtggggcggccgtcgatcagcacgatgttgcgcagatgcagatcgccatggccatggcgcacccggccgatccgcccgcgcgcctccagcagggcggcattggcggcgaaggcggcctcgctcgccccgatcaccgcgcgcgcgaccccgccatccagcagcccggcggcgatgcccgcctccagcccctggcggttgatctccagcacccgccgcacccggtcggcaccgccatcgggcccgatcacccgggcggcggcatggaaatcatacaccgcctggcccagcgcctcgatcaggccgcggttcagcccatcctgcccggccaacccgtcccgttccgccagccggtccagcagcccgtcctcgtcgaagcggaccatctcgaccacggcatcgaccagcggacccgccccctccatctccacccggccgtcggggccggcggtcagccgccggacccccagatagatcccgggcgcggtgcgccggttcaacgccacctcgcgcccgcaggcggccgcacgcagcgccgcggtgccgaaatccagatagggaaaccgcaccgccttcttcagcttcagaacgcgcgtgcggccgatgaagaccagcgagatatgggtctccaccagccgcggcggcacgccgtcgcctgccgccagatgctctttcacgcaggcgatcgcagcgctctggtcttcggtgtgcatcggatgtccatcccctcgccggaccatcgggcagcgccatcataacgcaaggcgcgggcggggtggggtggggatcggggggtgcggcgacaggtccggggtgctgggcaggccgccgctcagaacatcagcagatacacgatgatcatcgccagcaccgccagcgacaggctgatccacagcacatggcgcatgcggccggtggtgcgggcctggcgggcggcggtgcggtcttcgaccggggggtggccggccgggttgaccggggcgtcggggccgggggtgccgggggcgtcggcgcccggatgggggccgggggtgatgccctggccctgctggcgggcgcgttcctgggcgggggtgggctcgttcattgcgggcctccgcgtcatgtcgcttcgggcgcccggttgggcgtccgcttgacctcggaactgccgggccgggcacaaggttccggacaggggttatgttgcggggcagcaatccgcctgccgcatacgcaaaataacgtatgggagccggcccccggcgccgctaggctgatggttcacgggcgttgaaccgcggggaggcggcaggcgggcgtatggcggatgccgggagggtcagcagcgggcaggcagggggcggcggcgtgtccggcggcggcgtgtccggcgtcaggccgggcacggccgcgccgcagcgcatcgttcgcgtccgccggcagtacaatcagtgggtcgcgaaccagacgctggaagactatgcgctgcgcttcaccgccaagagcgcccggcgctggtcgccctggcgggtggcgaataccgcgctcggctccatctcgttcctggcgctggaggcgatcggcggcgcgatcacgctggcctatggcttcgacaatgcggtggcggcgatcctgaccgtttcggtgctgatcttcctgaccggcctgccgatcgccgcctcggccgccaaatggggggtggatatcgatctgctgacccgcggcgccggcttcggctatatcgggtcgacgatcacctcgctgatctatgccagcttcaccttcatcttcttcgcgatcgaagccgcgatcctggccatggcgcttcaggacctgttcggggtgccgttctggatcggcaccatcgcctcgtcgctggcgatcatcccgatcgtgacccacggcatcaccctgatcagccgggtacagaacctgacccagccggtctggatcgtgctgcagctgctgcccttcatcgcgctggccctggccgatccgggcatttttacccgctggcaggggtttgccggcaccgagaccggcggcggcgccgggatatctgcgggcggcttcgatctgatggctttcggcgcggcttcgggcgtgctgttcgcgctggtcgggcagatcggcgagcaggtggatttcctgcgcttcctgccccgccgccgcggccggcgcgatctgcgttggtgggcggcgatgaccgcggccgggccgggctggatcatccccggcgcgctgaagctgctgggcgggtcgctgctggcggttctggcgctggaggcgggcgttcccgtcgcccatgccgacgagccgacccggatgtatctggtcgccttcggccagatggtcggcaccgatcaggcggcgctggcgctggggttgaccggggtgttcgtgctgctggcccaggtgaagatcaacgtcaccaacgcctatgccggctccatcgcctggtcgaattttttctcccgcctgacccacagccatccgggccgggtggtctggctgatcttcaacgtcgccatcgccgtgctgctgatgtctttcggtatctatgaagggctggagcacatcctggggctgtattcgatcgtcgccatcgcctgggtgggggcgatcaccgccgatctggtgatcaaccggccgctgggtctggcgccgaagcggatcgagttccgccgcgcccatctctacgacgtcaacccggtggggctcggcgccatggggctggcggcggcgggcgcgatgctctgccatttcggcgccttcggcgcggccatccagcccttcgcggccttcatcgcgctgggcgtgccgatgatcgccgccccggccatcgcggcggccggcggccaccgcttctatctggcccgcccgcctgcggccatggccgaagatacagatgggggtggggcagcgcccgagccctgcgtgatctgcgaatacagtttcgagcccgaggacatggcgcaatgccccgcctatggcgggcggatctgctcgctgtgctgttcgctcgatgcccgctgtcacgacgtctgcaaaaccgatgcccggctgaccgaccagttcgcccagctgctgcgccgggtgatgccggcggcggcgcgcagccgcaccctgcatccgctggggctttatctcaccatcctgacggtctcgctgggcgtgatcggcgcagcactggcgcttgtgggggtgcaggcgcatctcgacggcgggccgcccgggccgggtgcggcggcgacgctgtggaaggcctttgcggccatggcgatcatcgccgcggtggcggcctggctgttcgtactggcgcgcgaaagccgccaggtcgcccagctggaaagcaaccggcagacccggctgttgctggaagagatcgaggcccacaaggcgaccgatgccgagctgcagcgcgccaaggaggcggcggaggccgccaacctcgccaagacccgctatgtggtggggatcagccatgaattgcgcgcgcctttgaacgccatcttcggctatgcccagatcctggaacgcgatgccggcatgccgccggccaggcgcgatgccgtgcgggtggtgcggcgcagcgccgaacacctggccgggctgatcgacgggctgctcgacatctcgcggatcgaggcggggcatgtgacgctggcgcgggagcgcatccggctgggcgatttcctggaccagctggtcggcatgttctcgctcgccgccgccgagaagggcatcggcttcgtctacgatgccgcccccgacatcgcaaccgtccaggccagcggtgccccggtcgaggtctggacagacgagaagcggctgcgccagatcctgatcaatcttctgtccaatgcggtgaaattcaccgatcgcggccaggtgaccttccgggtccgccgccgcagccaggtggcggagttcgaggtgatcgacaccggcatcggcatcgcgccggccgatcttgcgaagatcttcgaacccttcgagcgtggcggatcggcccgggcgcgggaattgcccggcaccgggctgggcctgaccatcgccaagctgctgaccgagattctgggcggcgagatttccgtcaccagcacccccggccagggcagccgcttccgtatccgcctgttcctgtcggatgcgggcgtgcacgatacgggcgagccggcggccccgccccggcccgcccgcgacgtgaccggctatgccggccggcggcggatggtgttggtcgccgatgacgacccctcgcaccggtcgctgatcgccgatgtgctggcgccgctggatttcaccctgctgttcgcggccgatggcgaaactgccctggcgctggccgaacgcttccgccccgatctcgtgctgctcgacatctcgatgcccgatatggacggctggacggcggccagggagatgcggcgggcggggttggatcacaccgccatcgtcatggtctcggccgatgcccagatcgaccgcgacctgatcgatcatgccgcaaacggcggtcctccgccgccccatgacgccttcgtgccgaaaccggtggatctggaccggctggtggagacggtgggccggctgctggcgctgcgctggctgcatgccgaccccgaagccgagcccgaggcggcggcagacacgacgccgcctctgccgcggcaggggccgtctctgccccggcaggggccgggcgcggttctggcgccgctgccggcggcgctggttcaggatctgcggcggctggccgccatcggctatgtccgcggcctgatccagcggctggagagtgcggcggcggacatgcctgaacatgcagcgaccgccgggcggctggtcgccatgctgcagcggttcgaactggcggggttcgatgcggtgctcgacggctgggatgccgagaccggccgtgcggaaagccaacgggagagcgggggatgatgatgaccaggccgcgcgatatcgtgctggtggtggacgaccgggcggagacgctggccctgctgaccgatgcgatcgaggcggcggggttgaccgtgctggtcgcggcagagggcgcccgcgcgctggacctggtggagcgggtgacgcccgatatcgtgctgatggatgcggtgatgcccggcatggacgggttcgagacctgccagcggctgaagacccggccccatctcgcccatgtgccggtgatcttcatgaccggcctcgccgaaaccgagcatgtggtgcgcggctttgcggccggcggggtggattacgtgccgaagccgatcgtgcccgacgagttgatcgcccgcatccgcacccatctggccaatgcccggctggcgcagagtgcccgtgcggcgctggatgccaccggccgtcatctgctggcggtggatggtgctgcacgcctgctctggtccacgccccaggccgaggcccggctggcggcggccttccccgcgcgctgcggcggggccggggcgggactgccgggtaggggccagcctggtgggagcctgccggcaggcttccggctgggggccgaggcgacggcctggcttgccgtcccgggggctgcggaggcggccccgctgaccctggccgtggaggtcggcctgccgctctgcctggcgctgatcggccggctggggcccgacgagatcctgctgcgcctgaccgaaggccgcgaggtccgcgacgaggatctcctgcgcgaggcctttggcctgacggcgcgcgaggccgaggtgctgctctgggtcgccaacggcaaggccaaccggatgatcgccgagattctggaactgggcccgcgcaccgtcgacaagcatgtcgagcgcatcttcgccaagcttggggtcgagaaccgcaccgcggcggcggcggcggcactgaaagtcctcgccgggcggtgaccgcccgcagggcgaaaaccggcgcaggcggcaccggtccgtggccgaaaccggaccttccggcgttatttgcgccgggctgtgacctcatgatggtcgcttcgtggcttctgccgtcaccggcttgtgcctgttcctctccatgccgatgtctgaaccaggacggcggatacgagcctccgccgcatcgacagcaatggagaccgagaatggacaaggatcgcgttgaaggcgccgcccgccaggtcaccggcaagatcaaggaagtcgccggccgtgccaccgacgaccccgccaccgaggccgagggccgcaccgaaaagaccgccggcaaggtgcagaaggaatacggcaaggccaaggacgaggtccgcgacgcgctcaggaagtgagccgccgcaccgccgacccgtcccaccccgttaccggagacgcatcatgaacgttaccgacaggatcattcgcctgaaggtcgatctcgccgcggaccggcagacggtgtgggaggccctgaccggcgcgcagcatgttcaggcgtggtgggggaggcatgtctccctcatacctcgcgccgggggcaggttgttcgtccggggcgacgggcgggagcagtcgcgccaggtgcgcggccgcgtgctccgctggtcgccgccttccgcactcgagctggcctgggcagatgccgcctggcctgccgagacgcgggtcaatatccgcctgatgcccacccccgacggcgacacccgccttcagctggaccatgtcggctggtcgggcttcgaagacaaggcccgcctgcatctgatgcaggccgcagaacgcgactggaccgcccggctggaccggctggaagactatctccgcgccggcgacatcgcaggcacggtttcccaggcccagagcggcggggcacgtgcctggtagggcacagccccgacctgcatctataagacgacgcgccgccgccgccccacattcaagggttgcggcggcggtgtgcgccggggggtgcgcgtctgggctctggcgatgaaccgccatccgggctatgcagaaccggctggcccgcatggcggggcccaggctgccggagaggatgcatggagcctgtcgaaaccgaccgcttgatccttagaaacttccgcaagagcgatgccgccggcctgttcgcctatctgcaggcgccggtggcaggctgttttctgtcgctgcggctggagagcctggcggccgcagaggccgaggcggaacagcgcgcgggcagtgacgagtatctggcggtctgtctgaagcagaccgacagcctgatcggcgatgtgttcgccatgcaggaagacgatacctggtcggtcggctggaacttcaatcccgcctggggcggcagaggctacgccctggaagcggcccgcacgctggtcgcatggctgttctccaccggaagggctcgccgcctctatgcctatgtggaagaccacaacctggcgtcgcagcgcctgtgcgaacggctgggcatgcgccgcgaggggctgttcctggacttcgtctcgttcagaactgatgccacgggcgcgccgatttacgagaacacgtttcagtacgccctgttgcgcagggaatgggaagccggccgctgaagaccggcctcccgcccctcgtcatccgatcgccgaaaccagcttctgcaactccagcagcggccggtccaggtccgggtcggtggtggaatagaggctgatcgagaagccccagaccgcgccggtggtgacgggctgggttgcctgctgccactggccgacggcctggatgatccccgacacggtgccgttggtatagtcgtagcgcgggtgcagcagcaccggcagcagggtttcgatcgaatcggcccccgcctggaccagcgtgtagccatagcggatcgacaccgcgatctgctggccggccggctggccgtcgaacatttcgttgaacaccgcggtcagcgggttggtggcggggtcggtggtccaggcgccgatgtcgatccgctcctgcaccgtgatcagcggcaccagcggttcggggaagcccagctgcggcgtgcggtagacgaaggccgagctggtctcgggcccctcggcgcccagcagccgggcattgcggatcaccgaaacgccggcggtggcgttctggaaggccgcgatgtgcagcccgccgatggtgtagcggaaggagagccgcgagaaggccggcatcagcgtggcgccgtcgcccagcggaaaatcatagatccgcatggcgccggtgggctcgcgcccggtaagggcggcggtggcgccgtcgtcgcggatcaccaggatctccggccagtcgaagggcaccgcctcgtcgcccagctgctggagggtgagggtggcatagacctgcaccggttcggtgatgccgaccatggtggtgttcagcgtcgccagatagtggaagaagctgtgtaccggcccgtcggagccgtcgagtgcccggccgagcagggcggcccggcccctggtggtgcggtgggcggggaccagcccttcatgggcggggcggaccaggcttcgtgccgccaccagatcgtcgcagctgcccaccccccaccaggccgaccagcgcgccgccaccttgccggccagtgtggcataggtgtcgagcgtggcggccagcaccgtgtctcccggcccggcggtcggcgcctggagcccggccaggatctgccagaaggtgtcggcggcggaggcatactgggcgagcagggcgaagagggtttcatcctcgtccgccatggctcgcagcgccgggtccggctggcggttgaattccagctcgatccggatctggtcctgatcggcgctctgatgggtgtaggtgaagacataggcccagtgcaccgcctctgccacgctctgcggatcgtcgggcgtggtcgcggtctgcgaaatcagcgccggcaggtcgggataggcgcgcagcggcaccggcacctggggcgtctccagatcggccgagaaggcgggcggcgcatcggtttcgaagggcagaacgaaggtcagccagttggaggcgtcatagccgctgtcgacgggcgtgatgccgaattcgatctcgttgaccgcatagaccggcttcagccgcaccgagcggtgcagcgccggctgcgagacgtcgagcgtgaacgagaccggtgctttggcatcggcgggggccgtcttcagcggcagcttggcgttgccgagctgggagaccttccaggcattgggatcgccgtcgccgggttgtccgctgcccccgccatcgaccggcacctccgaaagcttgccggcgccggagaggcgcgcggtcgcggccgcggcgggggccgtgacctcggctgcgaattgcagcacggcggtggtgtcgtagccggcgcccagcgtgcgcagcaggcgctgatacagcacctcgcgcgccgccttccagccggctccgttgatggcgccggggcccgtatcctgctcggccaggatcgccgacagcccgtcggccaccgcacaggcggtgagtttcttggcgcccaggatcgactccagcgccgtggggttcacccgataggccggcgcggcatagggtgctgtgcagatcagatccagcccggccagccaggaccgcgcccagacctccagatcaatcccctgaaagtcgtaggtttgggattttccccaagttccggttgcaggatccagggtgctgatcgtgaccccgctttccgcctccagcgtgttggacagcgggcggagaccgaagctccagggctggggggaggggttccagtcgaccgtcagcggcggcgccagatcgaccttggtgatgccgcccggatcgacgaaagacaccgcccagacatcggtgggcgccgggtcgcgttcggccgagagcaccttgccggtcgcgatcttcagcccgtcgatcgcggcttcgatggccgcggcgaagacgtcgagggtaacggcgccctcttcctcccgctctggcgccgcactgcgggtgacggcgatcgggctcgccacctgtgccacgggacccggatcggttccctcgtggagaaaggcggggtccaccagacgcgggtcgcgcgccagcgtgatccaggtcctgagcgggaagatgacgtcggggaactgccagccgccggcgccgaaaccggcctccagccgggtatcggccggcggcagcagcagtttcgcggccgccgcgatccaggcctgatcggcattgccggtgaccacgtcgccgatggtgaccgcgatgcccgccgcggcgaagcggcggatgatggcgttcaggctgtcttccgtcgccgtggtgatggtgggtgtggcggcaacgggtgaggggcggagcgtcagccccgctacgatcaccccgggtgttgcggcattggccgacaggatcagggtcgggtccagcccgtagcgcgcgcccagatcgggcggggtgagggcggcatctcccgtcagcgccgggccgcagagcagcagcccgccggtcgccagcgcatccggatcgtcggcgatggcggcggcgaaggcatcgatcgtcaccggcggatcggcgcgggcgatcaccgcatcgaaactgtcgcccgcttcggtcgccagcgcctggccgtcgacggtgatggtgcgtccgcccgccaccgtgccgggcatggcgcggttggcctgggtcagcgccacctctgcatcgctgccgaggggcacgaagcgtgcggcgatcgccgtcatggtggcaccgcccaggatccgccaggggatacggatcgtggtcggatcctggggccaggcagagaggccggggatgggcagaccgctgccgtttgaagggggctgtggggccagcccggcattgtggcgcagcaggtcgcccggctccacgccataggcgcgggcggtggcgccgagcggtgcatccgccaggcccgtgacgctggtcgttttcaggaacagcggcgcgccggcggggaagagatcgatggtgtcgatgttgagcccggccagcgttgccgcggtctggccggtgtcgttgtcgtcgagcgtccagccgtcgcggatcagcttgcggtcgaccgtcagcgtcacgcccgtgcggaacatgcccccggccgcggcattggcacccaccgtcatcaccgcatcatagggcacgccattgtcgcggaaggtggcggcgatgtcgtcgagggtggcatcggcgccgggttcccccgttgccggcacctccacctcgatgccctgggcgctgaacacgaagcccggggcgagcagggcggggcggtccatattggcggtggtcaggctggcaagcgttacgccgaaggcctcggccagctcaccggccgagagaccatctgccggctgggcatgttccgccgccgggatcaccagctcggtgccgggcagcagcggcagcacgatgttgtcgtcatcgcccagcaccgtggcgggatcgagccccgtgggcaccaggtccgtcaccgtgctgccggcggtgaagaccacgtagtccggcaccgcaagccccgcctcgggcagggtgaccagctgccccaccggccgttcgccggccgccaggcccagcgcctgccagtcgagcccgtagcgcgtcacaacatcggcgagggtgggggtgacggtgggatcggccaggctggcccccatcaatgcggcggcggttgaaaaggcatagcaggccgagacatgggcgcgcagcccgtccatcggcaccggcagcgccgtggggctggcggcggccggctggtccagcgaggtggagagtgccgcggtgacgtcgggctgcatgatctggtaccagatcgcgccgaagcgcgcgccgatatcggccgcggtcgccgccgcggcgtcgcccgcgaccgtgccgccggcggtcagcccccccggctgcatggcgatgcgcagctgcagccgggcgccgacctggccctccgccgccgaggtgaccccccaggcgacgctggtcaccggccaggaggtgacgccgatcatcgggtcggtatagccgaccaccatgtccacggtgccggaggcggcgtcgaacgaaactgcggcgctcatcatgcgtctccttcggcggtggcgttgccgtagacgtcgtggaagcccagctccacggtcgcgaccggcggtgcggtgcgcccgcttgccgagatgccggcgtaagggtcgcccgcctggggcggcaggcccggaatcgccggcaccgtcggcgtcttcgcatagcggtggatggggatcacctgcgacagggtctggtcgttttcatccgccgcatcggccgtcagccgtggcgtcatgcgcatccggtccaccgccgcggcgctgccgtcgacccggggcccgaccgggctgccggcattgctggcggcgaaggcctcggtctcgggcagctgatagccggccaggttgtacaaccggcgggcgcgcagatccgggtcgtcgcccgcatccggcgggttcaccagccccatggtgaagccgacattgccctgggcgacggttgcctggcgggtctggtcgcgatcatcgggggccgccacgaacagcgcggtcgcggcgggatcgatcgggtcggcgaccagggcggcggtgttgaaggaatgcagctgccggtcgggatcggccgccgactggctggccagcagggtgatgatcgtgacggtggcggtgccttcctggctccagatctcgtcgccatagccgttgccgtcgccatcggtcagctccagccaatagccgccgccgcccaccacgctcgcctcccacaccagtttcaggaacatctcggcatcgccgaccggggcgaaataggggctggagggcggcaggtcgccgtccgccagcgccagccggttggccgagagattgcccgaacgggtttcggtcgacagattggtgcgcacgatatagctggcgccgcgatcgatgccggtggtggtgagcccgccgggcaggccggcggccggcgacaggcggaagccgaaatacagcaccgcattgtcgtcgggatgggtttccagatagcgccagagttccagcagcagctggcggcccgccgtatcggcgccggtgacgctggcggtgttcggccggccgggaatgcggctgatgccgatatcgatcaggctggcccagatggagcggtggaccggcaaagcggggctgtcgggccccttttccggatcggtgcgatacagctgccaggggccgccatcggccgcggcggcaatcgcggccagatcgctgccgaagggccagaaggacggcatgccgatgctcgcggtcccggcaccctcgcccagcgccggcagattgatctggttcggcgtctgccagatcaccatctgcgacaggccgtggcgcaccggcacgtcttcccaaagctgcagcggcgccggcggcgcgctcaacacgggggtcagcgtatcggccggatagccgtcttccagcatcttctcggtgacctggatgaccagctgggtggtgtcgtccacctccaggatcatgcccgggcggatgcggcccgcggcggcggccgggttgcgggcggccagaccggtgttgcgggcggtgaaggcggcgagcccttcggcgggcggcgcggtttcggtcgcaaccagggtcagccagggcacctccaccgtttcggtgacggtcagggtcaggcgcacggtttcgggcggctgggtggtgtcgggggcggggccggtgacctgctggccgatcaggtcgtagagaccgctcaactggctgttgtcgccggcgggtaccggcagacgctggccatggagcatgaagcgcgagacctggcccgcgacatcgcgcaccggcgcatcgccggtcaaagccggcatcagccggtccagcccgatggcggcaagatcgggcacgatcagcggcagcgcggcatccaccgcgaagacccccggcacatcggccaccaccatgccggtggtttcgatcgccagatcgtaagaggtggcgaaggcgcgcagcgtctgattgtcgatggtggtcagccggcaatcggtgaccaccaccggggccagcggcgccagaagatcggtggtcgccacaaccgttcggaagttcgccgacggtgtcgccggaattgtggttgcatccgccaccatcagcagccgggccgccagcgcgcgcaggctttcatcgggcaggagggcggtggtcgcggcgggcaggatgaccggcccgccagcatagccggggttcagttcgccaaccgcggccgcccaggtggcgaaggccggatcgacctcggggttctgccacagcatggtgacggcggcgagcatcggcagggtgtcgccggccagccgcgtccagtcgaccgggtcggtcagcacgtcgaaggccgagggcagcttcaccaccgccggcaggctgccatcggcgccgatgctgtcgccgttcaggctggtgatcgcttccgcataccagccggtttcgggcagcagggtgacggcgggggtgccggcattcagccggacgtaatagagcgccgccgcctgggtgatggtcaggccctgaagcgccacaccggcgccctggggcagggcgaccggcgcgccctcgcgggtgatcgccggcacgtcgagggcagccgccgtctgcagccaggcatcgaccgaggcacccagccgggcgcagagccggtccggggtgtcgccggtccggatctgggtttccagggccgcgacccgggcggtcttgcccggggtcagcagccgctcggggttggcggcggcgatcgccgccggggtcacgcccagcgtcacgctcaacaccgtgcccggtgcggcatcgtccagggtttcgacgatgccgggattgagcgccacgatctcgtcggtgtcgtagccgtaggtggcggcaagctgggcgacggtatcgcccagatgcaccacatagggcatctgaacggtcgggaagctgccggccagggcggcgagggtggtgtcggcgtcgatctccacggggaagcgcgtgaacaggccctgggccgcctggaccatgtatttggcgaccagcagcatgtattcgcggaacaccaccgaggcgagcggctcgttcgcctggataccggtcgagacggagccgccatcgcccatgggctgcggcgacagctggcggaaataggccgcgatccggtcggcataggcgtcgtcgaccggctgatacagcgcgaaattgcggtcgttttccggcggcggcaggtcggggctggtccagcccagcaccggcgggatcgggaaggcgacgccgggcagggcatcgggatcgtcccccgagggtgggcccgagaggtggaaatcgacattgccgcccaggaagccgctcagattgtcgaagccgaaaccttcggcaaaggtctgcgggcaatccatctgtgcggccagttcggccagatcgccggcggtgagcgtggcggtgaccggatccagccccagcgccgagaccgcccagcggaacatcgcctcggccagcagggcgaagggcgtctccgcctggtcttccgcccgcgcggtggcggtgaaggcggccgtgcggcgggcttccagcgtttcggcatccaccgcgaccgggccgtcgatcgccagcatcatcaccatccgccgggccggatcggcggccggcggggtgctgccgccgggccaggccaccgtcatatcggcgatggtgaagcccgggaccatgcgcagatccagggtctgcgtctcggcgaagaccttcgcatcgggcgagaagttcagccggtagacgccttcggcgcagggatcgaggacggcggcggcggtctctgccagcaccgccatctggcgggcgatcggatgggtcaggccatgggccgcatcgctgcgcaaccgggcgcgggtcagcatccgggtcatgcgcgccatgtcgccgggccgccggcggaaccgctggccctgcccgcgcgaggcattggcgagcggcaccaccccgatggcggcatagcggccgagggcagcgctgcccagagccgcagaattccgttgatcgaggctccgcccggactggtcggccgacaggatccagggtgtggtcgaggccgagcccacggtgaacgagacgtcgaggctggtggagaaggagaaggagaatttgacgaacacgatcttgatcgaggcatggacccgcacgcccacgctcatcgcgatcacggtcggccggtaagcggccaaggtcagggtcgccgaggcataggcttcgaagctgacatcgaccgcgatgaccttgaaatcgaccttgccatagaccttgccgaccagggcggcggtgccctgcgcccagtaatacatcgccttggaggcggcggcatcgtcggggtggaaccaggcgagcacgccttcgaacaccacctcgacctgcagataaagcccggccttcagcggccccttgttgaattcgcggccgatgccgaccgcaagcccgaggcccagttccagcacgggggagaaggtgccgttggtgatggccggcacccgggtggaggtggcgccgttgagcaggccgaaatagatgccgcccttgcccaggaacggcccgtattgcagaccgaaagaaaccgagaaatcccgcttgtgcgggaagcccagatcgaccttgaaattgccgttggtgaagacgtcgacggtgatgatgccgagcgtgatcgcgaccgcgccgaaatccagctggcggaacatgtccggcacctgaaggcgggcatggaacacgccgatatcgtcggtgaccttcttgtagagcagttcgaaactgaagcccgacagcgtgccggcctcgggcccctgcagcgcgatcagcacgccatagagaatgggatcgttcatcaccagcttgacggtcgccgtgcccatcagggtcacgtccagaccgatcagccactggctggattcctggaaatgcagctggttgccgctcggctggtccagcgggttgcggttcggatcatccaccggcctgagctgggcgcgcatcagccggatgacgtcggccagcgaatccggccgggtcagcccttccagcgtgacatgctggccgaagcccatatagcgcagatcgaccagcgaattgcccttgcccggcacggcgggcgggctgtcgttcagggcatcccagcccagcggcgacatgcccggctcgcggccgtaatccttgccgaggaaattgccggtgatctcgatattgacctgcggctcgccggtcttgcggtcatagcggatgccgaccgtcttgatggtgatgaagccgagcgtcaggttgatggcgtaattgagcgtcaccgactgttcggtggggtcgatgatcagcgtgaagctgccgagattgatgtcgttgaggaaggtccagggcgcggagagccggtaattggcattggggttggccagcgccgcgaagctttcgaccatggcgccgagcgtgacgcccttcatctccaccgtcagcacctgatggcgcttggccccttcgccggtccacgaggtgcgggcctccagcgagaagcggtcgagatccaggcggaacagccaggtgagttcctgggcgaggaacgagaatccgagcgtgacgatcagattgttgatctcgaaggcgcctttgacattgccttcatagatcatttcgggcgcatcgcccgcggcggcgtcgcgcaggaccaccgcatgcagctgcgggcgggcgcgcgacagcccttcaaggcggatgcgatcgctgatggcgagcatgccggtgccggctttggggcggcgctcgatgctggcctcggccagcaatgcgagtttcaggcccagaacctcggggtcccagcggacggccactgcggcgtccaccttgtaggggttgccggtggaggtggcatagcgtgcccagagccgggtcagttcaagatccgggagccagtcgggcggagtttcgccaagaaaggcgtaaacgaattcagtgaggttcagctgtccggtggcaagaccaccctggaaggcccagctgccgtcaccgggataataggcaccggcggcaagctgggttgctgtctcgccatcgaccgagacgccgacgatgcccgacaggccgccccagatctgcgagggaccgaccgtcacctcgaaatcgatcgcatcgagcgtgaaggtgacgttgccgatcggaattgcccaggttccgtgcgcagacagggtggcgccataggtcttggcagagatatcggcgctcatggtcatgcggtcgaccaccaggccggggccggtctgcggctgggtgccggggaagaacaccgacattgccgcggcgaggtcgatggcaaaggccccgcgtgtttccgcctcgatgcgcatgccgggcagggtgacggtgacatcaagatagaccggattacccgactgatcggtcggcgcattggccaggatggccgggccggttccttcggccgttttggcaccgaacctcatggtgccgaacaggattgcggtccagctggccgtgccgccggtccagttcatcagccagttcaccccgacctgctcgatcaggatgaacgggattggcggatcccatgccgtcgtggagacgatggtcgcaccggtatagctggtgcccgagggaagcggcggtgagccggttgtctgcagaccgtaacgcagggccgccagaccgaaggcatcgagggccgccgtacccggtggcaggctgaaggtcgaggcttcggcgcccgggaagaggcgcatcagagcgatgatgccgtcgctcagcgtcaatggcggatcgatttgcccggccagatcccagagtgatccgggaacgagaagcggcatcgtgacggtcacgtcgtgcggccggccggtatcgaccgacagcgtcagcgacagcaggacgctggatgagttcggctgcggtgtctgaagactgtaagtgtcgatcgtggctgtggtcaggacaagggatacggcttcggtggggatcttttcccagacaccgcccggatcgggagccgtggccgaaagcgtcactttctgtgccgccgacgcatcagggcgcggatcaatctgccctgatatggacagtctttcggcgccgaccagcgggatataaggcgcaaggcttgagtcgggcaggaccagccaaccgccgatggcgggcggatcggccggcaggtccgccgcgtctacggcggtcacggcaagggttgcctgctccggccccagatcggccaggaccgacgtccccagagactgagcgccggcggccacggtggatggccggcgggatttggggaggtcgggaaccagggtggcgaagctgacgaagccgcgttcggtgcgtgcggtcagcatcatggcgatgacgtcccgcccggcttcgtcgaccgttccggtcaggaccgccgaccaggaagtgtcgtctgcccagacgatgtcgccggtcagctgggccgaggcggggaagcgcgtcgcccggccctgcgtcagcggcagcgtctccacacccagtgccgccgtcagcttgcccatcaacggcaggatgtcggcaccgatatgaccggcacccgcggcccggacgaaagcgtcatacaggctgttcacggacatgggttgctctccgacgggcagatgacgggaatggggcagcgtgcgaaatggtcagcgaagggtgaccttcacccggcgcaccggtccggatcgccggggctctggtgcggcattcgccgtcggttgcggcgcatgagacgcggcaggtctggcggggttggagaccatcccgccggactcgacttcctgttccggaaaacggcctgtgaagctgcgttcccccgcccagatcacggggcttctggcataagccggatccggccgtgccgttgccagttcgccgaacgtgctgccgaactcgccgtcgaacaggctcccgtccagagcctgttgctccgtggcccgctgcgcggccagctccatctcgtttacctgcggtgcggacaggatcccgggaacacccgcgttgaacacctgaacgccggtatcgtgtgtggtgggcgtgatgctgaagatccagttggccgtcacgaccggttcggtcaggctcagcacggtcgtgtagacattggcatcctcgctcggaatgatgccgaacctgtcggtcggtgtgtcgtaatagacgatggggcgtgcctggaactgcagcttgccgacatgggcgcccatcgtcctcagaatgatcagatgcgggtggctgtgcgtgttcttgtgccccgcactcgcaaagatcgaataggggcgcatgtagttggtcagccagatcagatccctgagatcgggcgtgtcggtcgacgtgctccggttcatcgtccgcagggcgccatgatgcgggacggatgcggcgtagacggcggggatcgggttcttttgccagaccgacatgatctgttccaggcgggcaaacgtctcccaggtcgcatcaccgggcagaaagaaagcgagctggccaagctggagcaggaagactcccgaagagcagttccgttcgatatcctcggacgtctcattggtcgcgacattggtgatgagcgtccatacgctcatatcgcccaccttcagcggatccggcatatcagtcgggtcgacgtaatcgctccattcatcgccgaatacgaaaacgtccttgtcggcatcggcggtccggtcttcaaatttggcgaccgcttccttggaactctgacgccagttctctccgctcagcatcatgtacttgacggcgacaggctgtccccaggcgacgatctgcttgtccaactcgttcagaagcgcccagtggtccctgtcctgatggctgatcgccagaacgtcgatacgagcatcctgtcctgccgccacctgcaacttcagctgttccatgatgaaggcgaccggtggcgtgacacccagggcttccctggtcttgctgagcccgccgctgccgaagtcgaacaggcacagccagtcggcgggtgtcgtggcgggatcgacggtcgaatccttgtagaccctgaccatgttcgccataccctggccgcaccagagcccgtccagaatgacgcgctggaccatcaccgggtctccttctgcgtatcatgattgcgggcggatctggtcagccggatcggccggcgggcggcggcagcacgcgctttcactgccggcgtcgccgtttcgctcaccgccttgccgtcgtcataggcggcataccagccgagtttggtgttggatgtctggtcgggattgccgaagacggtgatgtcgttcttgccgggcgggaaggacagacccagcacatgcaggccgaaatccctcagccgcatcaggtattgccggccgctgtcggcatcgtcataggtggtgaactgcaccgtgcggaagccgatatccagaatgccctgcaggggcaggctgacgcccagcatctgttccacacccggcagcgcgacgccgaaatagagcgaggtcttcccgtccggatcgttggccgggctccagccggccagcaggcggatggtgatgccgaccgatcccgccagtgcgcccagcgtgccgagatcgacctcatagaccaacccgtaccagggctggcggagttttccctgctggatcggcgccgagatcgagacgaagccggcggattccggcgtgcgggtcgaggggtctgccccggtcacggccgggtcgggcgtcgtcatcagaccggcgagcctgagcgggaagcgggcgaagagggaattggcgcgggcctggctgttggcggcgttgagggtgaggccgccgtcctggacggtgaaggtcacggctgtgggatccgacagcgagaagctcatcgtgatcgcatagttggaataggcgagccccgccgctgacttcgcatcggtgccgtcggcagcgtccgacagagaggggccccagcaataggggtcgaatttttccggctccgcgaaacgcagccttcccgccatctggaaggctgcggtgaccgtggtattgccggtctggggggcggctgcccgcgccgtcgccatgcgcatctggtcgaccgccatctcggtcagctggctgagctgcaactgaaacgcccctgcctcgcgcatcgcgaagacataggtgtcgcgccggtcgccgccatcggccgcttccgactgatagacgccgtccaggatcagattgttgccgtggtcggtggggaagagccgggtctgggcgccgaacacccggttcaccatcaactgcgccgagctggtgaagctcgccagccggccgttttcgaagccgacggtcaactgctggaccttgaaggcgaaggcgatgtcgctggagaaatactggtcgatcgggtcctgatagtcgatcaggccgaaggtggaggtggtgtcgaaggtgagcgtgccgttgtccgaggtgaaggaggtagcggtcagccccaggtgatgggcgtagaaaccggccgggtcgatgccggcggccagcggttgcagcggctctggcagggtgtcgagcggcacctcgaccgacagcgccagcacgcccgcccagtcgggatcgtcgatcacctcgacgaagcggtcatagggcgaggcggtgttcttcagccgggcggtggcgacactttcgcgcgccgtgcggatgatggcctgaatgtcgctgcgcgcggtttcggccttgccgtcgtctgaagacgcctcgggccagttccaggcggcggtgtcggaaaccagatcggccagcgagcggccgctgacgaatttgaagatcagccgggcgtttttcggtccctggcgatcgggggcggcccagttgcgcgggctcatccggaacagccagtcgccgatcaccggggtcagcagcccggcgaagcgctggaagaccagggtctcttcggcggtgatcgtgcccgatgtcgcctcggtcagcatctggtcgaaggcggtttcggtgtcgtagaccggatagccggcgcgcgagaccgtggccgagacctggttccacacggtttccgacacgcccttgcccggcggcagggccttgatcaggttcatcgacgcctgggtcagctgataggcgaccgagcccgacgccatcacggtcgcggccgagcccagcaccatgaacagccggttggacagcagcgcctggcggaaggcaccgtcgatggcggtgaagcgcagatccggcaggccgtcgctgctgcccatattgccgatgccgagccaggcccagggctgattgtcaccggcatagccgatggcgatgccgggcggtgaaaccgccggggtcaccgtgccgaccgggggggccgatgcatccgcagccctggtgacgtcccattgcgtgccggtggcgagcccgatccgccgccggcgttcgggtgcgatgccgcgggcctcgatgtcgcgcgcgaagaccgcatcttccgcggcaagcccggcatagccgaccatggggaaggccggggcgggatcttccgtcaccagatcggtggcggccatttccagataggacagaaagcccgaatagccgccggcatagaagggcgcatcctcgggctgggcgtaatagcgcggcgcgctgccggccgaaatccagctccaggcggtggtgccgagatcggtgagggccggcggtgccggcgcgtcgtcctgggtgagcaccggcgcctcgtcctcggcgcgggcgggcggggcataggcggcgcggccggcgcggaagctcaacacattgccgtcggccgtgttgagcccgacatagtcgagcccggtggtcccgcagagcacgcgcaccgccggggcggtggcggcgatgtcttccgacagctgcgcggttgccagctgtccgccctggtccagccccagcagggtgaaatcgccgtccggcgtcaggtaatacgcaaccggcacatcgcccggggcgccgccggtggcgccggtggtcagcggctgcaccgccagcacgaaaccgggctgggtctggctggcgatctgcaccggtttcaactgcacgccatagccaagggcggtgacatagccgctgtcgaagaccggctcgtcacccgaggccgtggcgccgaagggggcgaggccaaagcgggtgcgggtgggatcgagcggtgccagcgggtcgaaggcgcaatagagcgtcaccgtcgcgcgctggcgcagcggcaccacacgcaggctgcggatgccgccggtcgggaccggtggggcgtccagggtcatgaacggatcgatatcgggcgcgaagaagcgcaggctggcgcccatggacgtgagcaccggcacctcgtccacagccggcgccgccagatccagcgtccagaccagcgcgcccggccggagcgggttgtagctgacaccccagaggttctggctggcggcaaggctggcatcgcccgcgagcagggtgagggcggcaccgtcatggacgcggaacagccagctctgatcgctggacgcctgctccaccatcacctggccaccggcgggtgccaccacgacgatgccgccggcatcgaaggtctggccaccggtgacggcggtgacgtcgccgctgcgggccatgttgaccgcagagccggtccagccgttgatgcccagcgccacgcccgcgatccacaggaaacgcgggccccgggccggcggcagcagggtgagaaaggcctgaagcgggccgacgaacccggccgggtcggcgggcgcctggtccagccagaaccacagcccccgggcatcggtccagctggtggagagcgtgacggtgtcgccgaaacccgcggcatccgaggcgaggaacccggcccggttgccgccatccgtcagccagtagagcggcgagcccgcggccgcccggttgaaggcgggctctgccccgccgctcatgcggcacctgcgggccgggtgccgatgtcgatcctgtcgccggccatcagcggcagggcggtcatcgcggcattggccgagggcgcccagtcgaccctgagcggctggccgccgccggcatcatagccggcgggcgtgccggcgggcgacgggccggtgccgcgggtcaggcggatgccggtcagcggcaggcccaccgtcgccggctcctgcgcgcgggtggccagcacatcgctcagcgtcgtgcccagcggcaccagctgctccaccccgttcaccaggatgcggatctcggccaccagcgtggtgcggccgcggaagtaaagcaccgccgcccgggcgctggcatcggtgccgttatgcgcggcttcggtcgcggcctccagatccgagagtttcgacgcggcgagcagcaccgcattcagttccggatagggcgtacccggctgggcgcaggacgggaaggcctggggatagaccaggcggagcagcggctgctgcatggtcgaccagccggtatcgatcaatccgccggcaccggcgaccttgcggttcgacggcaacggccgcggtaccgtcgtgccgccctggctggtgaccaggcccacgaattcgtccagcaccgtgcaggtgacgccgttcttcacgatccgccccacctgccagcgcgcgacccccgaggtcacgaaaccattcagataggcctgatcgggggatccggcggccatggtggtataggcttcgaattccgcgcgcagcaccatgcccggcagcagatcgacatggcctttggtcggatcgaagctgtagccgaagagcagggtttcggcgaaggtctgcggcatggcgcgggcgatcgccgcctgcaccgtctggatggcgagtggcgtggcggtggccgtttccagcgccgtcaggaaaccgttccaggcggtcaccagatccgggcgcaccgcctcggcggtgaaggtccagggcagggcattcgcatcgcccgcgatggtcagggcataggtgtagggggccgtgccctcgacaatcgcgaagggggcgacggccggcagatcggccgtggccggcggggtggtgaacagctgcggcaggccgatggtgatctgataggcggtcatggccggcgcggtcgcgggaatgatcgcggccgcggtgtcctgggcgaaggtcggatagagaccggcggcgaagaccggggccgaggtggccgggccggtggtgacgccggtgatcgcctggacgctgagggtcgggttctggtcgcttgcataggcgatcgcgaccgagagttcgggtgcggtggtcagcacgccgctggagcccggaatgccggtcaccagataggccgaggccccgtcgaccgcccgccaggagaggctggcggtcgcaccgtcataggcgatggcaagccctgcgggtgcaatactgccaagcggtgtgaaggcgctccacggccctttgacgctggcgccggagcgggtggcccggccgcggacggcatagctcgccggatcggtcagcgccgaggccggcacggtgacggcggtggttccgctggtcaggctctggctgagcgtgccgttcttccacagctccagcgcatagccgtcttccccctggccggcggcgctgagggtgacggtgacgtcgccgccggcggcggggaaggcgatgccggtcacggccaccgcctcgctgatcagcgccagtgcgaccgagaccggcccggtggtgctgccggtggtgccggaaccgatgggggtgacgaccagagacggcgccgccccctggccgcccgccggcagctgcggcaccggcaggctgcccgagccgccgctgaagctgcccgaggcggcaacccccgtgcccgcgacgagatccagccgatagccggtgacccctgcatcggtgacggtgttccagccggcggtgaccacgccgccgtcgagcgtggcggcggtgagcgccggggcggatgtcagcaccggcagccgggtggtggtatagggtccggtggacgagccccggcaggcggcggcgatcaccgtataggcgtcgccgatggtcaggcccgccagggtgacgctgcgggtgaggcccgttccggacgcctggccgccggtgacgggctggccgtcgggggcgagcacgctgatcgccgaaccgctgatccgccagtcgccggctggcggcagcacggtgaccgtgaccgtgcggtcggtgcccgaggcggtggtcacgacatcgatcatcgggggcagcagcaccagccccatggcgctgccctcggggccggtcgccgtgccggcggtggccgacgacagcgccgcggtgacggcatagtcgtgggcgaggtcggcggcgatgccgaaacccgcggcgaactgccaggtgcgcgtgccggtccgcgtgccggcaatcggggcggtggtggcgattgcccgcccgtcctgcatcagattggcgatgaaccagacatcgccgctgtcgggcaggccggcgccagagacggtgatggtggtgttgaccgtctcaagcgggatgatcaccgcaaccgcggtgacatccggccgggcgtaatacaccggggcaggatcgctgaccgggccgctggagatgtcgaagaccggcgtgaccttcacggtccagctgccgccggccgcgcgcagattgggggcgacgacgaattgcgcgaccgtgcccgaggtgaccgaggcgacctgcgatccgccgccggtggtcagccggatctgggtctggccggccggcatggccgaggcggccgccgtccagcccacggacagggtgatgccgtcataggcggtggtgatgttggtgaccggtgcgaagagcaacggtacccggtcggagatgatggtcggatcactctgaacggcgacctggacgtaatacatcgtggtctgggcgttcatgtcctcgcccgccgtccagataccgccattgggcgtcatgcccgatgcggtgccggtgatggcggccccgccggcggtcgtcacgatgatcgtgaacgggccggtatatccctgctggataagccaggccagggagaagaccgggcgggtgccgccggtggtgcaggaaaccgacgagatgaccggcgcggccggcgtggtggcggtggacatgcgctcttcccccgatgcagaagcccgcgcaccccgccgacccttgaacggggccgggcgggatgcgtcgtcgtccgtcgtgatctgtgggttgggatcagccgtcgatgcgggcgatcggcgccaggccggcggcgatccggcgggcattggtcacatccagccgccagtcgtcgcccagggtctggcccaggatctcgaccggatcgggcagatcggccggcagcgccgcgcgggcggcatgcaccgcctgcatgcggttgtcaccgaccaggatgccgccggcgatgaagccggtgatggcgtcgtcgtcgatatcggccaggctttcggcaccgtcgggcagcagatccaggttgaagacctggccgtcatgggacacccgctcgaccagcgtcacccgggcggggccgtgatcggtggtgaccagggcgccggtctccagcgcctcggccaccaccacgcccgccgccgtcggcaccgggtggttgtgggtcagcagcacctcggcgccggtgtcggtgacgacgcggaccatgggcttgtcttcggtgccgcgccagacttcggcgatacgcaggctgccgcccatgccgtcggccacccgttcgcccgcggtcagggtctcgatcgcccggcgggtgccgtcggccaattccaccaggctgccctcggcgacacagccccagacgaactggatcggcgcgaccatgccgatattggcgggcggcgtggtcacacccagcggcacgctggtgacgcggatgaaggcggtctcgccggtcgacaggctgaaattcagcaggaagtcgaggtcaatggtctggccctgatcccagggcgcgccctgcagccagtcggggccgatcgcccagctgatcgcgccgccggcaccggtgcacagcggcggaatgtcggccgacggaaaggccagggtggcgccgtcgccctggcccgagcggcggaacaggatgcagttgccgttgaaattgggattggcggcaaccgtatagccctgcagcagggtcgccgagccgttgaccgccaggcccacgatcggcttcgagccgtcattgccgtattgataataatagtcgcaatccccgacctgattgtcggtccggttcaggccgaccttgatgtaatcgcgggtggggtgcgaattgtggttcgggtcgaccacggtcagggtgtcgatcgcgtccacgccgcgcagatcggcggtggcgaccaccgtttccagggccgtggcgcctgcgggcatataggcggccgacagcgtggcggtgacgtccagcttgccgtcgaccaccgatgcggccgaggtcagctccaccacctgggtggtgctgttgtactgctgcgggatcgagctgctgccgatctgctgaccggtgtggttgtcgaccaggatcaggttgagcgccgtgaccgtggagatgccggtcagcgtcacgatgccctgggccgagacctgattgctgttcggctccacccccagataggtcagggtcaccgcaggcacccagctgccggactggggatcgtccatctccagcagcgtggccttgcggggcccgccggtcgcctggtgatgggcttccgtcagcttgatcagccggcgggtgctgggaaagtagcgctccagatagtcgtcgccgccgaagcgatccaggatgaagcgccgatgcgtttcattgcgcatgtccagcgacatcacgccattgggggtggccgcggcctcggcagtcaccgtctggaaaacctcggcctcttccttgctcatcgggcttgccatccggccgaaccgatcgaccccgatttcgcgcatccgcctgctcatgatccgatccccttcccctgttatccttctgcgggaagacgagcatgcccgttcacgcccattggaagggcgcgtctgtcggtttgctcgttcccacttataggattgttgcgtgaaaggttagatttgagccgaaagggtgtcaatcacccttctatgaaaaccaacggtcgttaatctattgcatattgcagtgtacaattgccgcgcggtcgtgacgggtctcagcggcggttgtggagatgctcgcgaaaggcgaacgccgcaccggcgatcgaaatcaggccgaacagggcaaaggtggtggcatagctgccggccaggccctgaatggcgctgaagccggccgggccgatcaccacgccgccgaaggtgaggatcagcacgccgccggtgacggcgccgaccagccccgccggcgcccggcgagcggtttcggccagcatcacgccgttccagccattggttgtgttgccgatcaggcaaagcagggccaattgcacccccggcccggcggatgcggccgggccgatggcgagcgcgccggcgccagagaccgcgcccacgatcgccagcaccaggaagcctgcccccagccggtcggccaggaaaccccagatcacccggccgagtgcgcccgaggcctggatcagcgccagcgcgctgccggcggccaccggcgaccagccatgttcggtcaccagcatcaccacggtgaaggtcgacagcgacagctggagcatggaatagagcaggcccagcagccccagcgccctgagcggcgcctcgcgcagggtcaggcgcgggccctgcatccagtcctgtccgatccgggcccccggctcgcgatcggcatcccaggccggacgcaggcgctgcagcaccaggatgagcacgagcggcgcgagggcggcgatccacagccccgcctgccagcccatcgccacggccatcgccgggaaggcgagccccgccgtcacgccgcccagcggcacgcccgcctgtttgagggaaaacaccgtgttgcgccgccgttcgggcgttacccggatcaggatctgagaggcggccgggttgttgagcccatagccgaaaccggcgatcagggcggcggcggccatcagcggcaggctgcccgacccgaaggcgggcagggcgatcacgaaggtggccatgctgatctgcgaggcccgggccggaccgaagcggcgcacgatgccgccggccatcaccgaggtgatggcggccgccagatagaccaggctgacctggaaaccgaccagagacggcgcgacgccaagggcagccccggcgatgggtgcgatggtcgacagcgccagcgcgcccccggtcgagaccatctgcaccgccatcgtcaccagcagggcagtcagaagccgcggcggccccgggatatcggcaggtgtggaagggtggggggcgtcggctcgggccatggacggatccgttcggtctggtgatcctgaattgtacggacaaattatcgatttgggccaggcgttttcctgcaagggtgtcctgcggccatcgtcataaaggtttcacgagcgtggcgctcatatttcctatattccggaatcatggaaaacgaactcgccgcctatgccttcgccacgctcggccatcccggacggcttgcggtcttccgcctgctgatgcgcttcgcaccgcagggggtgcggccgaccgagatcgcggcggcgctgggcctgaaacagaacacgctttcccaccacctggccgatctggcgggtgtggggctgatcacggccgaacgccggggccggtcgctgctctatgcggtcgatcttgaggcgaccgaacggctgatcggctatctggcgctcgatctggggcgcgcccgcccggatctgctcggctccattctggggcctcaaaaggacacccccgccatgcgcgacaccggtttcaacgtgctgttcatctgttcggccaattccgcccggtcgatcttcgcggaggcgctgctgcgtgatctgggcggtggccggttcaccgccttttcggccggcacgggcggtggcgggggtctgaacccggtggcgctggaggttctggcccgcaatggccacgacatcgcggggctgcgctccaaacatatttccgagtttcaggcgccggacgccccggtgatggatttcgtcttcaccgtctgcgacacggcagccgccgaggactgtccgtcctggcctggccggccgatcaccggtcattggggcctgcccgacccggtaaaggttcagggcaccgagagcgaaaaggcgctcgctttcgcccgcacctatggcgcgctgcgccgccggatcgcgatcttcaccgctttgcccttcgcggcgctcgaccgcctggccctgcagggccgggtggatcgcatcgccaccgaggccgcgatcagtgacgaggtctgaccccatgtcctcccctggcacccgcccccgcatcgcgctcaacggcctcggccggatcggcaagctggtcctgcgccggctgatcgataccggcgccggcggcgacatcatgcttctgaacgatgccgcgggcgatgccgcacagcatgcgctgctgatggaattcgacagcgtccacggccgctggccgacgccggtgcaggcggcggacggcgccctgatcctgggcggccaccgggtccgcctcacccacgagaagaccatcgcggccctgccgctcgacgggatcgatctggtgatcgactgcaccggcgtgttcaagactgccgcggcactggcaccctatcatgccgcaggcgtgaagacggtggtggtcagcgcgccggtgaaggatggcggcgcgctcaacctggtctacggggtcaatcacgggctttatgacccggccgtgcaccgcctggtgacggccgcgtcctgcaccaccaactgtctggcgccggtggtgaaggtgatccacgagggcatcggcatccgccatggctccatcaccaccattcacgacgtcaccaacacccagaccatggtcgaccgtccggcaaaggatatgcgccgggcgcgatcggcgctcatgaacctgatcccgaccacgaccggcagcgccaccgccatcgggctgatctaccccgaacttgccgggcggctcgacggtcatgcggtgcgggtgccgctgctcaacgcctcgatcaccgactgcgtgttcgaggtggcgcggcagacgagcgtggccgaggtgaacgcgctgttcgaggcggccgctgccggaccgctgaccggcatcctgggctacgagacccggccgctggtctcggcggatttcgtcaacgatccgcgctcggcgatcgtcgatgccccctcgaccctggttgtcggcggcacgcaggtgaagatctatgcctggtacgacaatgaatgggcctatgcctgtcgtctggcagacatcgtgcgcatggtggcatcggcatgctgagacaggccgcccccgccaaccccttgcgcgcctatgccgccgtcaccgccgcctattgggccttcatgctgtccgatggcgcgctgcgcatgctggtgctgctgcatttcaacgcgctgggcttcacgccggtccagctcgcctggctgttcctgctctatgaactggcgggtatcgccaccaatctggccgccggctggctggcggcgcggttcgggctggcggcgacgctctatggcgggctgggcctgcagatcgcggcgcttcttgccctcacccggctcgatccgggctggagcctggcggcctcggtcgcgttcgtcatggcggtgcagggcgcatcgggtgtcgccaaggatctcgccaagatgtcgtccaaatcggcggtcaagctgctggcgccggccgccgatggcgggctgttccgctgggtggcgctgctgacgggctcgaagaacgcggtcaaggggctgggcttcttcctgggtgccgccctgctggcgctggcgggtttcgaggccgccctctgggccatggcggcggttctggcggtgatcctggcggccgtgatcctgttcctgcccgcagggctgccggggcggatcaaggcatccgaaagctggtccggctggcggtcgaaggatgcgcggatcaaccggctgtcgctggcgcggatgttcctgttcggcgcccgcgatgtctggttcgtggtcggcatccccgtctatttccaggccgtgctgtcggacggcacggccgaggggcggcgcgaggcattcttcatcgtcggcggcttcatggcggtctggatcatcgcctatggcctggttcaggcgctggcgccgcgcatcctgaaggccgccggccggctggagcgggaaatcgtgcgcaaggcggtcgtctgggcggggctgctggtgccggtcccgctcgtcctcgccgccatggtctggctggcgggggatccggcgccctggctcaccctgctgctggttgccggcctgctggtcttcggcttcgtcttcgcgatcaattcctcggtccattcctatctgatcctggccttcggcgatgcccggcggatcacccgcgatgtcggcttctattacatggccaatgccgccggccggctgattggcaccctgttgtcgggggtgagctatcagctgggcgggcttggcctctgccttgcgaccgcgggtctcatggccctgttcagctggctggccgcccggcggctctgacgcaaaaccagcgctccatgttgcgttatgcagcgtgctagactttgccctgacaacggccgggcaacacggccgggatcaccggaggaacgtctgatgagcgtgaacgcgcaggaattcggccccagggtgcaggccctgctggaccaggcggccgcggccggcgatgtgccgggtgtggcggtggcgatcggcgatgccgacggccagattttcgaggcggcggccggcagccgcaccgcgggcggtgaccaggcgatgacgcccgacaccgtggtctggatcgcctcgatgaccaaggcggtcaccggcaccgccgccatgcagcaggtggaacgcggggcgctgtcgctcgacggccccgccgccgatgtcctgcccgaactcggccgggtccaggtgctggacgggttcgacgaagccggcaatccccggcttcgcgccccgcagcgcccgatcacgctccgccatctgctgacccacacctccggcttttcctacgacttctggaacgccgatgtggtgcgctgccaggaggtgatgggtctgccgccggtggtcagctgccagctggcggcgctcgacgtgccgctgatggcagatccgggcacgcattgggattatggcgtcggcatcgatttcgccggtcgcatggtcgaggcggtgaccggccgccggctgggcgcatatctggccgaagaggtgctggggccgctgggcatgaccgataccgccttccgcatccgcgacgacatgcgcgcccggctggcgccgatccatgcccgcggcgccgatggcgggctgaccgccaccgacctcgaaatcccgcaggagccggaattcgaaatgggcggcggcgggctttacggcacggtgcgcgactatctgcgcttctgccgcctgttcctgaaccagggccgcgccgatggcgggggtcaggttctgaagcccgaaaccgtcgcgcagatgagccgcaacgccatgggcgatctccgcgtccgcccgctcaaggccgtgctccacgacctgaccaatgatgccgagttcttccccggcctgcccaagagctgggggctcagcttcatgatcaacgaggacgacgcccccaccggccgccctgccggctccctcgcctgggcggggctcgccaacagctattactggatcgacccgaagaccggcctcgcgggggtctatgcgacccagatcctgccttttgcggatgtgaaatcgctgccgctttatctggcggtggagggggcggtttacgggcggtgacggctcgccttcctgacgacggcaccgccggtcggcgcgtggcggtcgggcagaatcaaacatatacaatcgtgtgcttcatgccgtcttttggtatgaagaagcgggcagcctgaaccgggctgcccgccggtctgtctgtgccggcttccccccccttggcagggagactgcgaagatgtctgaccgcacgatcgtttccgacgttgaggatgtgtccgccgaggaccgcgagatctgggtgaagccggtggcacggacgcggaatctgaccgtcgcggagtccgctcccaccgggagcgcagatttttccgggggttcctgattaaagagcggcctgccgtcttaaagtctggcgtccctgcgaggaactcgggaacaccacggtcatgaccgatcgcaatgacgcgaccgtgcagttcatgcgcgccagtttcgacggcttcatggccggccggggcacctacaacctgtcctggctgggccatgagacgatcaaatatcccaccgacctgatcatgtatcaggagctgatctgccgccgccggccggcgctgatcgtggagaccggcagtttcaagggcggcagtgcgctgttcctggcgtcggtctgcgatctgatcggcgtgggggaggtgatcagcatcgatgtccgcaatgacgagcggcgggcggtgctgccggttcacccgcgcatcaccttcctcgccggcagttcgacggcgcccgagatggtgcaggcggtccatgaccgcgccgcgtccctcggccccgatgccgaggtgatggtgatcctggacagcgaccaccggctgctgcatgtgctggcggagctggaagcctatgccgggctggtccggccgggcggctatctgatcgtcgaggacggccatgtcaacggccggcccaactggcccgattacgggccggggccgagcgaggcgatcgccttcttcctgccccggcatccggaattcgaagtggacccggcctgcgagcgcttcatgatgacgctcaaccctggcggctatctccgccgtcgcgacgacccggcctgatgagcccgacccggctgtatctggatctgctgaagcaggtgctgctcaaccagaccgggcttgaggcggagctgcgccttgcccatgtcgcggcctgccatgtggccgggaccgaccccgacccgtatcatctgcgcgacatccgcttcaccgaggcggagactttcgcggcggcggccgcgcggcgggatgacgggcgctggacggcggccgatcgcccgggcctggggcttgcctataccatgaccggccggcagcggctggatcatctggaagcctgcctggatgacatccgcaccgagggcgtgccgggggatctgatcgaaaccggggtctggcggggcgggtgcggcatcttcatgcgcggctatctggcggtgcatgccatggccgatcgccgggtctggctggccgacagctttgccggcgtgccggcgccgtcgcatgccatcgatgccggcgacaccctgttccaacagaacgacctgctcgcgatctcgcggccgctggtcgaagacgccttccgccgcttcgatctgctcgacgatcgggtccgcttcgtcgaggggctgttcgaagagacgctgcccgggctggataccgggccgctcgctctgctgcgcctggatggcgatctcttcacctccacctgcgccgccctggaagcactatacgaccgcgtggcgccgggcggctggatcatcatcgacgattacggcgcggtgcagggctgccggatcgccaccgacatgttccggcatgtccgcggcatcaccacgccgctcgaccgggtcgactggacctgcgtcgcctggcgcaagagttgaacggagccgtcggccttggggttgcccttgattactctggcgataagacgcggggcagcgctatatttgccccgtggtgcccgttccccgtgtggcgggccacgcattcgagtgttggccccccccccccccgccgacctgtggtgtgcggatgagcaggctgacgtgcatgatgcagatggttgctgaatcccttgcggcggcaccggcagaggcgggtgccatggacaggctcgactgggtggcgccggtcgccagccggcacagcatgctggaggcggagacctcgttcaccagcagcggtgccgatatgggctgctcgccatcctgagcctatgtgttgaacgaggccgttatgacccagcccgcgcccgcctcttcggttctttcgcccgaaaccctggttcgcatccgccccggcatcctgactgccgagatggatggcgagacggtgctgctcgatgccgaaagcggggcctattcggcgctgggcagcaccggcagccggattgcggcgctgatcgccgagccggtgtcgctgggcgatctctgccggcagctgaccgggatctatgccgtcgattccgaaacctgcctggccgacgtcacccccttcctcgaagggctgatcggcgacgggttggtggacgtcgccggctgagccggccccgcatggcctggttccacaccgccgccgggctggtgatcgcatccgaccgcccattgccggccggcccggcccggcccgaagcggttatcgctgatccggccaccgccgacctcgtcatcgccgatgcggccgatccacccgagatcgggagcgacggagatgcgtccgggccgaactggtgcatccgccgctggaacggggcgcgcgggctctggatgatccacgagcccgacggccgggcggtgtggatgacgcgcccggaccggctgaacgtctatgcgcccgatccggtgttgcgggaccaggcctggatgaccgccgccacctcgggccttgccgccgccctgctgctccgcggccggctgccgctgcacgccgccgccgtggtgatggcggggcaggcgatcctgatcgcgggcgccagcggccgcgggaaatcgacccttgccgcagcactcgtcggggccggcgggcaggtgatcgccgacgacatggtttcgcccatggtcaccggtggccgggtggtggcggcaccggttctgccgcggctgcgcctgatggccgatgccgccgggcatttcggcctgacggggccggtcgcgccggatggcaagatcctggtgacgcccgctgccgacccgttgcccgatccggttccggtggcggcgctgcttctgctgggcgacagaggcgatggcccggcccggtcgggccggcttgccgccctggcggcggtgccggcgatccgtgggcagatcaccggcggggccgcgacactgcccctctatgatcggacggcggcgttttcgaccgcgttgctggatctggcgcgccatatgcccgtgctgaccctctctctgcccgaggggttgggccggctggacgaggtgagccggacactgccggcgctgatcgaccaggcgccggccgcatgttgaccggggccgccgcgctgatggccgaaggccgccgccgcgcgctggccggcgggctggaagagggggccgaactgctgcgccgtgccctggcgctcgacccggcgcccctcgtgcgggaggcgctggtgcgcgtcctgctctggctccgacgcttcgacgaggcggcagagctggtcacagccgggcttgtggaccacccggctcatccggggttgcgggcgctggccggcgatgaggccatccgccgccgccgccccaccgaggccgcggcccatatggcggcggcatcggcgatgacgcccgatctctggcgcatcgccggcaatgcccgcctgctgctgaccgatatcgacggcgcggtggcggcctgggaccagggcctgcggctcgatccgaccgactggcggctggccggcaacatcctctacgccgccagttgcgacccggccatgaccacggccgggctggcccggcggcaggcggccgtcttcgccgggcgggattttccgccccggccggcgccgcggccgcgggccgccgacggccggctgcatatcggctatgtcggcggctgtttcgccagccatgccgcggcgcgcgtggtgctgccgatgatcatgggccatgatcgcagccgcttccgcatcacctgctatcccacccggccggcgccggtcgatccgggcctgctgcggctgcggcttgcggtcgacggctggtgcgggctggccgggctggacgatgcggcggcggccgaccgcatccgcgccgacggcatcgacatcctggtcgatctggacggccatgtcggcggcaaccggatcgggatcttcgcccgcaggcctgccgcgctgcagatccaggcctggggctatctgccgggcaccggcctgccggtgatggacgggctggtgaccgacccggtgctgctgccggcggccgagcgaccggcgatcggggccgccaccctcgacgtgccctgtccgacgcttggatggccgcttgcatcgccgcctgcgggggatccgcgagaggcaggcggacccgtgcggatcggttgtttcgcccgcggggaaaagctgcccgacatgtttctggatcatctggccgggatactgaccgcgcggccatccgcggtgctggtgctgaaagacgagctttttgccgatccggccgtcaggtgccggctcgatcgctggcggagccgccaccgcctcgcgcccgatcgcatcgagatccaggggcgcagttccggcgatgcctatatccacagcctgcgttcgctcgacctcgccgtggacagctggccctattcgggcggggtggtgacgctggatctgctgtcgcagggcgtgccggtggtcaccatgggcggccgtcaggcctgttcgcggaccacggcctccatccttgcctgccttgggccgcaggggctggccgtcgacggtgtcgatgcccggggcgggcgggtgctggccctgatcgacgacgccgcggcccgcagcaccctgcgtgcggagatccgcgcaacccacggcccccgggtggcggcggccatccctgcgaccatccgcgccttcgagacgcatctcttcagtctggctgcctctttgaccgtgtgcccggcttcgtcttcgcggtcaaagtcccgacccggtcctatctgatcctggccttcgcggacgtgaaatcgctgccgctctatccggcggtggaggggggcgagtttacgggcggtgaggcgggacgggcggcacggcgccgtttcgctttttcaggtgtcatactgcggttgtcccgtcccgcagccagccatgtgcgggtggcggcgggtttcaaaaaattagaatgctcatatatgataatctagtgtaccatatatccggtgtcatacatcagcggagaaggcaatgtcaggattgtattttgacgacatgcaggttggacagacatttcaacatgacatccggaggaccgtgaccgaagcagacaatgtgttcttttcggcattgacccataatcccgcgcggcttcatttggacgaagaatactgcgcccaggaaacggaatttggatcaaggctggttaattctgctttcactctcgggctgatggttggtatttcagtgggagacacgacgctagggacggccatcgccaatcttggttgggacgaggtacgtttcccgaagcccgtcttccacggtgatacccttcgggtggagacggaggtcatcgatctgcgtgacagccgctcgcggccagacgccggtatcgtgaccttcctgcatcgcgcctataaccagcgcggagatctggtggccagctgcaagcgctcgggtcttcagcgcaaacggccggagaagacagcatgatcgggctccgttcctggttattcgtccccgccgacagcgaccgcaaaattgcccgatccgccgacagcgcggcagatgtgctgatactggatctggaagatgccgtggcccccggccgcaagaccatcgctcgcgggctgttgcgagacgtcctgaccgcgcggccgcgcgagacacggcgcagccggctctgggtccggatcaacccgctcgatgatgcggctctcgatgatctggccgccgtcatgccgggtgcgcccgacgggatcgtggtgcccaaggtggaccatccccgcgacgtcgtccggctctcgcactggctggacgctttcgaagcagccgcaggattgaaggcgggttcgacatcgatcctgccggtcgcgaccgagacgccggcagccccctttgcgctgggcgactatgcccgacagcctctcccccgccttgccggcctgacctggggggcagaggatctgagcacggccgtcggtgcctcgaccaatctggatcccgcgggcggctgggccttcacctaccgcatggcccgcagtgccacgcttctggcggcgagggcggctggtgtcatggcgatcgacaccctctatgccgatttccgcgatgcggacggcctgcttgccagttgccgcgccgccgcggcggaaggcttcgacggccggatcgccatccatcctgcccaggtggatgtgatcaatgccggcttcgcgccatcggacgacgcggtgcaccatgcccgccgtgtcgtcgaagcctttgctgcgtctcccgatgcggggacgatcggacttgatggccgcatgctcgacataccgcatcttcgccaggccgaacgggtgctggcacggcatgccgccgcggtccatcgcggcctctcatccgatgacatttccgagtgacggagcccgctatggacaagattatcatcagctgcgcggtgaccggatcgatccacacgcccagcatgtcgccgcatcttccggtgacggcggaagacatcgccgatcaggccgtggccgcggcggaggcgggcgccgcggtgctccacctgcatgcccgtaaccctgccgatggccgtccgtcccaggatccggcattgttcgcggctttcctgccggcgatccgcgaccggagcgatgcgatcatcaacatcaccaccggcggcgggctggggatgagcctggatgagaggctggcgccggcgaaatgggccgcaccggagatcgcctcgctcaatatgggttcgctcaacttcaacatttcgggcgcggctgcgcgggtgccgcagttccgccacgactgggaacggccctatctggagatgacccgcgacttcatcctgtccaacaccttcgcccagatcgagcgcggcctgaccgaactcggcgccctcggcacccgcttcgaatatgaatgctatgatgtcggccatctttacaatctggctcatttcgtcgaccgcggcctggtgcagccgccattcttcgtccaggcgatcttcggcatcctgggtggtatcggagccgatcatgccaatctgatgcatatgaaggcgacggcggatcgcctgttcggcagggattaccgcctgtcggtgctggccgccggccgccatcagatgcccttcgtcaccatgggggcgatcctcggggccaatgtccgggtcgggctggaggacagcctgtacatttccaggggccggctcgccacctccaatgccgagcaggtggcgaagatccgtcgcatcctggacgagttgtcgctggacgtggcgacacccgacgaggcccgggagatgctgcagaccaagggtgccggcaatgtcgccttctgacacaggaaggcacccatgccccgcatgctgaaacccggtgagctaccggatcatctgccgcagggcgggctggtgtgggtgcagggatgttcggcttggtcgtcggtggtcgagacggagattgccatggcggccgaccggctttccggcaccaccttcaccggtatcttcgtgcccggcctgaatcccgcctcccgcctgcttggcgggggcggcgactgcatggcttctttgccacgcccgagatggaggcggccgggcctgcggccgacatgctgcccctgtgctacgccgacctgtcggatcatctgcaggggctgacgatcgatgccgcctgtttcatggtcgcgccgcccgacagccggggcatctgcagcttcgggccggtctgcgacttcctgcccgatctctggcagcggattccggtccggatcggggtcatcaacccatgtctgccacggaccctggggacggccggcattccgctgtcggatttctcctgcctgatcgaagacgaccgggatctgccggcggttcggtccggcagcgacgagtccacccgcgccatcgccgcccgactggccggcctggttccggacggcgccaccctgcagatcgggcttgggcgaacgccggaaggcgccctcgcagggcttcacggacatcgcgggctggccattcattcaggtctggtcggtgacgccgtgatcgacctgctggaagccggcgccctgcggccgggcaggtcggtgaccaccggcgtggcgatcggtacacgccggctctacgatatggcaggggatcccgtcttcagcttccggccggtttcatatacccacgcaccccgcgtgcttgccgggatcgagggtctggtgaccgtcaatgcggtcaacgagatcgaccttttcggccagggatatgccgagatgcgcggcgggggattcgtatcggggccgggcggggcgacggactttgcccggggggcaaggtgggcgggcggattgcgggtggtcgtgctgccggctgcggcatccggcggccgcgtcagccggattgtgccgcccggtgccggccaggggccggtgtcactcgggcggttcgatatcgacgtggtcgtgacggatcacggcctggcggatctgcgcggcctcacccacgaccgtcgcgcggaggcgctgatcgcggcagcggcgccggctttccgggtggcactggcaaagggatgggatgactggcgccgtggcggccggccaggcggcgccagcctcgggtgatcagcccccagcaaccttcgggcagggcatacatgaagaccacgacaaatacgccgaagatcacaccggtcgcggcggtcgagatctgtgttgccagattgggggcgaggacgatgaaggcggcgcccagcacgccccccgggatggcgcccacgccccccaccacaagaccgaccagaaggaagaccgacagatataccgagaaactctcaggggccacgaactcgatggcaagcgcgctgacgccgcccgccagcccggtcaacagggcgctgatgccgaaggcggcacatttatagaggtggatgtttattcccatcgcttcggcggcgagggggttgtcgcgaatggccgtcagggcccggccgatccggccggcaagcaggttgcgcgtggccagaaacgcgagcacggcggcgaggagggccagatagtagatccagcggtcgggatcgatccatgccggcggctcggggcgggtgacgtagaggccggccacgccccccgtccagctttccagcgtctcatgcttcagcaactgaggaacggcgatggcgagcgcaaaggtcgcgagggccaggtagtggccctccaggcgcagagccggcaggccaaggaccatgccggcgacgaacgccatggccgcggcggcaggtatggctgcccaccagggccacgcgccctgcatcatgagaatggccgtgccataggcgccgatggcatagaaggcgccgtgcccgagcgagatctggccgctgtaaccgatcaacaggttgagccccagtatcgcgatcgcatagatcaggatctgggtcgcctgaaagatctgaaacccggccaggcaccagggcagcacgatggctgcaagaacggcggcagcgtacaggcgggacgcggccctgggagacgcggccctgggagatggggccctgggagacggggctgggcgacggagcattggggatggctttccggaaggggtgatccaggggcgggagaccggcagatgcaggccggcggtcagacccgtttgacgtcaggccgtccgaacagcccgttcggacggatcaccagcaccgtgacgaccaccgccagtgcgaaactcagtttcaggtcgttgccgatcagataggtaccggccaggttttcgagaacgccgaaaagcagcccgcccaggaccgcgccgccggggctgttcatgccgccgagcatggcggaggcgaatgcatacagcaggacactcatcatcatgccgggctccagataggtgacaggcgcgatcagcagtcctgcaaccgtcccgaggatgctggcgagcccccagccgagggcaagcatccgctccacccgtatgccgagcaggcgggccgatgcgggattgcgggcagcggccctcatcgcgaggccgaggagggtgaagcggaagaacaggaacagcaggctcagaagacccagtgatacgaggatggcgaacaggctgtgggcaccgatcaggatggtgcccgtggagaggccactcaccgggctggggaagtccttgatcgtgaacccccagatccagcctgcggtggcgttgaaggccaggagcagaccgacgaacaccacgaccagtgccagatgtggcgcattgcggaagcgtcggatgaccagtcgatcgaccgaaacgccaaagatgaaagcggccaccacggtgatcacgaaggcgagccagtaggggagcccggctgcgagcagcgtccaggcgatgtaggtgccgagcagcgccatttcgccctgggcgaaattgatatgaccggtggtgttgaagatcatgaccagggcgagggccagcgcggcgtagatggcaccattggaaatgccggcgagggtctgctggaggaagaggtccatcggcggtcgtccttcagttgcccagataggcgcggcggacgctgtcgtcgttccgcagcagggcggccgatcccgacaggaccactcgcccgctctcgatcaataccgcagtgtctgccagttcgagcgccagggcggcgttctgctcgaccagcagaagcgcgatgccctccacctcgttgatccggcgcatgatctcgaagatctcggcgaccaccagcggcgccagcccgaaagaaggttcgtcgagcagcagaagccgggggccgctcatcagggcgcgggagatggccagcatctgttgctcaccgccgctgagcgtgcccgccatctgtccgcgacgttcgcgcaggcgcgggaaatagccgaagacgcggtcgagatcgcgcgcaatcccggcggcatcccggcgtatccacgcgccgaggcggagattctcctcgaccgtgaggtccgtgaaggtgccacggccatccggaacatggccgatcccctggcggatccggtcttccgtggcgcgccgatcgatctgcaccccggacaggaaaacctcgcccatggtccggatcgttccgcagatcgcccgcagcgtcgtggtcttgcccgcgccattggcaccgatgatcgtggtgatgcccccggcggcgacggtcaggtcgatgccgaacagggcctgggtactgccataaaaggctctgagacccctgacgtcgaggagcatggtcatgagctgccggcccccagataggtgcgaaccacttcaggatcacgtgcaatctctgatggcaggccctcggcgatcttgcggccgaaattcatggccaccaccttgtcggacaccgacatgaccaggttcatatgatgctcgaccagcaggatggccgtgcccagccggtcgcggatggcgcggatctggtccttcagcacgtcgacctcctcgtggttgaggcccgcggccggctcgtcgaggagcaggagatgcggccgggacatgagcgcgcgggcgagttccacacgtttgcgcaggggaaagggaagatccgtcacccgacggccttccgttcccgaaagtcccatgaacgcgatcagctcacgtgcccggtcgcgcagctccgcttcctcccgggcgacccgtcggatgcgcaatgtatgtgcaaggaagccggcctggcccgccacatgtccgccgaccagaacattgtcctgcacgtcgagatgatcgaagagcgagacgttctggaaggtgcggccgatcccctcccgggcgatgcggtggcgtggcacggtcgagagggatctgccgcggaacaggatgtcgcctgaactgggctggcagagccggctcaggcagttgaagagcgtggtctttccggcgccgttcggcccgatcagccccaggatccggccggctccggcagtgaaactgatcgaatccacggccaggatgccgccaaaccgaacgacaagctctcgaacgtcgagaatggtcatggatgtgtcggaagcgttcggcatggcagatcctccctgcgacatatgccgttggcgccggacggacagggtcacctcgacgccgagatcggcgcgccgaagctctgccactgcaggccatcgaaacggatcatctgaaaggtcttgatcgggtcgagatcctgcggcgtcaccgtatagcggacaccgtcgatatacatctcgggctgaacatcgatgttgcgggcaatgtcccggatgttcgcccgtgtcaggtcatcaccggcacggcgcaggatctcgaccaggacttccgtggtcgcataggcgagcacattcgacaggctcgtaacctctcccgatgggaaccaggttttcatgaaatccaggtagcgcgccacgcctgcatcgtctttccagcgcggatcatcgggatgcttggcgaccgcggtgctgatgacccctttggcatgatcgagacccgcgggtttgagcacgtagtcgatgctcgtcgatgcccagccgagatacaccgtcggatgccactgaaggtcgccgatcttgcggatcgcctgcgcagcatgtttggccagtgcggcgacgatgacgacgtcgacgttgcgtgccttcaggttcaggatctgcgtgtcgaccgtcggataggcgaggtcgaaggtttcgatggcgacgattcgcttctctgcctccggtccgaagccctcgcgcagcccctcgacatagtccttgccgtagtcgtcggcctgctgcagaagaccgaccctggcatccggcatggtttccaggatgtgccgggcaaagatcaccgcttcggtgcggttctgcggcaatccggtggtgacccaggggttctcggcaggcgccagccatttagatgcgccggaattgatcagaacctgggggactttgcgcgcggcaaggtagggtcgcacggcggtattggctgaggtgccgagtgcattgtacaggaacaggactttgtccgattcgaccagcttgcgggtctgctcgatcgcgcgcggcggcgaaaaaccgtcatcctcgcagagcagggtcagtttgcggccgttgatgccgccgtcctggttggtcctggcgaaaaaggcccgggtcgcggcgcaggcgatcccgtaagccgaggcgggcccgctgagggggaccgtcattccgatccggatttcgtcgtcgctcgcgcccggatcgtaggtcgccgcctgagcccggccgatacccgccagccccatacccgccagccctatgcccgacaggacggccatggccgccagtggtgccagaagtcgcttcatccgtcatttccccccgatggtcgcctgatccgcggtctttgccgcatgtgatatgcaagcatattatcataaacagtacgatatgcgtcgatgcagagcaacccgccgcgcaataattatgtgcttgcgtatggtacgcaatattattaaatatggacaaaagacgcagacgcggcgaaatcgcgatccaccggggaggcagagatggagcaaccgaccacatccggcgcggcggtgcccgggggcatcgttgcgagcccgtggcatcatgcccggcagcggccggaccagccggcggtgatcgtggccgataccggcgaggtggtgagctttgctgaactgaccgacagagcgaaccgactcgccaatctgttcgtcgatctgggattgcagcccggtgactgtgtggccttctacctggagaaccacatccgctacgctgaactggtctgggcggccaagagtgcgggcctttattatgtctgcatcgcccggcagtcggcggtcgatgacctgcgctatgttctggaaaactgcggggcccgggttttcatcgcgtcggcggcggtcgccgacacggcggtggcggccatccgacacttccccgaattgcgatcgttcatgatcgacgggacggcgccgggcttcgcctcttacgaagccgcggtcgcagggcaaagcgaccggccggtcgaggaccggccgcgtggtgcgtcgatgctctattcctcgggcaccacggggcggccgaaaggcatacggcatccgcttcaggatgtttcgccgcatgtcgcgccgccacgccaccggttgatgatcgacacctacggctttggcgacgacatcgtgtttctcaatccggggccgctctaccacacgggtccgctgcggttcatgatgcatgcccatcgcgccggcggcaccgtcatcgtgttccgcaagttcgatgccgcggcggtgcttcgggcgatcggccgctacggggtcacacatggcctgttcgtcccgaccatgttcgttcgcctgctggccctgcccgacgaggtcaaggcagcggcggagctttccagcctgcggatggtcctccacatcgcggcgccgatttccatcccgaccaagcggcggatgatcgactggttcgggccgatcatccacgagatgtatggcgggaccgaatctgtcgggaccaccgtcatcacctcagccgaatggctggcgcatccggggtccgtgggccggccatcgcccggtacggaactgcacatcgtcgacgagcagggcgaggaatgcccggccggcgtgccgggcctgatctacatgtcgagcggccgccgtttcgaatatcacggcgaggccgcaaaaaccgcggccagcactcatccgaaggggtggtacaccctgggagatgtgggatatgtcgacgaagagggctacctctacctcacggaccggcagtcgaacctgatcatttcgggcggggtcaacatctatccgcgcgaggtggaaatggtgctcgccgaccatccggcggtgggcgatgttgcagtgctgggcgtgcccgatccggatttcggcgaggctgtcaaggcggtggtcgtgtgccgccccgcggccgtcgccgacgaccggctggcgcatgatgtcatctcgttctgccgcacccggctcaacccggtcaagtgcccgaggacgatcgatttcgtgaccgagctgccgcgcagcgaggccggtaagatccttcgcgccgaactgcggcggcactattggcccgaaggcgcgttgctggtcgtctgaccggcgtttcgtccatatagtgtgctttagtataatatgcacatgtaccgcgatccctgcggtccgtttcacgggagtcgtcgcatgcatctggcgaaggtgaaggatcactgcttcgcaccggtcgaacaccgcttcgatttcagggatacgatcctctacgccctgggcctgggcttcggatcggaccccgtcgatcctgcggagctgccctttgtctatgaagacgggctgaaggcggtcccttccctctgcgtcgtcctggcccatccgggtttctgggcgaaacgtccggaattcgggatcgactggctgcgcatcctgcatggcgagcagagtttcgagatccacaagccgcttcccgcggcgggggtcgttcatggcgaatatgagatcgaggcgcttgaggataagggggccggcaagggcgcgatccttcatcaggccaagcgcctgcgcgacgacaccggcgatctggtcgccaccgtgcgcagtgtgctgttcctgcgcggggatggcggatcgggcggtttcggaacgccgccggccaccccgggcgttcttcccgacggcctgcccgatgcggtggtcgacctgccgaccctgccacaacaggcgctgatctatcggctgagcggcgactacaaccccattcatgccgatcctgcagcggcgtatgccgccggctttgaccggccgatcctgcacggattgtgcaccatgggtatcgccacgcgggcgctgctccgggcacgggccggcaatgatcccgcccgtctgacgtcgatgtttgtccggttcagccggccggttttccccggcgagaccatcgtcaccgaaatcttcgaccaggagagcggcgtggtgcgcttccgctgccggtcgaaggaacgcgacgtcgtcgtcctggatcgcggccatgccgtgatcacgggctgacatacgtccctgaaggccgccgcgatggccttcctcccatcaaggatatatcggaatgaccgacaatacgcttctcgcgggcaaggtcgtgctcgtgaccggtgccggcggtggcatcggatcgtatatcgccaagctggcggccagccgtggtgccagggtggtcgttaacgatctgggcggctccccccatggcgatggcaatgacaccgggccggcgcgtatcgtggcgggcgagatcaatgcggcgggcggcgaggccatcgccgacaccggcaacatcgccgactgggatgacgctcaggccatggtgcagcgggcggttgacacgttcggccggatcgatgtcgtggtgaacaatgccggcattctgcgtgaccgcatcttccacaagatgagccaggaagactgggacattgtcgcccgggtcgacctggacggctatttctacgtctcgcgggccgcggcacccttcttcaaggatcagcagagcggctgctatgtccatatgacgtcgacgagtggtctggtcggcaatatcggccaggcgaattacggcgccgccaagctgggcgttgccggactgtcgaagatcatcgccctcgacatgcgccgcttcaacgtgcgctcgaactgcatcgcccccttcgccttcacccgcatggtcggtaccatcccgccgaacgacgaacgcaatcgcaagcggctggaggtggtgcgccgcatgacgcccgacaagatcgcaccgctggccgttgccctgatgtcggatgcggccgcggacatcaatggccagatcttcggggcgcgcaacaacgagctgatgctgttcagccagcctcgcccgatccgtaccgtgcatactgcggagggttggacacccgagacggcaatcgaaacggcgctgccggccatgcgaggcagcctggtgtccgtcgacgcctctcccgacgtgttccgctgggatccgatctgacggaaggacccgtccatgagcccgaccaccgttgttgaggggctgtcctcgtcacttgatgatggcgtcctgcgtatcaccttcgatcgtccggaggcccgcaattccatcacccgcgagatgacggtaccccttacccgaatcctgacggatgctcaggcggacgagcgggtgcgctgcatcgtcttcggaggtgcaggcggggtcttctctgccggcggcgacgtggcgggcttccgccgcgcgctcgccgagccggtggccgggcggcaggcggagtttcgcgcccggctggatgctgcggcggatatggtcgaagcgctgctccggatcgaccggccggtcgtggcggcgctgcggggcccggtggcgggggccgggctgggcttcgtacttgcggccgatctggtcattgccgacgagacggcgaagctgatcttcgcccatcgcgccatcgggctgacgcccgatggcggcgtgacctggctgttgccgcgtgtggtggggtggcgggtcgcaaaacgtctgacactgaccgcggcgacggtcggggcatccgaagcgttgaggctcggtctcgtcgaccggatcgtcgcgggcggtgatttcgatggagaagtgacggcggcggccagggccctggccggggcaccgcgcgacgccgtcgcccgcaccaaacgacttctggatgctgccatgaccgctgctccggatgcccagctcgggcgggagcgcgatgcgatcgtggagagcgtcgccacggcagatttcgaggaaggcgtctcggcattcctcgacaagcgtcagccccgcttcccctcggcgcgatgaccgcaagcccggtgctgaagccggcggacctgaatcgaggaccttggcctcagtcgggaccgtcggcgggcccgccgccttcggagtcgatcagctcacgcagattttccttcatctgcgccagcaccgcctcggcgacggcaatgtcttcgggcgaaatatccttcaggatcctggtattcagctgccggccgaccgaggtcatggtttcgaggatcccgtagccgcgctccgtgatgatcacgcgcttcgcccggcgatccctgccgtcgggcagacgctttacgaatccgctgatttccagccggtccaccagacctccgaccgttaccttgcccacgtccaggatccgtgcgagatccgtctggagcatgccgtcctggccgtgagagaggctgcgggaaagctgggcgagcacccaccattgcgatcgggtaagccccagaggcttcatttccgcatcaaacacggtccgccgcatccgcgaaacgtcatgtacatagaagccgatccggaagtccgacggtccggtcagaccgggtggcggcggagcgacgggttcgggggtggattgcggctttgcctgcttacgcttcattcgttactccgaagtctggcatattaatcacgagcgtatcacatcaccggggatcgccgcatcctgcgggcgggccggttgatcggggtcgggcagctgctcgcggaccggcacgaagaccgggcggcggatcgaccggttcaaccggtcaccgccgtcgatcgtgaagacgtgaccggtgacataggcggcatagggcgaacagagataggttgcggcccagccgagttcacggacccggccgacccgaagtgccggtatcctgttccattcagcgtcatagccttcgggacgccgttcccgcatcgccggcgcgtgatccgcatgcgggaagagaccgggagcaatggcgttcacgcggatgccgtcgggcgcccattccaccgcaagcgtgcgggtcaggttggcgaccccggctttggctgcggcactatgggcgtggcccggtgcaccccggtcgatataggtggccaggatgttgagtacggcgccttcggctccggcggcgatccgccttcgggcgaattcccgggcgcagaggaagctgccggtgagcacgatgtcgatcaccgcctgccagccgcgcggactgacggcctccgcacggaccggaaagttgccggcggcgttgttcacgagaacgtcgaccggccccagagcagcctctaccgcgtcgaaggcgcggcggaccgcatcggcatcgcggacatcgagcgccacggcggtcgctgcgcggcatccggccgcttcgagtgccgccagaccggcggcgcgatgttcggctttccggctggcgatggcgatcgaggcgcctgcgcgtgcgaattccagagccattgccaggccgagcccggtaccgccgccggtgatgaagacgcaacgtccgtcatagcagccgggcagcatcgtccggcccgcggggggtggttccggcaatcccgtcacgggcatttccgatcctttaaaaggtgagggccggctcagaggtgagggccggccgcgggtcagagctggaggccgccatccaccgcgaggctctgccccgtgatgtagccggcggcatcggacaggagaaaggcgaccgcggcggcaacgtctccgggcgtgcccatgcggccgagcggcgtgacggccagaagacgttcgagctttgcgggcgtgaactgctccgccaccacccggcggcccatgcctccgtcgatccagccggggccaacgcagttggccctgatgccgtgacggccttcttccttggcgataccacggaacagggcctcgatcgcacatttcggtgcggcggacagaatgtccatccggggcacacgttccacggcggcggtgatcaccgcgaccatggcggaggacggccggcggcgcagatgcgggagggtcgccgcgaccagatgaaaggcgcctttcacgtccacgtcgatcacacgtgaccattccgcggggtccagcgccgaaatcggcgcaagagagaggttcggtcccgcggcatagaccacggcgtccacaccgcccagcgccgcggccgcatcatcggcaaaggctgacacggcggctgcatcttcgagcgcgaccgcacgaaagaagctgccgacgccggctgcggccagttcgtcggcaagcgttgccgccccgtcatggttgcgaccataggtgaaggccacgttcagccctgcgcctgcaagggtggtgcagatggcacggcctatgccgcccgtgccgccggcaacgagcacggattttcgatcagctggcgtcatgtccgggggacctcgtcattcggttgagaccatcttctgcgttgcgggatgacagccgggcccggatcgaggcgacgtgttcacggtattccggtcccatgaccaggctgccgactgccagtctttcgacgttgcgcccctgcgcgcggtccagatccgtcgcaagttcgatcgtcagcttgccggcggccacagcctcgggtggcagagctgccagatgccggcagaaacgtgtcgccgctccgtccaggagatcgtcgtcgtgaacctcgtggacgagaccggcggcgagcgcctgttccgcagtcatctgcatgttggcaatgacgagccagcgcgcccagtggggacccacgatgcgggtcagccggcttatgccgcccgatcccggcaggccgcccagggcgatttcgggcaggccataaagggcgctgcggccggcgatccggaagtcgcaggcgagcgaaagctccagcccgccacccaggcagggcccctgatggaccaccacgaccggcttttccaccgcctcgatcgcatcgaagagaggatgcagactgccgcggccctcccggtaccagcgccggaacgcggcagcaccagggaggccgggatccggaaagagcgggctgtgcagatcggcgccggcagagaagtaggggccctctgacctgatggccatgacccgcatcgccggatcggcgccaaaggtccggacggcctgacacagaccatcggcgaccgcgaggtcgatggcgttgtgctttgccggacggcggatggtggcagtcacgacgccatcggatatgtcggtcgttacgataccactggtcatggatgtcctctgctggcagggcgtcagcgggcggtgaggccgccatcgacgggcagtgctacgccggttacgaaggaagcccgatccgacgcgagccacagggccgcctcggcgatttcctcggggcgtccaaggcggcccatgggaatggaggcgagcagccggtctccgatgtccctgccgtgttcaccgccggtcagtgcccgcagcatcggcgaatcgaccggtcccggacagatggcgttcacccggatgccgtccggcgcgtagcggatcgcaagggatctggtcagccccaccatggccgatttcgccgctgaatagagcgggttctggattgaccccacaagaccggcgaccgaggaggtgagcaggatggcgccgcgaccggcagcacgcatcaggggcaccgcctcgctgcaggccaggaccgtggcggtgaggttgagcgccatcatcctgtcataggcggcgaggtccagcagctcgaagtccgggccgttaatgccggcgtggttccacaggacatccagccccccgagcgatccggcgatcccggtgacgaggccatgtaccccggcagggtcggacagatcccgtcggatggcgatcgcatggccgccgcggtcccggatccccgcggcgagagcctcgacgcccgggccgtcgacatccaccagggcgagccgggcgccttcacgggcaaaggccagcgcaccggcatggcccatccccgaagcggccccggtaatcagtacgcgccgctccagcatgtgcatccgatcgtcctcctgttgttgtatagtaaactagcatacggtaaatttacatacctgatgcaagaagacaatgtgcagatgcacgagatcagcgacacagggggaggatcgccatgcgtgtgagtggcccgccgatcgatcgggaacgggttgagtggatcgccgatctgccggcacgtttcgccgccgaaacgccggacaagccggccatcattttcgatagccgtgcgacctgctttcaggccctcgaagagggaagccggcgtctggccgccggatggcaggctgccgggctggaggcgggtgccacgatcggctatttcggccgcaacagcgagctgttctatcagacgctgttcgcctgtgcccgcggtggctatgtgctggccagtttcaactggcgctatgcggcggcggaactcgcctatgtcctggaagacgcgcgaccggcactgctgatccatgatccggattttgccggcctggtggcgcaggcgctggacgggcggccgtcacgaccgatcctgttgcccaccgtggccgccggggggccaagcctggcgacggcgctgcacggcccgtcggggcccctggtcgaggcaccgcgacgctacgaggatccgctgctgctgatctatacgagcggcacgaccgggcgacccaagggggtcctgttcaagcatggcgcggtcagtgccttccagtccgcctatgacgcctcgccgcagtgggacgactggcggcgcgatgacgtcggcctgtcggccatgcccaatttccatatggccggcatcggcttcatgatgatggggctcgcggtcggcgccacgatggttcacaccgcagatccgtcgccggccaatctgatcgccctgtgcaaccgccacgccgtgacgcggatattcatggtgccgacggtgatccgcatggtgctggacgacatccggcgcaccggtgcgcaggcgccgaagctgaccgggctctattacggcgcgtcacccgtgggctcggctcttctgaaggagggtatggccaccttcggctgcggcttcacccagttctacggcatgaccgaagcctgctcgacccatgttctgggcccggcggagcatgatcccgcacggccgcagctgatgcgctcggtcgggcgtccgcttgccggcgtcgcctgcgagatccggcgggcggacggcggcgtctgtccgccgggtgaacatggcgagatctggatccgcagcgacatgctcatggccggatatgccaaccggccccgggataccgccgaggcgatcatcgatggctggttccggaccggtgacggcggctatgtcgacgaggaagggtatctgtacctgaccgaccgtctgaaggacatgatcatcacgggtggtgagaacgtctacccgatcgaagtggaggacgtgatcatcgaccatccgcaggttgccgcggttgccgtcgtggggataccggatcccgtctggggggaacgggtgacggcggtggtggagcctgccgctgacgggaccgcgccggaactcgaccagctgcgtgacttcgcccggggtcggctggccggctataaatgcccgcgggcgctggtcgtcgtcgatacgctgcctcgcacggcatcgggcaagatccagcgcggggtggtccgcagcatgttggaaaccatgcggacgaacgcctgagcccagacgatccaccccgtctccaccagttggatggagacggggtggctggtgccgccggcgggccgagggggcctgcccgccaggcggttccgggcgggccaaagccgtcagaggagggctttggcgatgatgttccgctggatttcgtttgtgcccccgaagatggaccagcaccggccgtagagatagtgatgcgccatggcggaggcgtcccgcgcagcggtctgcggcaggtccaggccgtcatgcagggctgccggatcgtgaaccgtgctgtaggggcccgccagatcgagagcgacctcgctcatggcctgaagaacttccgtcccccggatcttcagcattgagccatcggcaccggccggccgaccggcggcccaggccgcgaccagccatgcctcgagcgcgaccagggtccgcaggcggaccgaaaggtcgaggacccggtccgcgagccgggcacgcagacccgccggaacggccggatccgcctgaacggcggcattcatggcacggatgcgttgcatcaggcgcagtttggggccggtgtccgcgatcgacatgcgctcgtggcccagaaggaatttcgcgatggaccagccccggtcttcctctccgaccaggtttccggccgggacgatcacgtcatcgaagaagatctgattggtatggtgttgaccgtcgatggtgacgatgggacggatggtgatgcccggggtggtcatgtcgatcagcaggaaactgatcccgtcctgctgcctgccggcatcggaggtgcgcaccaggcagtgcatccagtccgcccaatgggcttccgtggtccacatcttggtgccattgacgcggtagacgtctccttcacgcgtggcccgcgtcctgagcgcggcgaggtccgagccggcgccgggctcggaatatccctggcaccaccagacatccgacgtgacgatgcccggaatgtgccgcgccttctgggcgggagagccgaaaacctggatcacgggccccaccatgttgacgccataggggatgatcatcggggccccggccagcgcgctctcctgcaggaaggcgagctggcgggcggcagaccagccgccgccgccccaggcttcaggccaggcgccggtcagccagcctcgctcgttgaggatcttctgccagcggacatagtcggacttgccgagttcccggcctcgggcgaccttttcggcgatgtcggccggcagcgtctcccggacgaaggtgcggacatcggcgcggaagctgtgcagatcgtcggtcgtcatgtccgggcctccagttcgagcagccttgccgcacgggcatcatgagtgcctgcctggccgcgaatggctgcgacacggcggagatagtggctgacgaccagctcgtcgctcacccccatgccgccatgcagttggaccgcatcgtgggtgcaatgccgggcggcggtatcagtgaccaggctggcggccaggatgatctgcgcgcgatccgggcccgacggccggtccagagcggcgatggcctcgccggccatggccgcggcttccgtggccgcgatctccatgtccgccacccggtgctggagggcctggaaggtggcgagcggtcgtccgaactgctcacggatcgtcagataggccagcgtggcatcggtggcggcccgggcgagcgctgccgcctcgacggccaggcctgcgagcgtccagtcgagcgcatcatggatggcggcatcggccgcagccccctgaagcaggaccgccggggccggcaggggcgtatccgtgaagacgagatcggccgcgccggccccgtcgatcaggcgcagcgccgtttgcccgatccccggcgccgtcgccggacacagcagaatcatcgtaccggctgccgcgtcccgggcggtgacgagaaaatgggtcgcgacatcggcatggcgggtggcgggcttgcggccgttcagtcgcaggccttcaggcgcgggcgagacgtcgagccgcggcggctgccagggatcgaacccttccgcatgcgcaaggaccgggatcatctcgccgtcgagcaccgccgtgatcgcgccggcggcaccggcggcggacaggatgcgaccgcaggtgacggcggccatgagcagcggctcaaccggcaggaaaggcgccagtgccatctgcatggcggcgagatccgcggggctgccaccgcaaccgccatggacatcgctgaaggccatggtcggcgctcccgcttccagcaatgccggccaggcgccgagacgatcgggatggtccgcagccatccgcgcccgtctgacctcgaagtcgttcgtcctggccatcacgcgttccagcgcggcggccatcaggcggtgatcttccgtctggttcgctatgaacatccgggcacccgtcagatcatgaggagggagagggtcaggacccgccttccgcttcggcacggagctggtcacgcagcacccggcgcagcagttttccgacgtccgagcgtggcaggcggtcgaccacgcggatctcgcgcggctgtttggttcgcccgagccgggtacggcagaaatcgataatcgtttcgacaagggcggtctcgtcggtgacgtcccgggacgggaccacgaaggcgaccggcgtttcgccgtagtcggcatgcggctttgcggccaccgcgcactctgcaaccaaaggcagttcctcaatggcgtattccagctcttgagggtagatgtttaccccgcccgaaatgatcagatctccctggcggtccgcgaggaacaggtagccgtcctcgtcgacccggccgatctcacccaaggtctggaacccctgacggctggtctgacctgcggtcttcgccgggtccttgtagtattgaaacgcgctgattccactgaagaagacccggccggtccggccgggaggcagttcctgatcatcctcgtcgaggatgtggagcacacccttcacggcgcgtcccaccgatccgggcttgcgcagccactctgccgtgtcgaggcaggtgaggccgacgctttcggagccggagtagtattcgaccaggatcggcccccaccagttgatcatggcccgcttcagttcgggcgagcagggggcggcagcatggatggcggtgcgatgccagggcgcgtgaaacgcctcccggcgtccggctggcagatcgagcaggcgccggaacatggtcggcacccattgcgacatggtgatgctgcgggtttcgatcaggtggagcgcgtgttccgcatcgaatttgcgcatgatgacggcggtgccgccggcggcggttacggccagtgaccagcgaagcggggcggcatgatagagcggcgccggcgacaggtagcgcagatccgatgacaggccaaagatctggatcaggtcccgggcgaagaccggcgggccatcgcctgcatcctcacgcgaccatagcggccgccagatgcccttgggtgcgccggtcgtgcccgacgaatacatcatgagggcgcccggcgtctcgtccgcaaccggtgttgcgggcattccggcaagcacgggctccagaggcgtgaagcccggtatgtctccgatggcatagtgctgccggcccggcgagggtaccgccgccagcggtgccacggtgccggcgtaacgcgcgtcggccagtaccaggcgagcgtcgcagttgtcgacgatatacgcgatttcgggtgccgagaacgtgttggcgaccggtgtgtaatagagcccgcatctgtatgctgcccaggcaagggcgagcggatctgccgtattgccgaggatggcggcgatgtggtcgccccggctcaggccgtgatggcggaagagttgagcatatcggttggcaagcccttcgagctccgcgtaggaaacgctcccgtcgtcaaattcgagcgccgggcgctccggctggcggcgcgcccagtccctcagtccgtactgcatctctgctgccctcttcgtgcgtttccatcccgttacggtctgtatgccgctgatctgttcataacatatagtacgcatgtttactagatggcgatggtgggacaacatagtgggacaaacggcttgcgccggggccggcacatgatagtcttcattatgatacgctagtgtacaatatggccctgccggaagctcggtccgcctcccggcacgtgccgccatgcgatcgacgcgggctgcccatgacgggccggtactgtcgaagaacggttcgacagaccccctcgcgccgatcggccgggccgatcgaccggaccgcataccaaaaaaaccacgacacacagaaagtcagggaggaatatccacatgaccggttcctttgagatcagggcgatcctgcccaccggtatcgtggcgcttgccgtcgcgatggtcaccggcatcacggccgccgctgcacagaccactctgcgattcgcagattacagtcccaaccgcggcatccgtgccgagatggtcgaggattttctgacgcagatcgaaaccgcatccgatggccgcatcaagatcgagcgctactgggcccagtccctgcttgcgggtaccaagatcctggaaggcgtacgcaatggcgtggcctccatcggcaccgtcaccgccgactatacgcccaacgagctcttcgcatatcgtgtcggtgacctgcccgtgcgcaacccgcacgaggtggcgggagcactcgccctctatgatctcgccaccaccaacccggtcttgcaggcggaattcgaccgtctgggggtggtctacatcgcgaactacagcgtcggccccatccagatggtgtgcaacaggaccgatctcacctcggtcgacgatttcgccggcaagaaagtgcgcgctgtcggtgactggagtcagatctttgccacgctcggtgcgatcccggcgctggtgccgttgtcggaagcctatcaggctctcgggtcggggatggtcgactgttcgcaggcctatggatacacgaccgaatcctacaagctgtacgaggtcggcaccagcttcacggtgatcgatggcgggaccatccaggccaacggcctgttcttcaacaagcgcgaattccaggcccttgatccccgcgatcaggagatgatccgccggctcgggcgagagatgaccgagaagatcgctgccgcgacccgcgcacgcaatcaggatgtcatcgcccggctggaaaccggcatcgacggtcatgtcctcaaggtccatcacttcgacgaagcggacctgaccaggatcgatgaggccagtgcgccgttcctcgacgccttctctaaggatgcggccgcacgcgggatcgatggcgccgctctgatcgcttcttatcgtgcgcagatcgcagcccatctcgaggccctgaagccctgatcgacgatccccctccgatcgtggcccggaaaggcccctgtctcatgcttcataacgtcatctccgccgggcaccgtgtgctcggcggcatcgaacgcggtctgcttgtcgtcgcctcgatcgcgctgatcctgatcgcggcgctgatcctgatagagatcgtcagccgctggctgccggtcctgagaattccggacaatgtcatcatcgtccggcagctcatggttgtgtccatcgcctgcagcctcggctgggttaccgggcgcgacggccatatcgccatcgatctgctctttcagcatatgacgccgcggcaacagcgtgcctgccgcggcctcgcgctcgtttgcgggttggtcatggcggtgccgctcgtggtctggatcgcgggggatgtcggcgcactctacgcgtcgcagagcttctatttcggcgaactgaaactgccggaatggccggtccggacagctttcctgttcgggttgctgtcgcttacggccaggctgtgcctgcagctcgcctccctgctggcgggatcggacgatcccgtgccgtccgatgccgggcacaaggggtgagcgaccatggacccttacctcctcggacttgtcggactcggcatgtcgttggtgcttatcgccctccgggtaccgatcgcctttgccctgggcgtcgtcgcggtcgtctgcatcttcctgttctttgccttgtcgggcggcggtgagccgcgcttcgcgatggcggtcgtgccggcgatgacgctggcatcgggaacggtgttcgagcttttccacagctacgaactgacggcgatcccgatgttcgtggcgcttgggcatgtctgcttccgggcgggtatcaccagcgacatctacttcgcggcccgtgtctggctcgcccggattccgggagggctggcgatggcatcggtcctgggctgcggcggctttgccgcgatctcagggtcgagcctcgcctgcgcggcaaccatgggtcgggtggcggtgccggagatgctccgcttcggctatgaccagcggctggccgcaggctccgtcgcggcggccggcacgttgggctccctgataccccccggtatcctgttcatcctctatggtctcttcgcagaacaatccgtcgcgaagctgttcatggccggcgtcatgccgggcctgatctcgctggtgggctattgggtggtgatcgggatctggaccagcctgcgtccgggccatgccccggcagccgaaagacagttcaccatctcggaacgtgtcacggcaatgctgcgtgcctggccggcggccatgatcttcgccatcatcgtcggtggcatctacggcggcatcttcaccgccaccgaggcggctgccgtcagcttcgcgaccggtaccgtgatcgccttcgccacccgccgtatcaccatgggcgggttcatcgccgcgctgggcgaaaccgccagtcagacggccgcgatcttcctgattgcaggggctgcgaagatcttcgtttcgttcgtgtccctgaccggcattgcccatgtgatggtcgatctggtgcaactcgccgatccggggccggttctcctgctggtgggggtggccgtggtctatctggtgctcggtatgtttctcgacccgctgggcatcctgctgctgaccctgcctttcgtcctgcctctcatcgaacagaacggcttcgatctgatctggttcggcgtgatcctggtcaagctcctggagatgggactgatcacgccgccggtgggtctgaacgtcttcgtgctcgccagcgtcacggagccgaaggtcgcaatcgaaaaggtgttcgccggcgtgatgcccttcttcctcatggacatcgtggtcctggggctgctgctcgcttttccggtcctgtcgctctggctgggcggggcgatctgatcatcatcaccggtcaaaaaaagacgccccgcagaaccgactgcggggcgttcttccgcgggccatcccgagggaggcaacgggtggtcatggcggaaaagtgacgtctgaggagagccggatcggcatcccgccgcgggtctgtccgccttgcggcctcagggccccggcagttgacggagggcgggctccggggcgaagaccgccccgggacggagcgggacgccccgtcggtcaccagcgatcttcgcgcgtgaacaggtcgcggccgatgatctgcttcatgacttcggcagcaccgccggcaatgcgggtgatgcgcgcgtcgacataggcgcgggcgatgggatattcctccatatagccatagccgccgaagaactgcaggcactggtccaccgttttgcagtgcaggtccgtcgccagcagtttgacctttgccgcgtcgaccggatccagatcaccagccatgaagcgggcgatgcaccagtcgacgaacacccgcaccccggtcacctcggcatcgagcgctgccagcacgaactgcgtgttctggaaatcggcgagggtgtggtcgaaggccttgcgttcccgggtatagtcgaccgtccagcggatggcgcgttcggccaccgtaacgctgcggatcgcctgggtcagacgttcctgggcgagcttggtcatcatcatcgcgaagccgcggttctcgtcacccagccggttggcaaccggcacccggacatcggcatagaacagttccgaggtgtcctgggctttgaggccgatcttgtcgagattccggcctcgcctgaaaccgggcgtatcggtcggaaccacgatcaggctgatgcctctggccccggcctcgggatcggttctgctggccgtgaccaccagatccgcgttctggccgttggagatgtacaccttctggccgtccagcacgtagtgatcgccgtcacgccgtgccctgaggcgaatgttcttggcatcgctgccggcgcccggctcggttatcgcaatggcgccgatggcctctccgcgcgccatgcgcggcagccagtggcgcttcgtctcttcggtgccccaggccaggatgtagggggccaccatttccgagtggaccatgaagcccggaccggacatgccggcacgcgccagctcctcgatcaccacgacgttgtagagccagtctgcgccggccccgccataggcttcggggagattgcagcacagcatgcccatctcgccggcccgccgccagatgtcgcgcggaacgatctttgcggcttcccacgcggcatgatggggaacgagttccgtttcaacgaagcgccggacggaggcccggaactggtcgtgcccggaagagaagagggtccgtgtcatggtcatgcgtgcagccccaggatcgagatcgccgcgatcccctgatacggcaccccccccagattgtgggaaaggccgaaggcgggggcgggaagctgccggggccccgcacggccgagcagctggttgtagttctcgtatgccatccggaggcccgacgcgccgatcggatgaccgaagcatttgaggccaccatcgacctggcagggcacgccaccaccctcgcggtcatagaagccgtcgagcacgtcatggaccgcacggccttcctcggagataaacaggtcctccatcgtcaccagttccgtgatcgagaagcagtcatggacctccatcagcccgatctgccggcgaggatcggtgatcccggcttcttcataggctcgacgggcggcaacgcgggtgttgcggacatggctgccatcccagccgctggtggcggtctcgatccccgagctgatcgagagctggattgccttgatggtcaccatgtcccggcggccgagcgaccgggcgatttccggcgtggtgacgattgcggccgcggcaccgtcgctgacgccgcagcaatcgaacaggccgagcggttcggcaatcatcggggcctggagaatggtatccatcggcaccggcttgcgcagatgcgccttggggctgagcacgccgttctgatggcttttccaggagacatgcgcgatgccgcgtttcagatcctccttcgaaatgccgtggcgcgcacgatagccggcggcgagctgggcgaagccggccggcgccgaccccatgggcagccagagatcgttgaaagtgcccttgtatggcggcggcagtccgccgtagccggtatccttcagcttctcggcgccgaccgcgagagcgatgtcgacggcacccgaggcgaccgcataggcggcgccgcgcagtgcctcggtgccagtcgcacacatgttctccacccgcgagaccgggatgccgtccaggcgcagcgccatggaggcgggtattgcggagttgccgacgttgacctgatcgatgcaggcgccgaaccatgccgcctcgatgcgatccttctcgatgcccgcatcggtgagagcttcgtcgaaggcttcggcgagaaggccgtcggtcccgacgtcccaacgctcaccgaaccttgagcaccccattccgatgattgcgaccttgtctttgatgccggttgccatgttttcctccccgggcgtgccgcccgacctcaaccaggaagggcgacgggggtcgccttccagaaatagcgccggaacccgcggaccgtgtcggtctgcttgatccgacagaccatgcgcagcggcattcccgtgtcgagcacgccggtgggaacgtccacgatctccatcagcagacgcgcgccgttgcggaactggacgaagccgacatggagcggtggtgccggatggtaggacagccagtcggcggtgcaggtcatcagttcagcgggttcgtcggccagggatacccggctgaaatcccgggcaggcgtaccgcagccgggtgtcacgcaataggcgagctgcgggaactgcaccgcgccgcaggccggacagcggccggcggtaaaggccgcgagctgatcggcggtgcgataggcttccgtcagggccggcttgtcgttcttctcgccacgcatgccccagtccggacggatttcgccgtaaaaggacagcatgcgcagatagtcgtcggtcggcagacggtcggacagagcgccgctgaccccacgcgcaccggccatcgcgggtgtgcggccgctcgcctccaggatgagggcatctgcaccctggccgaagcccacgagcaggatccggtcaccgggggcggcggtttcgagcacggcacccagcatcagcagggcgtgggcggtgccggtgtagccacaatcgtcgtcgagcggatcggcgacgtcgcctttgaagcccagcgtccgcgcgaccgatgctgccgcaccgcggatcgtcgccggcatgacgaagtggtggatatccccgatggtcagccctgccgaagcgagggcggcattgacggcctttggcacgatctttccgaagccctcgtcgcggatccagcgttcctcccagacatagtcatggggctggtccgaggggcggaagtgatcggcaaaggacgtgctgatgccggcggatcccagaagacgggcgatcacgtccccgctgccgaaggcgaccgcggcggctcctgcaccgcagatctgttccagcgcgctggcgggctgcgtccgggggcggtcggcggcgatgagcagcatgccgtcctgtttccgcgcaaatgcatcgatcagtgcggtggtggctgcacgctgcgagcccgtgcgatcgtcgctgcggacggaaggatccagatcgagcgccgcggcgacgagccccgcatttgagaagtcggcgtaaggcagggttgtggaggcgagggtcagggacgtcactgcggcgcggctttcgccatggccgagggcatccctggcggcctccaccgccatcgtcacgctgtcttcatcccaactgcagaaggcccggtagcctttccctttcggggaagcgccggtcatccatcggtgagccgtgccgatcgcctgccgcgacagcctgaggcgcgggacacaggccccgaacgcggtgatgccgaaggtcatttttcctcccgggatgatggactgggccggtggccctgaggccgccgcattccggccgggccacatgaagtacacaagctaactattagctagcattttccaacgcgggctgccaccataaaacatgaacggaccggcgacgggcggcagcccgctcgcggtgaatgcggatccatgacagaaggacatacgaggtgatgccgtatccggaggcgactgctggcggacctctccgcggtgtgcgcgtggtggaattcgccgggatcggaccggcgccgtttgcagcgatggtgctggcggatctgggggcagaggtggtcaggatcggccgtccgggagagccggcgcggcctcatgacttcatgtcgcgtggcaagggcctcatgacgcttgatctcaaggatccggcggaccgggagacggcgcgggcacttgccctgacggcagaggtgctgatcgaaggcaatcgcccgggtgtgatggagcgcctggggttgggcccggacgatctgctcgcgaaggcgccgcggctggtctacggtcggatgaccggctggggacaggccgggccgctggcctcgactgccggacatgacatcaactacgtcgccgtcaccgggatgctcgatgccctgggcgccgaggggcgcaaacccgcgataccgctcaacctgatcggcgacctgggcggcggggcgatgtttctcgtcgcgggcattctggccgcgctgttcgatgccatgcgcagcggccgtggccaggtcgtggatgcggcgatcgtcgacggggtcaatctcttcgcgggcgtctttcatatgcttcgggcccaggggcgctggccggggcggccggggaccaacctcctggacggtggcgcgcccttctacgacacctatcgctgtgccgacgggaagtatgtcgcgatcggcccgctcgaacctcagttctatgccgagctgttgcgacggctcgatgtctgtgatccgcgcgccttccagcgcgacgacaggacgtcgtggccggagctgaaaacaatgttcgcgcgcctctttgccacccgtgaccgggatgcctggtgcgccctgctggaaggcagcgatgcctgttttgcgccggtactcgaactcgatgaagtgccggaccatccgcatcatcaggcgcgtgaagcgtttcatcagactgacggcgtcctgcatcccgcaccggcgccgcgcttctcggcaacccccgcggcgcgcccggcgatgggggaaccggtcgatccggacgaccttctgacccgctggtcaaccgccgccggcgcctgatccttttcataattcccccgggaggacatcaatggacatcgctctgacggaagaacagactgcaattgatgcggcagtgcgcaaaatatgcagtaacttcagtgacgagtactggacggaatgcgaagaagatctgcgctttcctgaagaatactatcaggccatggcaaacgcgggattcctcggcatcacgatgcccgaggaactgggaggctccgggctgggcgtgacagaagccgcgatcatgatgcatgccgcttcatcgagtggcggcggatattcggcggcgtcagccatccacatcaacctgttcggcccgcacgccattgtcgtccacgggacagccgagcagaagcagcgcttcctgacgccgctgatccggggagaggagaaggcgtgtttcggcgtcactgagccggatgccggtctcgataccaccagcatcaagacctttgcgacgcgggtccccggcggttatcgcatcaccggccgcaagatctggacgtcgacggcacaggtggcatcgaagatcctgattctggcacgcaccacgccgaaagacgcgtgccgcaggcccacggacgggatgtccctgttcttcacgaacctcgaccggtcgaagatcgaggtgcgccggatccacaagctgggtcggaacgcggtcgattctaacgcggtcttcattgacgatctgttcgtctccgaggaagaccggatcggtgaggaagggcgcggcttccactacctgctcgacagcctgaatcccgagcggatcctggtttcggcggaatcgatcggcctgggccgggatgcgctggcccgcgccgcccgctacgcccgcgagcggatcgtcttcggccggcagatcgggcagaaccaggggatccagcacccgttggccgaatgctggattcagctggaatccgcttggtggatgtgtctgcgcgccgcatcgctttacgacgccggaaagccctgcggcgccgaagcgaatgcggccaagttcctgggcgggcgcgccgcattcgatgcctcgacccgtgcggtgctgacccatggcgggatggggtatgcgcgggaatatcaggtggaacgcctgttccgtgaatccatcctgccgcgcatcgccccggtgacggaacagctcatcctgtcgttcatcgctgaaaaagtgctggaccttccgaaatcctattgagcggcattcgtccgccctgcgggagaccgatcatgaccacccccgactggaccaccattcaggcagagatagccgacagcatcctcacgctgacgctgaaccggccggaccgcctgaatgccttcgaccgggtcatgcatcacgaattgggcgaggcgatcgcctatgccgccacggcgcctggtatccgggtgatcgtccttaccggagccggacgcgcgttcagcgccggcggggacatgtcgcagccgccgccggacatcgcggcgtttgcggaagaggctgaagacgcccgcaggatcgtgtccggcatgctggattgtggccggccgatcgtctgccggatgaatggcgatgccatcggcctgggtgccacggtcgctctgctgtccgacgtggtcattgccgcggacactgcccggctggctgacccgcatgtgcgggcgggtctggttgccggcgacggcggtgcgctgatctggcccctgatctgcgggatcatgaaggcgaaatactatcttctgaccggcgacatggtggcggctcccgaagctgaacgtctggggcttatcacccgtgctgttcccccggacgacctcgaccgcgaaacatcgcgcatcgtctcgatgctccttgccaacgcgcctcttgccctcaaatggaccaaaagagccatcaatgcgcatatggacggctatggccgccttttgtttgaaacctctcttgcctgtgaaggactgaccatgatgtcgaaagatcattctgaattccggcgcgcgttcatggagaaaagaaaagcaggctttctgggggcatgagataaaccggcatcgccacgggccgtgcgacccggatcctgcccgcggcccggctgagcctgacgggtgccggcgaccggatggtggcgggccgccattcccgccaccatccgcgccttcgagacgcatctcttcagcctggccggcggctgagcggcggcgcggcctggcccatccggcggcgatgggcatgggccagggcttcggcactgccgaagccgaccagacgggcggcctctttgaccgtgtgcccggcatccagatggcggcgggcctcggccaggcgccaggccgtcagccaggcggcagggctggtgccgagggcggtgcggaaggcggccatgaaggcgctgcgcgacatgccggcgatgtctgccatgtcttccacccgccagggccgttccggcgcctcgtgcagggccgccagcgtgcggtgcagccgggggtgggacaggccggccagcaggcccgggccgtcggcgcccccggcgacggcgctgcgcagcaggcggatgaccgcggcctcgaccagccgttcgatcatgcccgcggccccgcaatggggatcctgccattcggcgaccagcgcccccaggatcgccgccagccgcggatcatggccggcgggcagcaggatcgtccggtccagcgccgccagcagcggattgccggcgccgccgaaggcgatcccggccagcagcagtggggggcggtcggcgagggcggggcggacatccaccgcatcgaacagcgccaagggtgccgcggcatcgcccgccagcgcgaactgcgccgggggcccgtccagcgcggccgcctcgcgcagcgccgtgacccgcagcggaaagcggcgcagaaaagccgacagccggtcgatgcgcagggcgcccggggctgtgatgtcttccggactttggatcagaccttctggaccattcatgtccagaattctggaaggatgatttcacctcgtcaagacatcctgcctatccaaggaggccgacccatgccgcttaccccccgcgcgccggtgccggcgctggccgtcgacacgctcgcccatggccgtttcgacatcgccgccgcccgaccggaacgcatgaccctgatcgctttctatcgcggcctgcactgcccgatctgcatcacccagctgaaagagctggagcggctggtgcccgacttcgccgcccgtggggtggagctgatcgcgatctcctccgatgatgaagaccgcgcccggcagatggccgaacgcgcgggtgtttcggccctgcgtctgggctatgggctggacctcgccaccgcccgggcctgggggctgtacatctcggccgggcgcggcaccacctcgatcggcatcgaggaaccggcgctgttctcggaacccggcctgttcctggtccgtgccgacggcacgctctactacatggcgatccagaccatgcccttcgcccggccgccggcgaaagaactgctggcggcgctcgatttcgtgatcaaggccgactaccccgcacgtggcgaatatcagggcgcgctctgaacggaagcggtctgaatggaaagcggcccggcccctgaaaaaggagccgggccgtatcagggatgcgccgatgccgtcaggcgccggcttctgctttcgccttttcctggttgcgcaggatgaagcgctgcagcttgccgctcggcgtcttgggcagttcgtcgacgaattcgatctcacgcggataggcatgggccgacagccgggcgcggacatggcggcgcaattcctccgccagctcgggcgtgggctcataagccggcttcagcaccacgaaggccttcacgatctcggtacgctcggggtcgggcttgccgaccacggcggtctccaccaccgccttgtgctcgatcagcgcgctttccacatcgaagggcccgatgcgatagcccgacgaggtgatgacgtcgtccgaccggccgacgaaggagatgctgccgtcctcgttcagctccaccgtgtcgcccgacaggtaatagcggccgcgcagcgacttcgtcggcatgttccagtagccctggaaccagaattgcggcgaggcctcgcgatccaccgccaggatgccgggctgacccacgggcagttcttccagcgtgtcttcatccaccaccacgatgcggtggccgggcacggcgaagcccgcggcgccggcctgaaccggatggtccaggtcatgatggttgcacagcaccatgccgagttcggtctggccgtaatgatcgtggatcaccgtccccagatgttcggcgaaccagcggatcacctcggggttcagcggctcgccggcgctggagaccgcgcgcagccggcccttcacgccttccgccagttcggggccggcggccagaagcaggcgataggcggttggggcacccgccagattggtgacgcccagcttcccgatcagaccataggtgctctcggccgtgaacggcccgtcatagaaagtggtggcgacgccgagcgacagcgggccggtgaccgcgtaatacaggccataggcccagcccggatcggcgatgttccagaacacgtcgtcggcgcgcagccccaccgccagctgcatatagcccttgaaggcggcgattgcgcgcagcggcaccatcaccggcttggccgggccggtggtgcccgaggtgaacatgatcaggaacggatcttcgccgcggcgcatgatcggcgcgaaatccgggctctgcgcggcgagttcggcctcgaaatccagatcgccggcaccggcaccgccgcggatgacggcgatggtcgccggcacgctcagctcgttcagcttgtcgcggttctgggcgtcggtcacgatcagcttcgtgccggcggtggccgtgcgatgctcgatcgccttggggccgaaggcggtgaacagcggctgatagaccgcgcccgcccgccaggtgcccaggatggtgaccagcagttccggcacccgcggcagcagcccgccgacccggtcgccgggaccgatgccgcgggcggccagcagattggcgaagcggccggccgcttctttcaacgcgccgaaggtcattgtgccgccatggccgtcgcggctttcatagcgcagtgcgatccggtcgggatcggcggcggcatgggcgtcgcagcactccacgcaggcattcatcgcggcaagatcgccggccagcgactggcgcagcatcgcttcgaaatcgaagcccgcagccgcatcggcccaggactgggtcatcggttatgtctcccccggttcacgagtgacggtccgccgcttgttccgcagcgtgacgttccgggcgaaggtatgcaccgggcccgcggtcggcaatggccgttcgggtcacgtcatgcgatatgttgcgtcatgtggaccttggtcggggggcgcgggctgcggggcctgctctgctccgtggccatgaaacgaccgttcgaattatgttgccgcggacggcgtcgcgggcgaggatatgtgccacgacaagaaacagaccggaggattgcgcccgatgtccgcttcgccgaagctgcccgagttccggaccctcgattatgcggtcgaggacggggtcgcgatcgcgaccttcaatcggcccgagaagatgaacaccttcacctcggccatgatgtacgacctgctgcacctcttcgacgtcaccgatgccgatgacgatgtgcgggcggtgatcgtcaccgggtcgggccgggccttctgtgccggtgccgatctggacagcggcggcgacacgttcgatttcgaccgtcatgccgggcgcaagaaccagatcgcgggcgtgcatcgcgacggcggcggccaggtgacgctgcgcatctatgacagcctgaagccggtcatctcggcggtcaacggcgcggcggtgggcgtgggcgccaccatgcagctggcgatggacatccggctggcctcgaccgccgcccgcttcggtttcgtcttcgcccgccgcggcatcacgcccgaggcctgctcgtcctggttcctgccgcggctggtgggcatgcagaccgcgctggaatgggtttataccggccgggtcttcggcgccgacgaggcgctgagccgcgggctggtgcgttccctgcacgaacccgacgatctgatgcccgccgcccgcgcgctggcgcgcgagatcgccgacaacactgcgccggtctcggtggcgctggcccgccagatgatgtggcgcctgcacaccgccgatcatccgatggaagcgcaccgcgtcgacagccgtgccatcgtctcgcgcggcaagacggaagacgtgaccgagggcgtgaccgccttcctggaaaagcggcccgccgccttcccggcgaaggtgtcgaccgacatgcccgatttctatccgtggtggccagatccccgttttcggtgatccgcgctttcgctgatcccgacttccactgatcaggccccacgacccgacacctcaccccgaacaagagcgacgcctgcccgatggccgataccgagatcctgttccgccccttcgacctggggcccctgcacctgcccaaccgcatcgtcatggcgccgatgacccggtccttctcgccgggcggcatcgtgaacgaggatgtcgcggcctattaccgccgccgcgccgaaggcggggtggggttgatcatctcggaaggcaccggcgtggcgcggccggcctcgctcaacgatcccgcagtgccgcgcttctggggcgaggcggagcttgccggctggaagcgggtgatcgacgaggttcatgccgcgggcgggctgatggcgccgcagctctggcatgtgggctcggcccgcaacccgatgaccgactggaaggcccccgggccgatcgacagcccctcgggcctgtcgtctcccggcaagcgcttcaccgagccgatgaccgaggcggcgatcgccgacaccatcgcggccttcgcccaggccgccgccgatgcgcagcgcctgggtttcgatgccgtcgagctgcacggcgcccatggctatctgatcgaccagttcttctggtcgggcaccaacgagcgcagcgacggctggggtggcgccaccctgccggaacgcagccggttcgcggtcgagatcctgaaggcggtgcgtgcggcggtggggccggactatccggtgatcatccgcctgtcgcagtggaagcagcaggatttcaccgcccgcctcgccaacacccccgacgagatggccgcctggctggagccgatggccgatgccggcgccgatgttttccactgctctcagcgccgcttctgggagccggaattcgagggctcggagctgaacttcgccggctgggcgcgcaagctgaccggcaagcccaccatcaccgtgggctcggtcgggctctcgggcgagttcgtcgccgccttccgcggcgagggctcggaaccggcgtccctcgacggattgatcgagcgtttcgagcgtgacgagttcgacctggtcgccgtcggccgggcgctgctgaaggatccggactgggtcgccaagatccgcgacggtcgcagctcagagctgcaagcgttcacgcgtgaagccttgggcacactctattgatctcgtcttgattggtttttcacgacattttctcggaaaggacgctggcggtggtggcaaaaagggggtttcgtgaaagagccccctgcgttccgtttgttaccggaggtcgtccgtgcccaggaccgccgtcttcgccgtcacgtcctgcatgattcttgccgcctgcggagggggcccttccgagacgtcctcttttgcccagctgtccgggccctggtcggcgcagttcagctgtgccgatggctcggcgctgaaggttcgctacgaacccgatcatgccgtcatccgcaccagcgatggcgaagggctgatcctgccggcggtggagcccggccggtacgagaccaatcgcaacgccctgctgctcaggggcacaggggcggcctggatggtcgcggggcgggtgaccgactgcacggcggcctgatcgccacctgccgccgtgagcatttgcgggccgcgcttgcgcttgtgcccgggacgggatctgctggccggagaccacgagggaggtttccggtcatgttatccctgatccggggccgcctggccccgtccgtcattctggcctgcatgattgccggctgtgccgccgaacgcgacctgccgccgcccccgccgccggcaccggatccggtggcggcgtcgccttcagaagatgtaaacagcgtctatactgcaacctatgtgtgtgacgacggcacccgtctcgacgtgcgcttcatcaacggcccgacgctggaagacagccgcgcggtcgtgtcgaccggcgagggggcgcccctggtcctgccccagaagatcgccgcctcgggcatctggtatgccaccccgcgccacgaactccgcggcaagggccgcgacgcgacctggaccgcgggccgtcgcgccgccgcccattgccaggcgacggactagtccgcgatcgcttcccacggcccgcgatccactaccagggcccacgatccactaccaggacaccgtgtcgccaaaccggtcgatgaagcgcagcccgggcctgccctgctgcgcgatcagggtgtcgaccagggtcggaatggtctcctccatgctgaacggtgcgccgggcccgcccagcccggtgcggatccagcccggcgccatcagcaccatcgcacgcgggtcgccggcctggcgggcggcatagctgcgcatgagctgattgagcgccgccttgctggcgcgatagacctcgaagccgccgctggtgttgttggcgatgctgccctggcccgacgacatgacaccgatcagagaccatcggacttgaccaggtcctcaagcccttcgaccgcccgcatcacgcccagggcattggtcagcatcacctgcatgaagtcttcggttgcgacccgggcggccggcgcggcagcgtcccgattggcggttccggcattgacgaacaggatgtccaaagcgcctgacggcatccgctcgcgcagcgccctgatctgtgcgggttcggtgatgtcgagtggctcgatggtgatctgatcgggccaggcatcggccaatgcgtgcaggtctgtccggccgccgtcgcggaccgtgccgatgacatgccatcccttcgagacgaacgcggctgccatggcctgaccgagaccgcgagaggcgccggcgatcaggatcgtcttcggcgtttcggtgggcaggttgctcatatgtggctcctttcatccgtgccgtccgattatgccggcggccatgacatgcaccacatgcatcagatacaaacgatcattgcagcagacgccttgcgtcctgccgcgccggggatgagcctgccatgaccgcgatcgatctgaacctgctgaccgccctcgacgtcctgctggcggagcgcagcgtaacccgggctgccgggcgccttggtctcagtccctcggccatgagccgcacattggcgaggctgcgggcggcgacgggcgacccgctgctggtgcaggccgggcgcgtgctggtgccgaccccccatgccgagcaccttgccggacgtcttcatgtccttgtccgcgaggcgcatgccgtgctgacgccggcggcgggggatctcgatccggcgtcattggcgcgaaccttcacgatccgcgccaatgaaggctttgtatcgctctttgcggccgggatcgtcgctgcgatcacgcaggaagcgccactggtccggctccgtttcgcaccgaagcccgacaaggatgtgcgcccgctgcgggaggggctgatcgacgtcgaggtcggcacgaccggcgcctcggcgcccgagatgcgcagccagatgatctttcgcgatcgcttcatcgccgcggcccgccacggccacccggtgttcgacggggtgatgacgcccgagcgctatgccgcctgtagccatgtcgtggcgtcgcgcaggggggccatgaccggcccggtggacgaggcgcttcacgagatcggcctgaaacgccggattgtcgcggtggtaccgggctttctcgatgcgctgacggttgcccgccggtccgacctggtcgctctggtaccgcaatcctgcctcttgcacgggcagatggcgcacgggcagggggcggcgcagggcctgcaggggttcgacctgcccttcaccacacccgaactggcgatcagcctgatgtggcacccccgtctcgacgcggacccggcacaccgatggttccggcaggcactgatggcggtgtgccggaagatgacctgacgctgatccccacccctcccggcttgcagatcatcgtcggcagcggcagagtggccggcggggatggagacgggcattcagccgcgacaacaagggacaagggaatgatcagtggtgcggatatcgccgccggcagggcgggcgggctcaggatcgggccggaggtggtcgtggatcctgcggccaggatcgatcgctcggcggcgatcttcggcaaggtaacgttgaaggccggcgtgtcggtctggatgaatgccgttttccgggctgagatgttcgatgtggtgatcggcgagaacaccaatattcaggacttcgtgatggtccatgtcggcaaccggaccggcacccatgtcggccgcaactgttccatcacccatcatgtcaccatccatggttgcacgatcggcgacaacgtgctggtcggcatcggcgccaccatcatggatgattgcgtcatcggcgagaattcgatcatcgcgccgcagagctgcctgaaggaaggcacggtgatcccacccaattcgatcgtggtcggcacgccgggcaaggtggtgcgcacccgcgacaatgccgccgccaaccggctgaacgccttcctctaccgccgaaatgctgaggcctatgccgaaggcgacgaccggttgtggtcgcgcgagagcttccatgccgagatggaggcggaaatcgcccggatcgcccgcgaggcagactgatcggggcgtcggccgatcagagatccgatgccttgggccgccgcggtgcgggcgccggcggatcggccagcaggcgggcgccgcggccacgggcggcggcactttcgtcgtaatagcgggcggcgaccgcgatcgaccggtgcagcgactgggccatggcctgctggatcggcacgtcgcggttggccgcctcggtcatgaagccggacctcaggccatgggcgctgatctggcgcgggtccagcccggcctgtgccgcgcgggtcttcacgatccgcgccacggcctggccgctcaacccatccaggccgcgccggccgaagccgcggccgtcgggggtgatgcgcggattgccgtggcggtcgatcggcacgaaaaccgcgcctgagcggatgcccgaggcctggagccaggcatccagcagctccaccggccggccgatcagccagacccgggcgccgtccacggcgcgggtggttttggtgcggggcagggcgatggtcatcgcgggcagccaacccgccgccgtgccctcgggcgtcagcgcgccgtcgggggcgatctcggccggctgcggccgttcccggcgcagatgttccatccggatcatgccggcctcgctgcgccgccgcccgccggacgcccacatcaccgccagaagggcggcatcgcgcgccgcgcgcagcggctcgcggtcgatatcgatctcgcaggcctgaagcagggcttccagcgtgtcggccagaaccggcgcctgggccttgcggccgggcatgtaggtggaggcacgcatcagcttgcgccgcacctcgcgcacgccggggtcttcggtcgggggtttgagcccgcgcatgcggtgcagcgaggcccagctggccaggcggcgggcgacggtggccggggcagccggccccgcctcgcgtttcagcccggcggccagcagcttctcttccaccgcccgcggcatgccatggtccggattgcgggcgcgttcttccgcatcgtaaaggtgatggaccatgaagcggactaccgccgaagggggggccggccagggcagatgctggccaccattggccgccgcccaccagccggccagatagcgggcgtccttgatcagcgccaggcggctgttggcggcgatgcccgcgcccagcagcacatgcagggtctcgcgctcggcctcgtccaggtcgcccagcccaccggtttcaacggcccccggcagcccggcttcgacatgatcctgggtcgcaaccaggcgcgcggccggccggatcggctcgtcggtcagcacgaccttgcggcggccccgccgtggtgcggcgccgttgcctgcaccacccctggccccaccggtcccactgcgcccggaccctgccgccatgccttatgcctccatcttcagccatccgcaccgctgcggatccgttccggcttcaggctaggcgttccgcggcgtccggtcaaatcggcgggggcgggagaggccggccggtatgcatggagtgtcacgaattggggcgcttcgcaaaaattgcgatggggcattgtaaagatcatgttagtttccagtcatcgaccggaacagaacggatcggcgcaccccccgtgtccagatggtcccccagcctcgttatcctctgcgccttcttcgtcgggctggtcctggccggggcggcgaccttccttgccgtcgaccagccctggacggggctgcggctggtggatgacggcgacgccggcccggcgcgagagccgggcgtgcgcatcgcggccgtcgcccgcaacggccccgccgcagcggcgggggtggcccagggcatgcgcctggtcgcgatcgaggccggcggccggcgcgaggaggttctgcccggcgatctgatcgaggaaagcgacatgctgccgggcttcccagcgatcatcgccttccaggaccgccagacccggctggccgccattctggccgccgactgggttgagctgcatctggtcgaccccgagggagagccgatccggctgtggatcgcgcccgccgatgcccggccgatcctggatctgccgctgctgttctgggtgcagatcatgaccggcgtcggcgcgatgctgatcggcggctgggttctggggctgcgccgcgacggctcgggcccgctgatgttcttcctgagcgcgccgacccttgccgtttcggccttttccgccgcggtctacggcacccgggaactggcgatcgacggcatgctgttccgcgagctgtcggcgctcaatcacctgggggcgatcggcttcggcgccgccatgatttcgctgttcctggtctatcccaaacggctggtgtcgaacctggtgccggttgcggtcggcatagccgtggcggtgctctgggtgctcgacaccctgcggctgacgcccggccccggctatggcggctattacgccacgctgatcgagatgatcctgatcgtcaccctgatcggggtgcagtggcggaagaaccgccacgatcccaccgcgcgggcggcgctgcgctggctgggcctgtcgatcgtgctgggggccggcgccttcaccatggcgatgatggtaccgctgacgctgggcaccgaaccgctgctctctcagggcatggccttcggcttcttcctgctgatctatatcggcctggcactcggcgtgcgccgctatcggctgttcgagctggacgaatgggccttcaaggtcatgttctacacccttggcgccatgctgctgctggccatggatggggtgttgatctggctgatcgggctggaccaggcgccgtcgctggggctgtcgctgatcgtggtcggtttcggctatctgccgctgcgcgagatcttgtggcggcgcatggtgctgcgccggccgatcgccgatcacgagctgttccgccaggtgatcgaggtcgccttcaccgcgcgcccggccgagcgcgccgaacgctggcgccagctgatccgcaccgttttcgacccgctgtcgctggagccggcccggggcgaggtgtcggtggcccgggccgatgccgatggtgtgatgctgctgctgccgcccaccgccgacgcgccggcgctggaggtgcgctatccctggcgtggccgcggcctgttcggccccgcgcatctgcaattggcgcgcgagatgacccagctgatgcgccatgccgacgagggccgcgccgcctatgaacgcggcgccaccgaggaacgccgccggatcgcccgcgacctgcacgacgatgtcggcgcccgcctgctgaccgggctgcacaaggccgatctgggcgagacccgcagcctgatccgtagcgcgctcgccgatatccgcaccatcgccgccggccttgcccgcggttccatgccgctcggccgggtgatcgcggatctgcgccacgaaacctcgggccggctggaggcggcgggcctggcgctggactggccgctggacgacggtgcccatgacgagctgccgctcgattatgcggtctaccgcaacctgttcggggcattgcgcgagatcatcagcaatgtcattcgtcatgcagcggccaccaccgtccggatcgagatccgggtcgaggatggttcgctgtacctctcggtggcggatgacgggatcggcctggtggcggccgccgctgcggatgccgacggccgtgcagacgccgatggggaacggccatccggcggcctcggcctcggcaatctggcgcggcgggtgggcgatctgggtggccggatcgccttccccgaacagccgaggggcacgcgggtggatcttgaactgccgctggagggcacacgtccggcgacagccggctgacatcggcatccaagcttgaggacacggaatgagcggcagcagcaccgaacagcgtatcggtctcgtgatcgaagacctggcccccacccgtgcctggctggtcgagatgctgaccctgaccttcccgggcatccgggtggtgacggccgacagcctggcctcggcccgcacggccatggccgggtgtttcggcccggtggatgccgcccgcagcgtgccgcatctggccctggtcgatctgggcctgcccgacgggtcggggatcgagctgatccgcgaactggcctgcgcccggcccgatgtgatgccaatcgtcaccaccatctatgacgatgacggccatctgttcgacgccatcaccgccggcgcccagggctatctgctgaaggatcaggatgccgggctgctggcgcagtatctgcgccggatcgagcgaggcgacccgccgctctcgccctcgatcgcgcggcggatcctggcccggctgcgcagcccggccgcgcccgtaccgaccgcccccggcgccacgctttcccccgccgatcccgacgtcaccctgacgccccgggaaatagaggtgctgtcgctgcttggccgcggcctgcgcaatgccgaagtcgcgcggctgctgtcgctcagcgagcacaccattgccggctatgtgaaggcgatctacgccaagctcagcatctgctcgcgggcggaagccgcgctggaggctgcgaagcgggggctggtctgaccgcccccctcaacgcagtcagcgcccggcgcgcagccgcacccgccggtagagcggcgccacgatcagcggcgagaggtaaagcggcagctgccccgccgccatgatcagctcaagcggccggtcgccctggccggaaatcgccgccagcagcaggatcatgttgcgattgcccgagaccagcgccgccgacagccgcgcctgcaccgggaccggcccaaggatcgcgaagccgaagaccgcgaagcccgtggcctgcagtgccaggttcagcgccagcgtcgacaggatggcgagcgtcatgaagccgggggccgcgaccagcgccggccccaccccgtgcatcaccgcaaggcccaccgccgccaccagcagggtgatgccggtgtcgatggcgggggccgcccgcctgatgcgcggtcggccgatcagggctgtgaccagaaaggcgccgccgaagcttgccccgatcatcaccgccagacgcagcgccgtcaccaccggatcgatcgccgccccgccgcccagcagcagcgccaccgccggcaggatcaccggcgccaggatattggtcggcagcccgaccagggtgagcagggcgacatcggtccccagcagcacgccataggccgccgccgacatcatgcccggtgtcgccgcgatcagggtcatggcgcgcaggaagacgtcgtcggccggcagcaccagccgccccaggcaccagaccagcaccgggcaggcgagcaggatccagaaaatcaccacgatgccgagccccggccggcgcagcacggcgacgaaggccgccggctccacccgaagcagggccaggaacatggtcaggcacgacagcggcagcagtgccggattggccgcggccgccagatccggcagcagaatgccgagcccggcgcccgccgccatcagccaggcgccatggcggcggatcagggcggtcagggcgccgggtgcggggaggggcatcggtggtgatcgccctatgacagcgatttcggcagcgccgtcaccacctcgggcaccagcaccatcagcatcacgaaggcgaccatgatcaggcagaagggcagggcggcgcgggccagtttcaggatgggcgtgccggtcaggccctggatgacgaacaggttgaagccgaccggcggggtgatctgggccatttcgacggtcacgatcaggaagacgccgaaccagatcgggtcgaagccggcggcggtgaccagcggcagggtgaccggcagggtcatcacgatcgccgacagcccgtcgaggatgcagcccagcatcaggtagaagaccagcagcaccgcgatcagcatataggggtgcagacccagcgcctcgatctggccggcgatttcgaccggcaggcccagccgtgccatggccttggacaggaacagggcgcccgagatgatcagcccgatcatcgaacaggtgcggaccgtgccgagcagggcatcgaacagcttgcgccaggtgagcgtgcgctggcccagcgccaccagcagggcgccgagcacgcccatcgccgccgcctcggtgacgctggcgaagcccagatacatggagccgatgacgaagaggatcaggaacagcaccggtgccagcgacagcagggcgccgaatttctgcccccaggacagccgcggttctgcctcgggcagcagcgacgggtcgatcgtggtccgcaaccccagatagcccatatagagcagcgccaggatcaaccccggcacgatgccggccatgaacagttccaggatcgagacattggcgagcacgccatagacgatcatcgggatcgagggcgggatcaggaagccgagcgtgccggcaccggccagcgagcccatggcgaggttgcggtcatagccgcgggccaggagttccttgagcgtgatccgcccgacggtcgcggtggtggcggcggaggatcccgaaaccgcggcgaacagggtgcagcccagcacgttcacatgcagcagccggccgggcaggcgccgcgtccagggggaaagccctgagaacaggttctcggagagccgggtgtggaacagcagctcacccatcaggatgaacagcggcagggtcaccagctcggccgaggtggccgtcgaccagagatcgcctgcgaggaagcggtcgacccgcatgttgcggaagacttccaggctgaccaggccgatggaggtaagggtgatgcccacccagacgccggcggagagcagccccaccagcatgccgaaaaccagaagcaggggcaggctcattcgatccctccggcatgtcggccggcatcttccaccggatcattaaccagcgcgcgcagcacacgggcgaggaaggcgagggcgagcagcacgaaaccggcggcaagcagaccctgcgggatgatcagcggcgtcgccagcggatagaacgaccgcgaaccgatctcggcggtgcggatcgcctgcgagaccatggcgacggcgatgaagccggtgacgcccaggccgaagacgctgccggccaggtccatcagccggcgtgcggccggcggcagggcctgggtcaccgccgcgacccggatatggccgccggtacgcagcgtccagccggtgccgcagaacagcacgaaggccagaagataggtgctgaactcgatcgcccagggctgcgaccaggcgaaggccgaggtggtgatcacctcgacgatcagcagcagggcgagcagggcggcggcaagggccgccacgaccgcgccgacatagttcaggcggtcgatgaagcgggtaagcaggcgcagggccgtcatgacgccccaatccagtttgggtggtgaccgtgaaggggtgggggcgggaggtgtggaggtccgtccgccggcgcccggcctgaaggccggggccgccgagggggaggcagagacgacccaggtccaagggggagacagggtgcccgggcgccggcggtccggatcagtggccgacggccttgtgataggcgtcgagcaggggggcggcggcggggttcgccgtcacgaactcgccttccatcgaggcggtggcctcgcgcattgcggttttgagcgcgtcggaggcgggctcgacggtcatgccgttggcgcgcagctcgtccatgcgcttggcgtgttcggccttgctgatctcccagaactggggctccagcttatgggcggtggcctcgatcatcttctgctgcttgggatcgagccggttccactcgtccaggttcaccaccatcaggttggacgcccacatatggttggtgttgtaggcgtgcttcaggaactcccaatatttctgggcgaccgcggtggtgcccgaggtcatcaccgcatccagcttgcccgaggcgagcgccggcacgatgtcgggattgttcatctgcagcgccaccatgcccagccgcgtgaccatgtcggcggtcacccggtcataggtgcgcatgcgcacgcctttcaggtcgtccagcgtcgcgaccggcgtcttggtgaagaagttctggctgggccagggcacgacatacagcaccttctggccgcgcttctgcagttccgcttcccagaccgggcgcacgatcttcatcagcgccgccaggtcgttatagtccgaaatcaggaaggggatgctctccacgccgagcagcgggatttcgccgacattctggaaggcggcgtattccgccatcggcaccgcgccgtcttccaccgcgcgcagcgactcgttcgccttgatgcccagcgcgccgccggtgtggatggtcatctccaccgcgccgccggtgaccgccttcacctcttcggcgaatttctgcgcattggtggaatggaactcggtcgggccccagggcagcgacacgtcccattggacatcggccgcccgtgacgccacgggctggaaaagggtgaaggccgcagccgcggcgatcgccgcgaaaccgcggcgcagcgtcggatgatgcatgatggtcgggctccctgaagcctgggtctctgccgtccgtgcccgctagggccatccccgatagggcgcgccccgccggccggaccgccaggtccggcacggcggctcccgacacgccgtcgcaggttgttatgcccttgagcaaagcacgggcagccgatcctgacaagaaatatgtacggacaaattttaaaatgtctggacaaatatcacagcgatcgcgctaagctgcggcgaccgcaggcaggcaatcgggagaggccgaatggagcaggagatctatctggaacggcaggggccgatcgcgcgcatcgtgctgaaccggccggcgaaacgcaatgccatgaccgcggccatgtggcgggcgatcccggcgctttgtgccgagattgcagaggatcccgaagccctggtcgtggtgctgaccggcgccggcggcaaggcgttcagcgccggcgccgacatcgccgaattccccgaggtctatgaaacgcccgaaagcacccgcgcctataacgaggcggtggaggcggcacaggaggcgatcgtggcgctggaccgtccgaccatcgccgcgatcagcggcgcctgcgtcggcggcggctgcggcctggcgctggcctcggatttccgcttcgccacggaagatgcccgcttcgcgatcccgccggcgacgctggggcttgcctacagcttcaacgccacccgccgcctggtcggcaaggtcggcccgtcgcgcgccaaggacatgctgttctcgggccgcctgatcgcggccgacgaggcgctgcgcatcggcctggttgaccgcgtcgtcccggccggggcgctggaccagacggtcgccgcctatgccgaacgcctggcctcggtctcgcaatacaccatccgcaccatgatgcgcatggtcgacgccatcacgctcggcgccgacgagcccacgcccgagcttgccgaggcctgggccgcttccttcaccggcaccgatttcgccgaaggctaccgggcgttcatggagaagcgggcgccggtcttccggtggcgatgacggaggcacaacatctaaaggtcatttatatagaaacaaaacaacctggactcgataattctgctaaaggggcctaccgtcgtctcccatgcatgtcgccgtcgcagcctgcgtcatcccggagacatcccatgcccctggacgaaccccctgctgccgacgagcatgaccgcatcgtcggtgcggcgctggctgatctgcagcgcaagggcctggcgcccgatcacgccatcctgcgggcgctcgccggcccggaatccgaggcggcgattgcccgggcgctggccgcagcgccggcctctgcggcacccgaggcgcggatcgccccgggcacgatcgggttcaccgacggccgggcgctgaccatcaacgtgaccggcgccctgcgtggggaggcgtccttcgtgcagcatcacacggttgcggcacggggcaatgcgggcctggaactgccgaccctggtcaccggccgtgccgggctggtgctgttcatgcccgaacaggcggccggtgcgatcagcgtcttcaggaccggccgccccgatcaggcgatcgtgctcgtcccgcccggcgggctggtgacctcggatcagccggcgaccgacagccgcgcgccgctcgactacaccacgcgcgcctggagcgcccgcctgcctgccgcctggatggccagcgggctcgacctcaccttccgcagcgatgacggacggaccggcaacctgccggcatcggggatcgatttcgatgcgccggcagagttggtgctgcagaacatccgcatcggcatgctgaccgattatggcgatcatcactggttcgagcaggacccggccatggccgggctggactattttcagaagatccccgtgcgccggctgatcgtcgcggcctatctgccggtacgcctccagccgatccggatgccggatggccggctttacaccaccgccagcaccgatcagggtggtgtctatgatggcgacatgcgcgagaacatcggcaaggcgatgatctcgatcggcatcaacaacgccaatttcggcatcgtcgacaccgccggtgccgagcaggtccagccgcaatattaccggcaggtggtcgtccacaccaatgtcggcgtctatgccaacggcgtccaggtccatggcctgagcggcggcaacggcatggcgacgttgatttcgaccgacggcaacgaattctcgcacgagctgggccataatcacggcctgggccactatcccggcggcgggcagtggtcggcgcagaatcctgccagcggctggggttatgacgactggcgcagccgcttcatcggcaatctgtggtgggaggcggccccccaggacaccgtcatcgaaggggtgaccacgccgcccttcgccggcagctataccttcaacgccgaccccatggcgggcggccggccgagcggtgcgatcacccggctgacgctgcacaccggctacagcatccggcgcgttcagcaggcttttgccgccacacccgtgcccgatccgtcgagtgcgaccggctatcgcaaatggaaccccgccagccacagcatggagcccttcgcaccgggcgggccgaaaccggtccattccggcgtgccggtggtcaccctggtcggcttcttcgatcccgatgcccgcttcgataccttcctctgcccgctttacggcaattacggccaggtcttcgacctgccgccgccggcatcgaccagcggcacggcgtggctggaaatctccggtcctgccggcacgcggcggatcgcgctcggcaatgcgcgtcacgcggccgggcagatgaataagttccacatcaatctgcgtcagagcgacctgccggtcacggcgaccttcgtcgaccgcaccgggcgccggcagtccttcacggtgcctgtgccgcccgcggccctgcccgacccggtggtgatcggcggcgatgacggctgggagacggcggtggtgccgcgcctgcccgatttcacccgctgggcgccagaaccgccagtgctggacagcgagcaggaactggagcgccagctggccgacacctatgggccggtgcacgcctggcggagcgatgcccgcagcggccgccggcccggcgaactctatggctacgacaatccctacaatggccgacggcagtatttcctgctcaaggccgacacctattggtattttccgaccgagagtaccgacaaccagtggtggcggtatctgggcgacgccaatgccttcgtcgaccaccgtccaaacccgctgcgggcccgcgctcaggctgccagcgccacgctcgatgcggccctgaaaacctattacggcacgacccagctggtgacctgcccgaggagtcgggcagaggcgccgtcacccccggtgcgggccggcgtcgttggggcgctgtggtacgcggcggccagccgccgctatttcctccagcgggtggcgagtgccggatgcggggacctgcccgggacggccaccgacaacgccgccttctggtatgttggggaggcggatgatctgacggccctgttcatgcgcccgatggcccgcagcgaggcagaccgccaccaggccgcgtggtacagggtcgaccgtttcctcgaatggggcgagcgtggcgagggcacggtcggacgcctgttccactacgaaaatacctaccgcaacacgctggactatttcgttcagcaggaaggcggtgcctattacttcccgaccgaccaggccagcggcggcggctggctgtatctcggcagctttcgctgacccggcggtcatggcgggggaggggagggcggctcagatcgccgccccctcttcctcggcctggcgcatcaggaatttctggatcttgccggtgacggtcatcggcatgtcttccacgaagcggatgcggcgcgggatcttgaaatgggcgatgcggccttcgcagaagcccagcaccgcggcctcggtcaggctgctgccgtcgggattgtcggcgcggcggatccaggcgcagacctgttcgccgtatttggcgtcggcgatgccgaacacggcgacgtccagaatgcccggatgggtgatcaggaagttttcgatctcgaccggatagatgttctcgccgccgcgcaggatcatgtccttcgaccggccgacgatgcggcagcggccgcgttcgtcgatcacgcccagatcgccggtgcgcatccagccgcccggggcgatggcatcgcgggtgcgggcctcgtcgttccaatagccggccatcacgctgtagccgcgggtgtgcagctcgcccaccgtgccgaccggcaccacccggtcgtcgccgtcgacgatacggacttcgacgaagggatggatggtgcccaccgtctcggtgcgggtttcaagatcggcatcggcgcgggtctggaagctgaccgggctggtttcggtcatgccatagcagatggtgacctcgcgcatgttcatcttcgcgatgacttcgcgcatggtctcgatcgggcagggggcgccggccatgatgccggtgcgcagcgtcgaaaggtcgaagctcttgaaatcgggcagggccagttcggtgatgaacatggtcggtacgccgtgcagggcggtgcaacgctcggcctgcacggcttccagcgttgcccgaggctcgaaggcttccgaggggaagaccatggtcgcgccatgggtgatgcaggccagaaccgacagcaccatgccgaagcagtgatagagcggcaccggaatgcacagccggtcggcctcggtgaagcccatgatccggccgacgaagaggccgttgttcaggatgttgttgtgggtgagcgtggcgcccttgggcgatccggtggtgccgctggtgaactggatgttgatcgggtcgtccggacgcagcgtcgggatgatcgcgtccagcgtcgtccgcgccgccgcatcggcaaagccggtcagcgtctcgaagccgatcatcgcgccgcggctcttacccagcgggatgacgaattccaggtcgggcaggcgtgcagagcgcccgcccgcttcggcaaattccggcgcgacctccagcagcatgtcgacatagcgcgaggtcttgaaggtctcggccagcaccagcgcccggcagcccgacagcttcagcgcgtgttccagttcgaaggtgcggtaggcggggttgatgttgaccaggatcagcccggcgcgtgcggttgcgaactggatcagtacccattccacccggttcggcgaccagatgccgatccggtcgcccggctccagccccagcccgatcagcccggcggcaagctcggtgacccggcggtcgaactccgcccagctccagcggacattctggtgcaccaccaccagcgcatccccctcgggccaggtttcggccgtgcgggcaagggcggtgccgatggtctcgtagcgcagcggcacatcgctggtgccgcagacatagctcatggtcagctcggacatgggagtatgccgtctcgatttcggaaagcggaatgacgtgatgacgaagggcggcgggcggcgctcagctcaccatgccgagggcgatcatgccgcccaggttttcgggccagctgcgcgtgcggccggcctgcagcagcacccgcgcccaggccacccagcccgaccaggcgatgcgcttgtcccaggccgtgccccaggccgacaggatgtcgagcccgatgcgggcatgggcggcggcggtgtcgtaatcgccctgggtcagcgcgatttgcgccagaaccagatgcggttctgcgatgtcgggattgtgcgcgatcgcggttttcagcagcgaaaccgccgcgaccggggtcgaaatcgcatgggcgcgggtgacgacctgccagtagagcgccaccgccgccatctcgtcggcctgggtcaggatgcgggtgcaacggtcgaaaaccggcggcacgggcaggccgagatcggccggcaggtcgcggagcggtcgcgccatgcgcgaggccaggctccaggcctcgttgctcggcatcagctggccgggccagagcgaggcggcccagttctctttcaccggctggcgggtctgccaggggaagccctggaacacgtcgtccacccagctgtgccattgttcggtcagatcggcgatcgagacgatcgcgaagatcgccgcgtccttctgcgacagatgcagcatgctgccgtctgatttttcaagatcgagcccccggccgggatggcgtcgatctcggtcagcttctgcacgaagcgggtgcggggcatcacgcagaaggtgtggatcagccgctcggcctcctcgcccaccgcggccgccagctcggcccgtttggccgaggcgtcgaacagcttcagggccacgaattcattggaatagacgctgtggaacaggcccagcacccgcacatcgcgcggctggtcccaaagggccagggtgcggtagacgtccagcaggtggttcttgaaggtgccggccttgtgccaggcctcgccggcactgcgcgagaacagaaggtcgagcagggcgggcagctcggcatccaccttttcccagtcatcggccagaagggccggcagcagcgggtggagcccggcgccggccggttcagaagcaggggcgggggcagtctgggcggtcatcggtcattccctccggcgccgcgtgccggcttcaggccgcggtcatatctgttcttccagcagcagccctcatccccagaggcctgcctgcgtcgggtatgacacacccgttggcgtttcgctgcaagtgatgtttgaaaatgcaatcaattcagcggcacgcaagcctccggctggtcgcctgccagccgcaacagcggccagcggtcgcgccagcccttgtccttgacccgctgaaggtgaaccgcatggcgtgcgggtgtcatgaaggccggggtcgggcgtgcgatgatcgcgaacagatcctccagcccatgcggggccgccacacgcagctgcccgcctgctgtcaactgcaccgcaacggcggtcgccgtctcgggccaatggcgcatcgcatccaccgccgaggcatagggcggatcgtcattgcgcagatgcatgcgcgcctgattgtcgaccgaccatcgcacatttggacgtattgcggacaactgcgcctccaacatcttgtcctgttcgcgatgcggccgcagcgcatcgaaccagatcacatcgatatcattgcggggcagttccggatgtcggccgtgcagatgatcccacaccagatcacgcacgaagccggccgcaacccagcaatcggggaggccacatgcggcaacctcgcccaggatcgacaaatgggcgggggatgcggttacaatggtgatcaggcgctgttccagcgtgtccatgccgccctcttctccgcccgtctcaatttttctttcagaatcaatgtattggaggctaccgcatacgaggttgcaggcggccgggccgccctgccccgtgcagcgatcatcgcatgatcaccggcctttcaacagcctgaaatctcctcaataaagtcgataagatataattatcggactttgatataaaagactataaaggcttcatgactgaagagcttgcagctccgcctgattacaatcatcccagagccgaccccgcatccttcgccagccaagatagaggttcagccatcccatccaccatcggcccgatagccgaagcgctgcatcatatccgccgaccggtccgccaactcccgtagcagggccggatccgccgcctgccaaccgataccgctccgtcccgcacgaaagaacgccggcgacctgccagggcgttcgcgaaaacccacacgccgttcctctgcctggaggcgatcgaagcggcagaactcgaccgcctgtgcgatcaccccgacatcttccgtcagcccggccatcgctgcggcccgggcgaagccggcgattgcatccgcgcgcagatcttcatagcgcaggctgatcaccggccagggcagatcatcggcggtccacgacgccgtatgaccggcccaactgccgacggtttcaggcatcggcagctgcagccggtccttgtctccgccgatgcggtgtgccgggtccagcagcgcgcgaatggtgtcgtcgatcgtccagccccgatgatgggcataggatgccgccacatcgaagggatgccgcaccagatggatgacaccgcgcacgatctcgggcggatagagccaggcgccggcatccgtgcgccgggccgcctcatgggtcttcagaaccagcggcgcatccgccggctgccccttcaccagactccgaaacacctcgggccagtagcggtcgatttctgtgacggtcagatccgacgcttcgaccggcccgaaccggtcgaaaatcatccggcgctgcacataaaggccggtttcgatgtcgttgatcgagatcggcgcccgagcgcggcggatcaggtgatccagcaccagcctcgtccaggtgttacccgatttcggataactcgcaatcagcaccagcgccgccgtcaccgaccggcctccgcgacccgagcggccagccggtcacaaagttcgtctggcgatggcctgtgcgcaacaccgacgcgccatacctgaagttgtgccgcaagccgcgtcatcatcgccatatgcgccgcctgccggcccatcgcccgcacctgccgggggcggaacacctcggccgccagggtttcgagccggtcgaccccgctcaatacatccgtatccccggcccggtgcagatcaagcagcaccacatgacccagcgccaccggccccgacatcggcatcgcctggtgcaacacccggccgtgttgcggccgcgccatgggcagttccgtgggggtgatgccaagcatccgggccgcatccggccaaagcgccacgatcggcgtgcccggccaggcaagcggccgcccccggccgtccagcgtgacccgaaccacctcgtcggccacgaaccgccagccgcgccccagcagcattgccgccagcgtcgacttgccggcccccgatgcgccgctgatggcgaccgccgccttgcccccggggggcaacaggcaggcagcatgcaatggcaactccccccgctgatggatcaacccggcaagcggcgtgcggacggcgaaatagtccagatctgcgtcggacgccccggcctcgccggcgatcagaagccgccgcccctcctcggccaggaatcggccaatgccgggcatgcggaccagcaaccggtcggccgtcgcctcgacgaacccgttcaccggcaccgccccggccagatggtcgggaagagcctcgacccggcggatgtccacatccggaaggtcggggcaggatgtgatcggcggcgtcgacgaagcgggcataacgatcctgagctgactgactgcgattttgccgttatacaatgacacctgcccggtggtacagccgccgccaaaaccgaagttgccatgtttatagtccgcgattttatgcgctcccggacgcttcctgacctgctgattcttggtgcccagcgatccggcacaacttggctgtataatatacttgcctcgcatcctgaggttgccgtcggccaggtcaaagagtcacaggctcttaccttgttctggccagaggcatatgatgtctggtcccgcctgctgccgccacgccgcggccaccacgaccggcggttgcggatcgatgccagcccctacatgctcgcccatccgcttgccccggtccgagcggcacagattttccccaagccgccgaagatgatcgtgctcctgcgtgatccggtcgtccgcgcctggtcacattactgccatgaattggctgccggccgcgaatttctggggtttacggaggcgttgcagacggaggcggagcggctttcaggcgaggctgaacgcttcgaccggatcgttcgtgggcttgagcgagacaggccggatatgccgcatcaatgctggtcctatatcgaaagaggccgctacgccccccagctggatcgatggcgccgtcattttccgtctggatctctgctgatccttcgatcggaagatctgttcaaagctccagggcccaccctcgccacggttggcgcctttctcggtcttgatgggctgtcacttcccacaaacgaactcaaacgcaatgccgggcccgtccatccgatgcctgatgcagctcaagccctgcttcgacaacacctgcccgacggcccggcatggcatgatgcctacaataatatgatgacgcccactccatgatggacaagccaagatcgtttatctatcctggaggagattactctataacttgcacaggagggcaaccaaatgaccgatcggatttctccgcccgcgcacacgaatgccgcggacaacacctcacagggccaatcggtctgggcgcgcccggtattgcggcccctgatgatcgcctccgagacgctgactggcgttgcttatggcagtgatggcaattgtgggtcttgattgaaaaactgacgccatcacccgccggacctgtcttcaggcatcatgggagtgcctgtgcgcaggcaggtgcggccgaggatgtgcccccgactcgtcccacctctccagcaccaaagccggtaatatgcgcccgggatgggcatcgatcgggatagtcgggttcctggcgcaatggtccgacctcgtcggcgtctggcttccgtagggcgccgtagccctgaactgcattagagtttcgcttattccttgcacatacaggcactagcggatgccccggagaatccctcctcagacctcatgcaacatgagaagcaacgatatttctgattgaaacgatcactgctgtcggcttccgcagccagatgtttgtgcagtgcagcgatatccgtgatatgctaattacctctcgctcattgatcggactctcgacatgaaaagctacatctcatccacctcgcatcatcagtcggttggtggtcatgggcatgaggacggggcgcagcccagctggtcacggccggttctgcgaccgctggcgatcgcctcggatacgctgaacaactactcgaactcaggcggtgacggtatcggctgcgtgtcgtaactgccgcgaccgggcctgctgttcaggcctggccctcagacgtgatgtgactgcccgatcggcgctgcccccgccgcatcgcggcggtgcatgatcagccgccggacccgccgcgccaccgcttccagcgccagagccggcaacagaagcggtagcacgcgcccgaaatggcgatcgatccgggcaatccgtgcatcgggctgccggctggtcgatcgccgggcagcgtggttgcgcaggatgccccgcgccagccggccgcggccaaccgccggttccaccggcgcccccgcctcggccaggcgggtcatcagccggccgatatccgccggcaccggccccttcggcacctcggcataccaccagcccttgtgatgcatgccatgggtgcggcagcgctccagatggtgcggatcggtggtacggtttgtggccagatcggcatgggcgaaccggcggaatttccaggccggacgcgccgacggatcgacatacgagaaatgccggccggcgcccggaatgaccggcgcggcatgcagccccctgcgcagggcctgcatcgatcgcggcggcaggccgcgggccggatcgcccagaatatccatcacccgcacgaccacgcccggtgcacagaaccacatcgggtccagcgcctcccaacgcccgggcttcagccgcggcagcgccgtcgcaaagggcagcgtcggatcggcacagcagggcgaacgcggccccaggcgcagcggatgctcgtaatggcgggtcatgcccagccgcatcggccgctccagcccgtcgcgtttcagccggcgcagcaccgccggatcggggatctcgtccacatccaggatcagcaccagatcgtcgggacgcgcatcctgcagcgcaaaaaccgccgcattgcgctgaaaggcctcgcgatcccaacccgaactgtcggccggccccagccggggcaagccgacatggcggatgcgggcggccagatccggccgcgtggcccgcgcttccgcccaggcgagcggtttggatgccccctgcatggtctgagccccttcgaccagaatatgctggtcgaccacgccatcgagttccgcgatgcgatgcgccagcatgacgaattcgccgtcgaacaggaagcagtcatagatgcggcgcatcggccatccttcggaacacggcagggccggcccgtcatccgggccgacccattcttagccgatgatccggcgggtgatcaatgcgccagcgtcggtgccgctgccggagcgcctgcatggccatgccggcgcagtgcgaagacggcagccgaggcgagcagggccggcaccacggcggccatcaccacccattcggtgctccagcccgcgccgatcagcaggccgccggccaccgggccgatgatcgagccgatccggccgacccccagcgcccagccgacaccggtggagcggatcgcagtcgggtagacgccggccgtcagcgcattcatgccgatctgcgcgccgaccacgccatagcccgccaggaaggtggccggcatcaggatccagagatccgaggcaccgagtgccaccagcgcgatgaagccggccgaggcggcataggccgaacccagcaccagatgcgggttcagccggtcgatcatccgaccaagggtgatggcgccgaccacgccgccgaaattcaggatcgcggtcgacagaatggcgatctggagcggcagcccggcgccgcgcagcagcgaaggcagccagttcaccaggaaatacatcaccagcaggttcatgaagaaggcgacccagagcagcagggtcacccgggcgcgaccgtcttcgaacagcttgcggaccggaaagcccatggccttcggctcgttcagcacatagctccgggggccgccggccgcgatcgcggggtcgagccggcgcatgatccggtcgatcttttcggccggcgccccgcgcgcaaccagatagcgcaccgattccggcagcatcacgatcagcagcaccagcaccaccagcggcgcgatgccgcccaggatgaacaccgaatgccagccgaaggcggcgatcatcggcgccgagagcacgccgccgatggtggagcccagcggaaagccgcagaacatcaccgtcaccagcgtggcgcgcagccgcgccggggcatattccgaggtcagcgcgatgatgttgggcatcgccccgcccaggcccagaccggtcaggaagcgatagagcagcagctcgttcatcgtgccggcccaggcagtgatcagcgagaacacgccgaaaatcgccatcgagaccaggatcacgctcttgcgcccgaagcggtcggccgcagggctgagtacgaaggcgccgacggtcagaccggcgaggccggcgccgaagatcggcccgaaactggccatgctcatctgccagtcttcggcgatgaccggtgcgacataggcgatcgcctgggtgtcgaaaccgtcgagtagtgcgattagcgcacaaagtgccgtgattgcgaactggaacctgccgaaccgcgcgcgttcgatcactgcggtcacgtctatggtctctggccgggacatagccccctcctcccatgtctacccacgtcttctgtcatatcgcccgattccgcggcgccctggccggcgccgcgcccggatcttcgccgtcaatctcatcttcgcctttgatgtcaggcgtttgtgaccgcctcgcggtaaaggccgagcttttcctgcgcggcccggtcggagtagccgaacagcaccagccggctgtccgccctgatcgtcacctcgcgccaggacggcacgaccagcaggtcgcgttccgccagcgtgaagacctcgtcgcctaccttcgcctcgccccttccttcgaccaccacatagatcgtgccgtcggacgaccgccgcggcctggtctcgaaccccgccggcagcagccggacatgggcggcgatggtcggcatcaccggcccgccggtggcggggttcaggaattcgagcgcatggcccagcaccggatccggcgcctcggccgccgccagatcggcgagcgccgccgaccactcggcataagggtagtgaaacagcggctgtgccgccggccggcgatcggcggtgctgccgcgcagcggccgaagattgcggccatagcggcgcgtgctgtcgcccggcgccacggtctcgggatgttccgcagcctccagccgctccgcgaaactggcgtcgaaatggcgcacggtcgggatgtcgagcccgtccagccagatcatcggctggccggaatgattgccgtggtcatgccactgccagttcggcgtcagcaccagatcgaagggccgcatcaccgccttttcgccatcgaccgcggtataggcgccatcgccttccatcacgaaacgcagcgccgactggctgtggcgatgacagggcgccacctcccccggcaggatcagctgcaacccggcatacaggctgggggtgatgccggacgatcccggcaggcccggattctccaggatcagcacccggcgttcggcctgttcggcgctgatcagatcccccgcccgcaacagatgatcgcgggccgaggcataatcccacttccacgcctgcgcgggtgagcgcggcgtgggcgtcaccagcgccgacagcacttcccacaagggatacaggctcttgggccgcatctcctcgtaaagccggtccagctgggcgcgggcgtcattgggcaggggagcggtcatcggatcagccctcctcgaccatcacatgcagcacgccgtcttccacccgcaccggataggtgcggatggcttcggtgcagggggcgccacacggcgcgcccgtgcgcacatcgaacaatccctgatgcagcggacattcgatcatgtgcccgtccagatagccgtcggacaggaaggcgcggccatgggtgcagagatcgtcggtggcgaagaattcaccctcgacctcgtagaaggcgatgcggcgcccggccgcttcggcgcaggccacgccctcatcggcgagacgcgcggtctcgatggtcttgatccagctcattctggctcgtccttgcttacgccggataaatcaggctgttcgggatcatctcgctgtcgatcaccacgatccgctcggcgaagtacagccggccgtcctcctcgacgatccggtcgtggcagaccgccgaaaggacgatttccgactgtctgtcgatcagcgtctgcacgatcagcagattgtggcgggtgcggatgccctcgggcccggcgctgatccggagcggcccggggaagcggcggtaatagcgcggcgcatacatctgggtggtggtcagccctgtcacccggtcctgcagcataccgcggctttccgcctgcatggtcgacagcgtgtagccccgctcgaaattctcccgcgggatcacccggtagaggcaatcggccatgaagaagtcgggccagtccgtcagccgcacatcgtccagcgtgtcgtaataggcgtcgtagaggtcgcggacccggccgcgcagggcgatatcggtctcagcagtcctgatcatcgcggtcacagccccatcacctcccgccagtagcgatacatcgaccggatcgcggtttcggtgaccatgtaatcggtcggcgcaatctcgcggccgcccatcatcaccagcgcctcttccatgtccgagggcgtgaagccctgctggctcatctcgatgatctcgccgtcatcggccgagacgaagccggccgggccgaacagattggcctggcgcgtgcggcgcagcttcatttccggcgtatcgtcggcatagcaccaatgggtccagtggaaatcgaacccggccggccccttgggcacgatctggcgcgaggtcagcgaattgacctgctgctgcaggatcacgctcgggaagacggtgatcatgccgaccgtgtcctcgcccgggaattccttcacgacatccaggatgcgcggatcggccagtttcagatcgccctggaaattgcgcagatccgcggtgacgtcgttcacctcctgctcgcccttgcggctgatcaggatgccgtgacggccggtctcgtcgatatcgaccgcggatttctgatcggcgcggaacaggccgaaggtgacgaagaatacatgcagcagacccgcatggtacgggtccttgatgttttccatcatcagcttccagttcgccggaatgtgctggcggttatagcccagcacctccagcttccggccgtcatagacccgggtgtaatgggcccagaacttctcgcccagatactcccggaagggcggggtgtcgtcggaaaaggtcgcccagaccacgccgttcaccacttcgacgcgcagccggttcaggccgtgattgccggggtcgaaatcccgcggcatgccgccctggcgcttcacgccgcggcggaagggcacgccgatcagattgcccctcaggtcataggcccattggtgataggggcagagcagatccttggtatggccctggcgcgcctggcagaactttacgccgcgatgcgcacaacggttctccaccacgctgatctcgtcttcggcagagcgcaccacgatcaccgggcgttcgcccagcgtggtggtcttgaaatcgccgacatcggggatctcgcattccagcgcgcaatagagccagtgcggcccgtaccagatgcgctgaagctcccgctgatagacgtcctgatcggtatagacccagtacggcaccttgccggcatcgccggtgtcccacacgcggccgttccgggcgcaagcgttggtctccgccattcccgcctcccttgggcggcgccccctcgtcccgggttgccgcctgttgtattgcatatcgtgtgagacttagtatgatatgcaacaacgcgacgtcaagacggttcgtcgaaaatggaatgccggccatgccggatcgtcatgaaccggcaccgtccttcagggagttgaatggaatgagcgcaggcgtggtcatcatcggcgccggccaggccggcggccgggcggcactgacgctcagggagaagggctatgccgggccggtgacgctgatcggcgatgaaccggtcccgccttacgagcgcccgcccctgtcgaaagacatgctgatcgacccggagacccgccccacctggctggtgccggcggaggcctgggcggcgcaggatatccggctgatgaccggccgggcggcgatggcggtcgatcgtgccgcgcggcaggtgcggctggatgacggcagcctgctcgactatgaccggctgatcttcgcaaccggcagccggccgcgccgtctgcccttccgggtctcgcgcctggccgatctgcgcacgctgggtgacgtcgaatcgctcgcggcccgcgccgtcggcgcccgatccgttctcgtgatcggcggcggggtgatcgggctggaggtcgcggcgaccctggtgcagaaggggctggaggtgacggtggtcgagatcggctcgcgccttctcggccgcaactttccggcaccggtggcggcggccctggcccggcgccatgcggccgaaggcgtcaccctgctgaccggccgccggatccgggatctggccgacacggccgcgggcatccgcgccgtgctgtccgacgggcaggtgatcaccgccgatttcgccgtcgccggcatcggcgtcgtccccgaaaccggcctcgcccaggcggccggactggtggtcgatgacggcatcgtggtcgatcaggacatgcgcacggccgatcccgcggtgttcgcgatcggcgatgtggcggcacagccggggccggatggccggtccctgcgctgcgaaacctggcagaatgccaacatcaccgccgaacgcgcggtggcggcgattctgggcagccctttgcccgcccccgaaacgccctggttctggaccgatcaatacgatctgaacgtccagctcgccggcgtcaccgggcccgaggccgacactgcgcggatcgtcgaacagcgggccggcgccggccggctgttcctggtgctggacggcgaccggctgatcggggcggcgggcatcaatgccggccgcgacatggccgcctgccggcggctgatcaccgccggcattcacctgccgcccgggatgaccgcgtccgacagcttcgatgcaaaggcggcgcgcggcctgctcagcccggctgcggccagcgcccgcccagcctatgcgtaacctcgcgcgcggccgcaatcagcatgtcgcgggcggcggtatcgccgtcgcggccgaaattcggcgaggcgatgatcgacagggccagcaccagctggccctgaagattgaacaccggcgccgcgaaggcccgcagccccggcgcggtggtgccgtccaccgcggccgacagctcacgccttgtctgcgcccgcatcgcatcgatgtcgaccggcccttcggagcggtcgcgcgccagttcgcgctgcagcaggtcggacacgaacccctcgttcaggaaggcgaggaagatccggccggtggcagattgggtgagcgagagatgcgagccgatggtgagcatggtgtagaccggcggattgccggggtaccagcggatgatggtcgggccggtttcggcccagaccgcaatcagcacggtgcggccgctggcggccaccagctcctgcgccgcccggctcgcctcttcgaacatgtcgagccggcccatggcggccagcccgaggcgcagcgcgccggtgtgcagatcatacagcgccgtcgccgggtcctggcgcaggaagccggtgttcacgaaactcgccagatagcgatgagcctgactgaccgactggccgctggcccgggagatatcagtcaaagagctgggccgccccagccggaccagggcatcgagcacgcccatgccgatttcgaccgactggatgcccttgcgcttggtgtcgccgccggcacctcgtctgccgccggacctggctcccgcctgcttcgcctccatcgcccgcccgttctcctgctgacggctgccgcctgatgcagcgcaccatagcccccgcgccccggccgggcaacggggcccagcgacatccggagttgcatcttgaaggtctacggctatttccgctcctccgcctcgtaccggctgcgcatcgccctcaacctgaaggggctggcgccggatcaggccttcgtgcatctgcgccggggcgagcagcgcgcccccgattatctggcgctcaatcccgaaggtctggtgccggccctcgtcaccgatgacggccaggtgctgacccagtcactcgcgatcatcgaatggctggacgagcgtttccccctgccccggctgctgcccgaagatgccgacggtcgcgccagggtgcgcgcgatcgcgctcgccatcgcctgcgacatccacccgatcgacaatctgcgcgtgctgacctatctccgcgaccggctggggttggaccaggccgcgcgcgacgcctggtatggccattgggtcgccgaggggctgacggcgctggaagcgcgcctcgcccgcgatcccgcaaccggccgcttctgccatggcgatgcgccgtcgctcgccgatatctgcctggtgccgcaactggccaatgccgcccgcatgggctgcccgctcgacgcttacccgacgctgacccgcatcgcagacgccgccggcaccctccccgccttcgccgctgcggcgccggggcggcagccggatgcggaatgaggcgtgacggcccgaacagaccaccccacgtcaaggacaccccgatgaccacctgcctcttcgaccccgcccccaccccgctcgccgacgtcaaaggcaccgaggcgcgctatcccgtccgccggatcttctgcgtcggccgcaattatgaagcccatgcccgcgagatgggcgtggtggtcgatcgcgaggcgccgttctatttcaccaaatccgcgctcgcttacgtgccgtcgggatccaccatcccctacccgcccggcacggagaattatcattacgaaatggagctggtggtggcgatcggcaaagccggcttcgagatcgcgcccgatgacgccctttcccatgtcttcggctatgcctgcggcctggacatgacccggcgcgacctgcagctggcggcgcgcgcgaaacagcggccctgggatctgggcaaggatttcgagcagtcggccgtgctgtcgccgatcgtgccggtggccgaaagcggccatccgaccgggggcctgctggaactgcgcgtcgacggcgagacccgccagtcaaccgatctgtcgctgctggtctggtcggtggccgagctgatcgcccatctgtcgcgcttctaccatctggagcccggcgatctgatctataccggcacgcccgaaggcgtcggcccggtggtggccggccagaccatcgaaggctcgatcgaaggcctgggcggcatttcgctgaccatcgcctgatcgcccgggttgagggcgagcggtcgcacgagcggggtggcacagggcttgccacccccctgccctggctggcttaccggccgtagatgacatgtcatgcacctcgccgcagcaacgctgcgagtctttctttgtctaaggacgataatgttgccgcaagctgccgcatcggccgggcttgacggttgccggtgattttcagccagatctttcaagattgcgcaatctggatgaaaagccggatcagccgccgcgcacgaagcggtcgcgggtttcgcggaagcgccggaccaggaaatcgcggcagaccgcgatccgcgccagatgatgcgtgtccggatgggtcagcaggtgatagcgacggcggaaggtcagcccgggcaggatcggcaccagatcgggggcgtcgcgcaccgcgaaatcatgcaggatgccgatgcccaccccggcgcggatcgcctccatctgcccgaccacgccggcgcagcggaactcgcgtggccccaactcccgcgatccatactcgcgtgatccataccgtgtcagggcccggccgtaatccagcgacgaggcataggcgtaatcctccacccccgtcaccaccacatggccggccagatcctcgggcgtctccggcacgccggcacgttccagataggaccgggcggcatagacgcccagcgtatagtcgccgagggcggtcaccagcagccgcccctcggccggcgggtcaaggcagacggccagatccgcctcgcgtttcgacagcgagaaggtgcggggcagcggtaccagctcaatcaccagatccggatgcatggcccccagccggccgagttcggcggccaggaaccaggtgccgagcccgtcgggcgcccccacccgcaccacgcccgacggcgcggcaccctgggcgcgagtctcttcggcgatgccgaaaatctcggtctcgacccgctccgccgccgccagaagccgctctccggcctcggtgagcgtcgcgcccgagggccggcgctcgaacaatggctggccgagcgaggcttcgagcgcatcgagcctgcgggcgacggtcgcatggttcagccccagcccccgcgccgcggccagaatctggccgcgccgggcgatggcgaggaagacgcggagatggtcccagttcattggatgcggaaactccgtcaggatcaggcttcaaatatcgcacaacagcttctcgatatctccggtttctgtgcaccggatcatccaccatcatcaccccatcagagggggccggccccccggacggcgtcatccatgcgaaggtgagcggagatggtcaggaagatcgggcattacatcggcggccggcaggtgccgggtgcggcggcgcggaccgtggcatcgttcaacccggcgaccggtgagcagagcggcgaggtggcgctggcctccgcagccgaagtgcgcgccgcggtcgaggccgcgaaggcggccgcccccgactgggccgagaccacgccgctgcgccgggcgcggatcctgaaccgcttcctgcacatcctggaagagcgcatcgacgagctggccgccgtgatcaccgccgagcacggcaaggtgctctcggatgccaagggcgagatccagcgcggcatggaggtggtcgaattcgcgaccgcagccccccagctgctgaagagcgagatgaccgagaatgtcggcacgaaggtcgacagccatgcgctgcgccagccgctgggcgtcgtggccggcatcacgccgttcaacttcccggccatggtgccgatgtggatgttcccggtggcgctggcctgcggcaacaccttcatcctgaagccgtcggagcgcgacccctcggcggcgctgctgctggccgaatggctgaccgaggcggggctgccggccggcgtgttcaacgtcgtccagggcgacaaggaagccgtcgacgccatcctgaccgatccggatatcgaggcggtgagcttcgtgggctccacccccatcgcccgctacatctaccagaccgccaccgccgccggtaagcgctgccaggcgctgggcggcgccaagaaccacatgatcgtcatgcccgatgccgatatggaccaggcggtcgatgcgctgatgggggccgcctatggctcggccggcgagcgctgcatggcgatttcggtggccgtgccggtgggcgaggccacggccgatgcgctggtcgaaaagctggtgccgcgcatccaggcgctgaaggtcggccccggcaccgatcccgaggccgagatgggcccgctggtcacccgcgcccatcgcgacaaggtggaaaactacatcgatcagggcgtcgccgaaggcgccgagctggtggtcgacggccgcaatctgcgcctgcagggctatgaggacggctatttcaccggcgccaccctgttcgaccgcgtcaccaccgacatgacgatctacaaggaagaaatttttggcccggtgctgtcggtggtccgtgccgaaagctacgagcaggcggcgggctggatcaacgcccatgaatacggcaacggcaccgcgatcttcacccgcgacggcgatgcggcgcgtgaattcgcccaccggatcaaggtcggcatggtcggcgtgaacgtgccgatcccggtgccgatggcgttccattccttcggcggctggaaggcgtcgctgttcggcgaccaccacatgcacggccccgaaggcgtgcgcttctacacccgcctcaagaccatcaccacccgctggccgaccggcatccgcgccggcgccgaattcgccatgccgaccatgaagtaaccgcggcacggcacatccgaccccgggcagcgaccgcacccccccgcacctccccccttgcggtccgcccggaccggaacggcccccggctcccgaccgggggccgttcttcgtttcgcggcgggatcccctgcatcgggcacccgtacggacactggagttaccacttgtttttatgaccggaccgccgatttttcgcataacctactgataaatattattttatagggaacgctccgcggcggttatgtaggtactggaaacgtgactcatatcgtttgcgtttcttatgactcacgccttaccattaatggtaggagcggacatcatccggatcgcgatatgagggcaagatcactcgcaacacgcgcgcgccgctggcagtcgctcctgacgggtgaccggccggcaaagcgcgtgttcctgatcgtgaccctggccacgctggccttcgaaagcggccggatcttcaatttcaacttcgccgaggaaacctggagcacgtccacggcgatcgcggtcggaatatgggcgccctggtacgacatgcgtttccccgctgcccgacaggcggcagagcgcatcggcatcgtcatgatcgatgacgacggacttccctttatcggcgacaggttcccgatcccctatgaccgccaggcccggatgatcagcgagatcatccgcccctccggcgcgccggacaccccgccggtcgccgtgttcatggacttcctctacgcaaccaaccgccacacactgagtggcggccggcgaccctccatgccggtccaggccgtggatctgcagacgctcggcgcagacatggattatctggccgaagaactggcgctcaaccgccgtgacgggcagatcgataccgatgtcgccgatgcgatgggcgcacttttaccgccgctgcttgtgcggcgggccggtatgctggttgccgaccagcctgtcgccctgcgccaggccacccgtccgcaagaggcgcgcaaccccgaacggcgcaataccttcggcatcgtcaatcagctggcggtgcccgctgcgccgggaatgttcctcacgccgccgctgcgctatgcgctggcgccggacggccttccctcgccggccctgctgctgacgatctggagctgcgccgtcgaggcgggcctgccgggctgctcgctcgacgaaccggtggtgagcctgtccgagatacgggaggctgcacgggcggccgccatcgccgatgtgaccggcgcctgtgccgatcgtatcgatgcggaactgcggaccgcgagccttactggagacaacagccatcgccgcaggccgcctccgacggcagatcccgacatcgtcgacaggctgacaattcattgccgcgatattgcctatgaccatgcggcgaatgccggctggatccccgatccaccggcatcgacggcgattgcccgcaccaccatggccctgctgccggcctatgccgcggcccgccgtgacggccgctttgccggcagcttcgaggccctgacatgtctcgacgggctggtcccccgcccggcaggcggagacatagtgccacaaccacccgttgcaaacgtcaccctggcccgcctgcgccaggcatcggccgactgtcacggcctgtcggatgccatggccgaccagcggatcggaccgacgatgaccgtgctctggggggccggcacagatgacggcggcccgccccgtgatgcgacgccggcagaccggctggccttccgccagagcggtcaggccgcagcaccctatgcctgggccgaggtggatcatcatccggtcgaggatgtctgcgcccccttccggctgtcgcgggacatcctgtcccgcctgtcggagtcgagccgacttctcgcctttaccctgtatcagggggaaaacacacatcaggatctttgcgcctatcaccggaccgtccgcgtgccctggctttcttccacccatgaccggacccgggcctatgtcgcctcggccctgtcgaaccgggtggtgatcctgggggcgacggtcagtggagccgaagatctccatccgatgcgcggggtctatgcccccggcgcctgggcccatgccatggccctcgacaacctgctcgccatggggcgcgactaccgtccgggcgccctcgacggcatcggtttcagcgccgggacaggctatgaagctgcccgcctgatgcttcagaccctgctggccggcctgatcgctcttggtctgcacaacatcgtccgcccctggcagatcgaggccctggtgcatcgcaacctgcccggctggatcgcccccaccctgcccgcggtgctggtcgatgtcgtggtcgccggcttcgccaccagcatccccagcctgctcgtcgccctgatcctgctcaccctgctgccgatccagccgctggactggatcgccgtcgccgccttcgccgccaccgcctggatcgcggccggcgacggctccacaaacccctcttcatcacgctgacagggagaatgcccatgtcgctcatcgcatatgcacccgcccgtcatgtcgtcatcggcccgcgcgtcaccgccgcactgaccgtcaccgccgcactggccgcggccgccttgctgatcatccccacccctgctgccgcccaggcctgcccgggcaacggcacagacatccgggtggtgagtgtgtcgggcaacatcgatccggcccttgtcggcaggtcgggcaaggaagtgtcgctgaaagaggtctgtatcgacggggtcaactactcccgccgcttcgttcgggtcgaacgggtgcagacggacgtcgtctcgaaggtctgcggtgccacgctggcgcagaacggcgcaccacggacgggttccaacctcggcaacggctgctgaaccccggaaagggcaggaccgatgacacgcatccgacgtcctcttctggccctgagcggcagcgccctgcttctcaccggctgcgtgaccggcggcatcccggtcccgggcctgtccgacgacagcatcgccgggatgaaagcgccgttgatcgcaagcgcgcagttcgatgccaccctgcccagcagcgccggcgatccgcgcccccctcgcaccctctatttttcaggggcggccgacgacgtcggcaccaattactggcgccaggaacgggacaaggtgccgatccccgaagcatcgcgcgtcatcccggatgcgaagatccaggcatatctccgcggcattctgctgcggcttctggccgtcgccccgcccggggccccggatgtgcaggtccacctcctggccagttcaggctatcaggccatggcgcggcccgacggcgacatctatgtcagcatcaacgtcctcgcccaggctgggtcggaggacgaagtggccatgatgctcggccacgaactgggccatctgctgctccggcatcacgacaaggacaagctgttcaaggaacagcgtgacgccaccaccatggcggccggcgccttcgttctcggcaccgtgctgaaaagccagatggacgccggaggtggcaacctggccggcaaccagaaggcggggctgcaacaggacgccaacacggtgatggcgaccaaattcgcactcgatttcatcggcaaggatgtcgtcggtgccgcctggaaccgccagcaggaaaacgaggccgacctgctcggcatcgatctcatctcccgcgccggctatgctccgctcgtcgcacaatacgggctggagaagatcgtcgcgggcgagaaggcgcgcggcaccatgaccgagcgcctgcagaaactctcggacgaacgcacgaagcgggtcgaggcagagatgcaggccgcctggtcgtccggcaatatgaccgtcacaccggtggtcggtgccatgctggatgccggcacggatgtcgggcgggaaatcgtcgatgccgtttccggccgctatgcctccggtgaggaacgcctgcaacgcagctgggactataatgacaaattttatgccgacgcgccgggggcgccgcatgaaggatatgaagagatcaagacgtcgctcggtatcaaagacatgaacaacgcctatgccggggtcatcgaggccctgttcgcgctgcccgaaaacagatacgacgacgctgaggcccggttgaaggcgggctatggcattgaccggatcggcgatcatcccctgccgcggatggtcgaggcgctgatccatcagggcctgggccgggatgctgccgctcttcaggcactgcagcagatcgaccccgacctgccgatgccgatcgaaggctataccatgaaggcgacgctcgaagcttcgaaacccgccggcatgaacaggtggcaggcgatcaccgcggccccgtccaagggcaaggcgaagtcgaaaccgcagcctgccggcaatccactcgtcacgctggaaaccgcccaggcgatctatggtctcgaagcggtccagccgaccagaatcgccgtcctcgcccggatgggcgacaaggcccaggcgcgcgccgcctatgacgcctgtcagaatctgtcggagatcacccggaagcagtgcagcaccacggccgtcgccgtccaggtcgccgaggcggaacagccggtcatcccccttcccgacgtcaacgccacccctgccgaaccaaagagcccgagcctgcgcagcctgctgggcttcggtggctgaatgacgcccggacggatccgcgcatcgggggcgcggcggttggccatcgccgcactgctcctggccgcaggcttcacggccaccgcccgggcggaagaccccgcctacatcaccatcgcaaccgcggcgcccgacggcgcctatcaccgcctggggctcgacacctgccgcatgatcaatcgccgctgcgccggtcgcggattgcgctgcgtggtggagccgaccaacgggaccggcgacaatctgctgcacatcgcggccggccatgtcgatctcgccttcgcccagctggatggtgtggtgcgcgaccagccggacgccatcctggtgtcggaacgcggccggtgcaccacccatgccgacggcgacgcgcccggggacgaccgcgtcctgaccggcaccgaagaagcgctcttcatcctccggcgggccgaggcgggggaccgggcctctccggccgatctcgccggcctgcttcagatgccaggcacgctggtcagcctcggccccgccggctccggcacccgcaatctggccgaggcgttgctggcctatctcgggatcgacctgccggccggtcgcgaggtggcactgccggccgatctccagctccccgccctctgccgccaggatgtcgacatcatcttccggatgctcgctccggcacgcgccgccctcctgctcaatgcgccgcgggacagctgccggctgcaactgatcccggtccccgccgacgatccgccgggcgcaccaccactgacgcgtgcggtcggggtggagcggcgggtgatcacactctccgatctgcccgagggcgatatgacggtcatgaccgtcaccgcaccgatggtggtactggcctcaccaggcctctgcgcggcaggcgggggaaagcttccaccgctgctccgcaatgccctgttggcagccataaagcccgatcctttgcccgagaccacattgccggccgcaacgccggccggctgtgcggcaggaccataatttcacagtttttatacggtatataatactattattgactcattttatggactaaacatacttgatccatggccgccggacagggcggccatcgcggagtttgaagagcagcttgcgccgcgtcaccaaccgctaaagcgccacgatcgccggtcgtggcctcgcatcctcgtatcccgtcggagagagccccccatgatccagcgatcgcacaccgcgctccggtgtctcctgtcgatctcctgccggttgcaaccccgcaccggccactgtccctgcgggccgcgcgccttcgggtgatgcggcccgaccttttcccggacagcacagatcgtttcagacctgaatggagggccatccgccatgtctgccatcctgccgatcgaggttgccggcgaggcgaccggtttcgtcacgccggagccgcgcggcttccgtttccacgccgcctcgggccgctatcgcctgctcgacggctcgcgtttcccgtctcctgaaaccgcccgtgctgcagcccaaaggctgcgggcggcccaggacgaccggcgtcagcggtcgtgacgtcgcccgccgccggccccacggccgggggaggccggatcggcggcagaggcgacaggcggcggctgcggaaatccggcagccgccgccgtcttcgttcgggcaggtcagcctgcggcgggcagccggttttcgaccaggcgcaccagagccgttgcaaccattggaattagtcgatcatcgaaatcatagtttgggttgtggaccatgcagcccccctccccgccctggccgaagagcagataggcgccgggccgcttttgcagcatgaaggcgaaatcctcggccgccatcagcggcgggaaatcggggcggaaattcccgccatagagatccgccagcactgcggccgcgcgcgccgtttcggccgggtcgttgaccagcaccggatagccgcggcgatagtcgaccgccgcagtcaccccgcgcgccgccgccacgccggccacggtgcgggcaagcccggcctcgacgatcgcgcgcgcctcctcgtccaaggcccgcaccgtgccgcccagccagccctgatcggcgaccacgttgtgggtggtgccgacatggatctgggtgaccgacagcacggcggcactgttcgcgttcacctcgcgcgacaccaggccctgcaggctgcaggtcgcctcggccagcgccagcgccggatcgcgggtggtgtgcggcatgccggcatggccgccttgcccggtcatcgccaccttgaattcatcgaacgacgccatggccggccccggcctgacgctggcggtgccgagcggcagcagaggcatgttgtggaatccgaacaccgcgtctgtggggaagcggtcgaacagcccctcctcgaccatccgcgcgcccccgcccagcccctcttcggccggctggaagatcacggtcagcgtgccctgaaagctgcggctcgacgccagatgacgggctgccgccagcaggcaggtggtgtggccatcatggccacagccatggaacaggccgggatgacgcgacgcccagggccgctcgtccacgcccggaccctcgtccatgggcagggcgtccatatcggcgcgcagcccgatcgacccgcccgcaccggtgctgatccggccgaccacgccggtgccggcgatgcctgtggtcacctcgaacccggcttcggccagacggtcggccacgaaggccgccgtgcggtgttcctgaaagccgatttcgggatgtgcgtgcagatcgcgccgccatgcggtatgcgtctcgttcagatcggccaggtcgcggatgatctgcatggccaggggcgtcctccgttgcgggcatgggatatggtcaatatagtttactatcttccggcaagggacaagatgggaaagatggcaagcggacgggatggcgatcgtgaagagcgcgtggtgctgcgcggcgacgagttggagaggttccggcaggtgaatctgggccggctgctcgacgaggtgcatatgggcttcgaccgccgcgcgctgcactatctgcgcgagagcggctatccgatgctgaatgccgcccacacccatgtcctgcgcaccatgcgcttcgagggctcgacgatcaccgacatggcggcgcgtgccggcatctcgaaacaggcgatgagcaagctggtcgccgctttcgaagaacagggtttcgtggcgctcgcccccgatccggccgatgcccgcagccgcatcgtcacggtcaccgaagacggccgccggctgctgtcgctgggcatccaggccctgaaacgcgccgaggccgatatcgcccgggtgatcggtggcgaccgtctggaccagctgatcgaactgctggcagccgcgcgcgaggcgggctctcccgacgacgaggcgccggcatcggcataccggcgccgtcggagctgagccggatgttcccacgacggggcgctccgtcacgagatagtcaatattgttgacttcctttccgaccgcccgcagactggatctcacgagccggagagaaccggccgctctcctcgacagggaagatccatcatgcgccgatatgcatttgcaccgcgcagggcgacgcgcgccctgatttcgggcgcggccctggccgtgctgtccctgggcctgcccgccgcgggccccgccacggccgccacctttacctacggatcgggcgtgccggaacggtccagcgccaatcagcagggtgtcctgccgatcctggccgacatcacccgggcgaccgatgggcgggtggcgttcacgccgatcctgggcggacagctggtctcgatcgccaacggcttcgacggcatccgcgacggggtggtcgatgccggcttcttcatcggccagctgaccggcagccagctgccctattcctcgctgatcgccgagatgaccgggcttggcggcgacccctatgccacaatgggcgccatcaacgagattttcttcgtcggctgccagaactgccgcgacgaggtgaagatggccgggatcgtgccgatcctgatgcagtcggcctcgccgctcgccatgatgtgcacgaagccggcccaggccgccgccgatctcgccggccgccgggtcagcgtggtcggctcgcccgaggcgcgctgggccgcagcactcggcatgacgccggtacgtagcaacatcaccgacatcctgcccgccctgcagctgggccagagcgactgcaccctgctcggcctcgcctggatccgcagttacggccttcaggatacggtgaaatcagtgatcgagatgccccagggcatcatcgccggtgcggtgccgatcgccttcaaccgcaaatcctgggagaagatctcgaaagaagaccgggcggcgatcgtgaagctgatgccggcggcggtctggaactatgtcaccgaagcctacgtcgcccaggatgcccgggtgaaggcggcacttgccgacaaggtgaccttcagccccggcgacgaggcgatgaagacccgctggaccggctttcaggatggcgaggttgccgccctgaaggcactggcccgcgatcgcggcctcgccgacggcgatgccgtggtcgaccggatggtcgcgaccttccgcatctggcacgagcggctgctgcccaaattccagggcgaccgcgcggcgttcgagcagatcctgacggagcgcgtcttctccaaatatcctttctgaccttctgaccccgcccccccctggcggcgcatcggctccgtaccgtctcccctcctgacggtcgggccgcgcctgccggcgtccggatcctgcaccctggcggcgctgccggatcctcctccccccgtgcgacaggacctactggccaggtctccggcatccccctgccggcggcgcacggccggctgcgtccgatcgtgcgggatccggacgtcttttccgtctgacgcacaccctctgcccggagtcgcccgcaatgaaagccgtatatttcgacacccacggatccctcgatgccctcacctatggcgagattgccgatcccgtcccgcccgcaggctgggtgaaagtgaaggtcggtgcctgcgcgctcaattatctggatgtcttctcccggcgcggcatgccggggatcaaggtggaactgccgggcatcaccggcggcgactgcgccggcacggtggcggagacgggtgagggcgtcaccggctgggcgccgggcgaccgggtgctgatcaacccggccttcgtcgacgaccggagcggccatttcgagatgatgggcgaaacccggcgcggggcgatggccgaatactgcatctgccgcgccgatcagctgatccccgtgccgacccatgtctccgacgaggccgccgccgccctgccggtcgcctatggcaccgcctatcgcatgctgttcacccgcggcgggctgaaggcgggcgagaccatcctgatcctgggtgcctcgggcggtgtcggcaccgcctgcctgctgctggcgaagatggccggcgcccatgtcgtcgcggccgccggttcgcccgacaaatgccggcggctgaccgagcttggcgccgacgagaccatcgactattcggccgaggcgatcgacgcctatacccgcaagcgcaccggttctctgttccggggcggcggctgggatgtcgtggtcaatttcaccggcggcgacagctgggtgccgtcgctcagggccgtgaagcgcggcggccggctgctgacctgcggcgccacggccggcttcgaccccaggaccgacatccgcttcatcttcatggccgagatgtcgatcctgggatcgaccggtttcaccaaagacgacatcgccgcctgcctggatctggtcgcggaaggccgtctcgatccggtgatcgacaaggtgctgccgctgtccgagggccgcgagggcgtgcgcctgctggaagaccgcgaggtcttcggcaaggtgatcgtcaagccggggctggacgcatgaccgccgatgcccatggcggacggccgcgccatctgccgcccttccggagcctcgccgatgtcgaggcgctggaacgcgacccgatcgacagccatctgaccgggcgcaccatgaccggggtgctggcccatgccgcccggacccatggcgaccgcatcgccgcctgctatctggccgatcccgccgatccggaggggatggccgaggagatcggctttgccgcctttttcaggcgcgcgatgcaggcggccgtcctgttccgcagcctgggcctgacacggaccgaagcggtgggctgcctgctgccggccctgccccagacggtggaaatcggctggggcgccgcccatgccggccggatcatgccggtgaaccctttcctggaaccggcgatcatcggtgcgatgctgggccgggcaggcgccgccatcctgtgcatcgaaggcccgtcgggccgcgacggcacctgggagaagctgccggcaatcctggccgccgcaccggccatccgccatgtgctggtggtgggcgagccggccgccccggatggtgttctgcattacgagaccttgcgcgccgccgccgacccggccgaagccggccccgagccggcgccgggcgacatcgccgcctgtttccacaccggcggcaccaccggcctgcccaagatcgccccgctcacccattacaacctcgcctgcatgagcctgatcgccggttacggggccgggctccgggccggcgacacgctgaccaacggcatgccgctgttccatgtcggcgcgctggtgatgggggcgctggcccccttcgcccatggctgccgggtggtccagctgggaaggcgcggctatcgcgatccctcggtcatggccgggctctgggacatcttcggccgggtgcggcccgacatcgccatcggcccgccgacggtggtcgccgccgccacccagagcttcgccgccccccccggcgacacgggtctgcgggcctggatctcgtctgcctcctcgcttccggccgaggtgcaccggcgcttcaccgaccgcaccggcgtgccgatcaaggaagcctggggcctgaccgaggcgacgctggtgctgacctatatgccgcccgacggcgaaagccgcccgggctcggtggggctgcgcctgccctggtgcgaagttcgggtcgcgcgggtggcggacggccgggtggtggagctgctgcccgccgggactgccggtgcgatcatcgcccgctcgccctcggtgtttccgggctatctcgaccccgccgccaatcgcggcgttctactcgaagacggctggctcgacaccggcgatatgggggtgatggatgccgacggcttcctgaccatcaccggccgggccaaggatgtgatcatccggggcggccacaacatcgatccggccctgatcgaggaaccgctcaacgcccatcccgatgtggcgctgggtgccgcggtcggcctgcccgatgcccggctgggcgaggtgccggtcgccttcgtcaccctgaagcgtggcagcagccggagcggggccgacatcctggccgagctggccccgaccatcgccgaacgcgccgcgatcccgcgctggatcgaggtgctgcccgccctgccgatgaccgcggtgggcaaggtccacaagcccggcctgcgccgcgaagcctgccgccgtgccgcggccgcctgtctggggctcgatcccgaccggatcggtgcggaagacctgcccggcgggcgcattgccgtgatcctgcccttcgccgccggcagcgccgccttcgaccaggcagccgccacacttgccgggctcggcctcgacgcccggccctcccccgctcccgcgcctgaggaaccccgtccttgagcatcctcgacatcgaccatctgatgatcaagaccggcgacctcagcgctgccggcgaccggttcgccgaactcggcttcacggtcaccgcccgatcggagatgcccggcctcgccaaccggctgatctgcttcgacgcaatgatcccgggcgcctgcaactacatcgaaatcatgcagctgaccgatccggcgtcggcgccgccgccgatgccccgggtgctggatgcccccgacggcccggtctccaccgtcaccgccaccagcgatgccgatgcgaccgccgcccggctcaacgccgccggcatccgggtgccgccgccggtctcgatccgccgcgactggccgctcggcaccggcgaggtgatctcccccgccttccgggtcgccatcccgctgaccggccaggcgccgttctactggaatgcctgccagcatcacacgccacagcactacacccggccggaattcacccgccatgccaatcatgcccggcagatgatcggggtcgttgccgtggcccccgatcccgcggccgtggccgcggcctatcggcagccctgggcggcgcggatcgagggcgaggcccccgtccgggtgacggccggccccggccgggtcgcgctgcgcatccacacgcccgaccagctgatccgcgcctgtcccggcatgatggcgggggcggatgatcagcggctggccggcctggttttcgccaccgacgacatcgacgccgccttcgcccggatcgatgccaccgacgcccggccggtgcgcacggcgcccggccgcttccatgtcctgccgcaccaggccaatggctgcctgatgatcttcgaggggatggcatgaccgcgacacccgatcgcctgaacgacccgcccgcaccggccgcggcgccgctccatggtctgcgccgcctggtcgacggcgccggcatcgcgggcgggcttgccgtcgccctgatggcgctgcatgtggtgctggacgtggcggcccggaacctggccgggctgccgctgtcgggcaccaccgaattcgtcgccggctggtacatggtcgcggtggtgttctgtgcgctgggcagcgtccatgcccgcggcgaccatatccgggtcgatctgatcgacatgatcgccggcccacggctcgacggcctgctcaccctcttcaccagcctggtctttctggcagcggcggcggcgatgaccgtctggggcatcgatgatgcgctcgacgccaccctgaggggcgaaagggtggagttcgccacctgggcgctgccggtctggccgggccgctggctggtgccggcgggcttcgcgctgaccggtctcgtcgccctgctcgatctggggcgcggcctgcaccgcctgaccggtcgccgcccgccccggggagacgccgcatgagcccggtgcttcagggatgcctcaccctggccgcgatcctgctgctgatcggcctgcgcctgccggtcggcctggcgctgggtgtcgccgccttcatcggcaccgccgccctgctgccgctgccggccgcgatcagcgtcatggcgcgggtgccgtatgaattctcggccagctgggaattctcggccgtgccgctcttcctgctgatgggcaatgtcgcctggcgtgcgggcatgaccgacggcctgttccgcatggccgagcttggtctcgcgcggctgccgggcgggcttgcggttgcaaccaatttcgccgcagcgggcttcggcgccgcctcgggctccagcctcgccaccaccgtctccatgggccggatcgcgatccccgagatgctgagggccggctatcacccgtctctggcaacggcggtctgcgcctgtgccggcacgctcgccgccctgatcccgccttccatcccgctgatcgtctacggcattctggccgaacagtcggtcgcgaaactgttcttcgccggcatcgtgccgggcctgctcaccgccctcgcctatacggtgatgatcgtgctgcgctgccgcttcaacccggcgctcgccccccgggtcgaggtgaaggcggcccccggcgaatggcggcacctgctcaccacctcgtggccgctgccgctgctggcgctggtggtgctgggcggcatctatggcggctggttctcgcccatcgaggccggcggcatcggtgcgctggccagcatcgccttcgccgccctgcagggccggatggggccgcgccggctctggcaggtctgtctcgatgccgcccgcaccaccgccgcgatcctgttcatcgccatcggcgccttcatgctcacccgctacatgaccctgaccggcctgccggcggcggtggcgacgggggttgccgccctcgacctgccgccggtgctgatgatggcggcgatggcggtggtcttcctggtgctcggcatgttcctcgacccgttcggggtgatgctgatctcgatctctgtgctgctgccgctattcgaacgcatgggctacgacctgatctgggtcggcatcatcgtggtcaaatacatcgaaatcggcctgatgaccccgccggtcgggctcaacgtctttgcggtcaaatcgatcgcccccggcatcggcctgccgaccatcttccgcggcgcgctctggttcctgctcgccgaggcggtggtgatggtgctgctgctgggcttccccgacctcaccctctggctgcccgcgcagctgctctgaaggaagcgatccccgatgaccttcgacgatctgaaatccctggtcgcctcggccgaataccacaaattcctgaaggtggagccggtggaggccgatccggagaaaggcgtggtggtgctgaaactcgccttcgacccggcctatacgatcttcgcaaaggccggcaactatcatggcggcgtcaccgcggcactgatcgacgtggccggtgccatggcctgttcggtgatgaccggctatcccacgcccaccatcaacctccgggtcgactatatgcaggcgccgcgcagaaccggcctcaccgcccggggcgaggtccgccggatcggcaaggcgatcggcgtcgccgacgtcaccatcaccgatgatgcgggcgagatctgcgtcatcggccgcggcaccttctcgaccgtcgacccgcggccgaagctgatgacgcccgaggcctgatcacctcagacccctgaacaccccagccccctgaacacctcagacccccggcaggggcacgtagatcgtcaccagttccagcccgcccgtggcgccgaattgcagatgcaggatgtccgcgcccagatcatacgagatccagcgcggcacggtgcggcggagcgtgcggctgaacgtgccgccgccctggttgcggatgtcgccgagcgcggcgcggatcggtgcctcttcggcgccgaaggtgagaccagccggcaggctgcccgcgaaaccggccgaattctcatagccggggctgtagaaatggacggcctcgacatgcagcgtctcgccctcttcgccggtcacccagggggcggtcttgaacatgaccgccaccccgtggcgctgcaggcggatgaagccggtccagtccacccgctccagcccgtcgggggcgacgcgtatcagtgcctgcaccgccggatcgtcgaccgggcggcgcagcaggcggcgaaaggtttcggcgtcggtggacatcggcagacgggacccgcagggtgcaggggcacggaaccggccttgcggccggttccggcattatgcaccggatcgcccccggatcagaagcggagcgtcgccgaggcataaagcgtccggcccggccccggctggttcaccagccccagcgggtcgatgtaatagcggtcggtcaggttcatcaccgacaggctggtggtcaggttctcgttgatctcgatatccgcaaacagatccaccagggtatagggcttccagttcacctgagagatgaactgcgatgcgccctgggcggtgacgtcgccatggccgatcgcccggggtccgatgtgcgagacccggccgcccagcgtcagcatgtcgtcgaacagcagctgcgagagcgtcaggtcggccgaatattccggcggcacatgattggtggcatagtcgccatagagcgatttgtcgatgcagctgcccgaggtgcggcagaattcgacgttgagataatagttggcggcaaactcggcggtgaagccgccctggcgatagcggcccgagatttcgagaccctcgaacttcgcgcggtccagattgtagatgtgcatgctccagtaattttgctccgtgttgtgataccattcgcgggcgatgtaatcggtcacatcccaattgaagtagctgagcttgaccatggcatcgtcggcagggtcgatcacgccgcgcaggcgctggttgacgcccagctcccaattccgcgaccgttccggcgtgacgtcggggttgacgcccatggtgaaggccgatgcggtctcgatcaggctgggcgcccgcatcacgttggaataattgacatagagctgggtgccgtcgaagggctccaccgtcacgcccagcgacgggctgaagccgccatcgctgaagcgcgtgtcgtagtcatagccgcgttcaagatagggatcgttgcgatcctgggtccggaagtgcatgtagcgcaggccgccattcaccgtcagccagtcggtcgcctcccacgcggccttgacgaacccggccgcctcctcgcgcttcgcgtcgcgatagtccagccaggtttcggcctcgcgggtgccgtcgctcggccgcgtgtcctcgccgcgataggacaggccataggtgaaggtcgtatcgccgaagccggtcgccacccggctgatattggtgatctccgccccccacatatcggtgtcggaaccggcgcggaaatcgcccggcttcggcagctgccagccggtgcggagcgggttgcgcagttccagatgcgaccagtagagattggccttcaggtcgatcagcggttcgccctcgggcttccagcgatagttgaaggtgccggtatccagccaggtgccggcggtctggcccagctggaccgcctgcgagttctcgccggtcagccgcgaggcgatgcggtcgccggcctcgctgcggaatttggtatagcccagctgcaccgcatggccgtcgccgaagcgcagcccggccttgcccagccacgagctggtttcaagctcggtgttcagcacctcttcgcccgcgcggtaattggcgatgccgtcattctggtagcgggcatcgacttgggcgcagctgccccagctggtgcagtattcgcccggccccagattggtgacggtggccgccgggccatggctgccggcatggtaattgccttgtttgcgataggcataggcggcgagcagatcgatatcggcatcgcgataggcggcgaccgcgctgcccgacccgctggtcggctccgcccagccgggccggtcgaggccggtggggctggcggtcggtgccgccggcgaattcgacggccaggcatagcccgatgtatcacccgccttgggcgacgaggtgttggtgccgaatccgcccttcagccggacgccgaaatcctcaccctcctgcacgatgtcccgggccgagagcgtgcgcatcgccaccgtgcccgccgtgccgaaggacgacacgtcggagcccttggtgatgtccacctcggccagcaggtcgggatcgacgaaggtgcggttcgacgcgccctgatagccctgatagacggtcaccagattctcggccccgtcgatcgtggtcgccacccggcccatgccctgcatgccccggatgttgacgtcgaccgatccggcgccgttgcgcgcctcgcccgacatcacgccgggcacgccgcggaagatgtcggcggggctgctgccgcggaagcgctggatggtttcgcccgaaatatgcgccaccggcgccgccgtctcatagggtttgtcggttgcaggtatggcgcttgtcaccaccagcggctgcaactgtcgggcatctccggtctccggtgccggctggatgatcaccgcctcgccgctgaaccgccaggtgagccccgtgcccgccagcagccgggccagcgccatatcgtcggtatagcggccggcgagcccggcggtggaccggccgcgcagcagttcgccatcggccaccacctgccggccggtcacctcggaaaaccgcaccagcgccccggccagcggctgggccgcgatctcataggcccgcaccgcggccacctcggccgccaccggtgccggcgccaccggcagcatcgccccggtcatgagaaacaccagcgtcgcggcgccccatcccgccccgtgagcccgtcctgtgccgtgccctcgtctcgtcatgtgatccggcattcccggccgtccttccctgtcggtcatgtcccacgatcggccgcctgcgcgcggccctcatgatccagacaccccaggggcgaggggttatgatccggcctgtgcttttttttgcgggacagcggctttttttcagcccgcccgtgtgaccagggcgaggcccgccaggcggcggatcctgagatccagcgtctcggccaggatgtcgagcgcctgatcgggccgggtcaggtcgaagacggcggtcaccttcagacctgcgacccggtcgccgccgagcaggatccggcccgggcggtagcggtccaggtcctcgaccaccgccgccagcgtctcgtcctcgaaaacgatccggtcgcggcgccaggccagcacctcctgcgcgcggcaggggcggggcgctccggcggcacgatcgtcgaaggccgatcggtggcccgccgccagatcgaccggcgccccggcggcgggatgcaggcgaagcccgccctccagcgccgccgcgatggtcacgccgccgcggcgcttcacgtcgaacgcggcgcccgcggtggcggtcatcagcccctggccggtgcgcagcacgaaggggcgcggatcggccgccgggcgaaaccaggcctcgcccgcctccagcgtgaccagccgccggctgccgtcgagccgggtggacagggccgagcgcccgcccagctccacccggctgccatcggcaagcaccagctggcggcgttcgccggtgccggtcgtctcgtcggccagcagccggccgggggccaccagctgcgatgcggccgcacccgccatcagcgccacgccaccggtcagcaccgcccgccggccgacccgccgccgtgtctgcatccgctgccaggcgggtttcaccgcaccgaaccggtcccacagctcttccgcccgggcataggcggcaacgcgcccctcgccgccggccagccagcgggcgaaggcggcacgatcctctgccgccaccggttcctcgttcagcagcaggaaccagcgcatcgccgcggcgcggtcatcctcgtcgatcatggccgccatcagccgagcgcccgatccagatcggccatggccgaggcgatctgcgagatcaccgtgttgcgcgagatgcccatgcgcccggcgatctgggcgtagctcaaccccgccagccggctgagcacgaagacctgccgccgccgccggggcagggcctcgatcgccttcagcagccgccgcagctccgcccggtggatcacggtgtcttccgggctcgcgaccggcgccggaatcgcggccatcgccgcatcgtccagcgccacctcgccatggcgtttcgcattgcgcagatggttgagggtcagattgcgcaccgccgcggtgatataggcctggctcaccggcggcggctcggcatggctgctgcggcccagcaggttgacgaaggcctgctgcacgagatcctcggccgtgaccggatcgcccagaatccgccgcgcgatcgcccgcagacgatcgcgttcatggccatacagcctggatatggagagtgcgcgcgtcgccacccctccccgcctccctgatcggtgatctgcggtggatgatgctggcggctggctgacggcagtctaacgggcggcgcagattatgacaatgcgtctcattctcatattgtcacgaagaagagggcgcccggttgtccgaggcgcccttttccggcagcgggtaccggccgggatcagggcggcggcagggacacggtcgccccgtcaaggaacgggccggctgccccttgcgcctcattgagattgagccggatgacctcaggctcgatccagctttcccggccatccggccggtcgccggcgatgtcgtgatcgatcatatgatccgtcctttcctctgacagagttcgtcgcgtgtatcgtcaatatctgcgcgatgcagatctctgacggccatcatgtcacgaccagcccggccgcgaccagatcgcccagcaccttctccacggccgcaaggctggtcgcctcgtcgaccgcgaagcgggcacgaagtcttgccgccagatcgcggccgctcttcggggtttcgagcccgtcccagacggccgccgcactgcggttgaggcccagaatatcgccggtctcggggttcatcagcacgacatcgccattgagcggcgttgccatcacgccgggggcgcgggtgtacacgcggtcgggatcgatggtggccggactggtcaaaggggtctggctggtcatgaggtcggaacatcctcggaaacggcagggacggcggcggcgagatgctggcggatagtcgccaccaccgccggcagggcgtcgaagcgacggggatagtgcaggcgatggaccggcacgcgctgcaccagccgcagaaccgcggcctggatcgccggttcccggccgagcggccccatcacccagccgccatagagattgccaagcaccagcttcagcgcggcaaggccggacagccgctcgatccggatgccgggcgtctctgcggtcgccgccagcccgaagatgccgcggagcggcagcaggcggtcggccgccgcggtcggcaccagatcgtcgaaccggaacttgtcgacaccggcggcgacggggcgctccccccgccccgcccaggccagccctgctaccgagctgtcccagagcctgagttcgcgttgcagggatcgcacgcgggtctcccccgccacctcctgcagatggcagacgtcatcggccaccagttccgtgccggcatcggtgaaggcggcggccagcgtcgacttgccggcgccggaatcgccacagaaggcagccaccccgtcgcccagcaccagcccgctggcatgcagcggcaacaggccgttgcagaaggagagatgcgtatacaccgccacccgcatcatgtgatcgacatgctccggcgcgtcgggggcaagcacgacctcgcggcccgccacgatcatcaaccggccgagcccgggcaggatctggatgtaatgcgtggcatcgatccgggaatgcgggcccgtgaacagcggcgccggcagatcttcgggcacgggcccgaggcggatggtcgccaccggatcgcccgcctcgggtccggccggctccagcccgccgagcggcacggcgctcgccagcaccaggcccagcatccggtagcgatagggcagatcattccccgccatcatcaatcacccgcctttgccgcatcctcgcggccggtctggttgctgcccgaaaaccgtcgggcgaagcggccgacattcaacgcctgggtcagggtcacctgcagggcgatcatcatctcgcggctctcgtccggaccgtcgatctctgcggccagcaccttcagccgctcgatatcgaacaggccggcggtgtcggggcaggcggcgagcgcatcgatctcgcgcaggatctcgtcccgcgccgccgacatctgacggcgccaggtcactgcctgggcgccctgccgccggttctccaccaccgccggcggcaacaggccggccatggccctgcggatcagcccgcgcggcgtgccgccggccagaaaggcttcgggcggcaagccccagcagtattccgccacccgccggtcggcggtgggatcgcgcagcgacagcccgcagctcgcctcgtaataaaacgtgagaaaggcgaggtcgttattggcgaaggccgcgacccgccgtccgccatcggccagccgatcggcaccgggccagcgccacacggccgctttcgccagaccatcgagcccgccatccggcagggcctcgggccgcaatgccgccgaagcgttttccagcacccgccggccgatccggcgccgcaaaccggccggcaccggcagccggcggcggaccgccatcgccgtctccgcgaccagcagccggcgctcgatccgattcagatcgcgcagccgccagccatggcgggcgagcgccaggaaccggccgcgcaggaccatgtccgccagcccctcgaacccctcggcactgatggtgagattgccgtacccggcgtgaagcagcacgccggccccccgacggccggccgcccgggcgatgtcgtcgaaccagggcatgttcatggcgttgaccggcggcagatcggccccggcggcgatccggtcgaacagctccagctccagcgccggggtttcgcggatcacatgatggcggatatttgggaagcgggccgcggtttcggcggcaacaccgctttcgtcatggcgcagcagcggatggaccgggggcgtgccctcgggcggggcggcggtataggcgtccagcacgtcattgcgggcggccagcacgcccgccgccagggcggtgacggcgctactgtccagcccgccgctcaactggctggcgacgccccgggcgctgcgggtctgtgcggccaccgccgtctccagcaccgcacgcagcccctcggcataatcatccgtgcgggcgaagcgcagcggggccacgtgatccggccgccagtgatgatccaccaccacccggccggcctgcatttcaaggaagcagccgggcggcagggcctgaatgtcctgatagatcgtccggtcggccgccacccgccagcggatcgaatggcgggcaagggcaacgggatccagcgcccgcggcaccgccggatcggcgaacaggccccggggcacggtggcgaagcgcagaaaatcgcgcgccagatgatagaccagcggccgcatgcccagggcatcgcgcgccagcagcagccggtcctcgccctcgtcgaacagggccagtgcgaaggccccgcagaaccagccgagcgcatcgcgccccgccgcctcgaaacatctgagcgcgatccgcccgtcgggcatggacgccgcctcgggccccgtccgccccagccgggccagcagctccgcccgattgtccagccgcccgtcgaacaccatcaccagccggccgccgccgccgcgcatcggctgacgatcgacgcgatcctcgggcagatcgacgaactgccgccaggccagcgccgcacggtccccgcgcaccaccccgtcggtgccgcccccatcggtgccgcccatgggcagcatcgcgcgaaggccccgcggctgccagtccgggtcaacaggacgtccgtcacggcttgcgatacccaggatgcaggacaagcgtgcgggctccgcgttgcgggggaaggaggccggaagatacaccacggcaggtcgcccttccatcccggttgacgccaccccccgcttcatgcgcccctttcccgtcacccgcctttcccgtcacccgccttcccgccacattcgactgcgaggatccttcgccccatggccgccgatcgcatgcccgacgatatcatcctggccggtctcgacggccctgccgagatccggatcgatggccacgggctggcccatctgcgggcggggtcggaggcggatctgtttatgctgcaggggttcaacgccgcccgcgaccggctgtggcagatcgatctctggcgcaagcgcgggctggggctgctctcggccgatttcgggccgggctatctggcgcaggaccgcgccgcgcggctgtttctctatcgcggcgacatggccgcggaatgggccgcctatggggtgccggggctggaggggatcgttgccgccttcacccgcggcatcaatgcctggatcgcgctgaccgaggccgatcccgggctgctggcgcccgaattccacgcgctgggtacccggccggcgcgctgggcgcccgaggatgtggtccgcatccgcagccatgccctggtgcgtaacctgacatcggaagtgatgcgtgcacgccttctggggcgtgcccgggcgctcgcccgcgaacagggccgggcggccgacgacgccgcggcgctggcgctggatctcgtccgccgctcgatcgcgccggcgcatgaaatccgggtgccggacgggctcgaccccgaggatatcggcgcccgggtgctggatgatttcctgctcgccaccgccccggtcagcttcgagcccgcccggcttgccgcgaacctcgacgaggcgccacgctggtcccgggtcgatgccgaggggcgggtgatggcggtgatggcggcggccgaaggctccaacaactgggtggtggcgcccgggcgcacggccaccggccggcccctgctcgccagcgatccgcatcgccattacgccctgccgtcgttgcgctatgcggtccatctcacggcacccgggctcgacgtgatcggcgcgggcgagcccgccattcccggcatttcgctcggccataacggccatgccgccttcgcgctcaccatcttccccgccgatcaggaagatctgttcgtctgcgaaaccgcggcggaggacccgctgctctaccgccatggcgacggttatgtgccgatgacggtggtggaagagaccatcccggtgaagggctgcccggatcagacggtcacgctgcacttcaccgtccacgggccggtgattttccgcgatacggaccgccgccgcgccttcgcggtgcgcaccgtctggtcggagcccggggcggctccctatctggcggggctcggctgtatgcgggcacgcacccccgaagcctatgccgccgccctcggccactggtcggtgccctccaccaaccatgtctatgccgatatggacgggcggatcgcctggatcgtgggcgcgaaactgccgctgcgcccggcctcggacgggctgctgccggtgcccggcgacggccgctatgactggtcgggtttccaggaccccgccggcctgccgcgcgagatcgacccgccgcgcggcttcatcgccaccgccaacgaaatgaacctgcccgaggggccgctccgcgcgcgcggtttcggcttcgaatggctggagcccttccgtgccgaccggatcaaggcggtcctggccgacggcccgccgcacgacccggccgcggccgaagccctgcagggcgatgtgttctcgatcccggccgcgcgggtctgcggccatctgccggcgcccgaaaccacacccgccggcgacctccaggacggcctggccctgctcgccggctgggatcatcatctgcggctgaaaacgccggcggcggcgctgttcgagatctggtggacccatcatctgcgcccggcgctgctcgaccgcatgaccgatgatccggcgctgcgccggatgctggagccgggcgatgtcgaaaccctgctcgaccggctcgacaccgaccccgcggcccgtgcctgcctgctgccgacgctcggccaggcggtcgccgattgccgccgtcgcttcggcgccgacccggccggctgggattgggggcggttccaccacgcgctcttcgtccatccgctggccgaggcgggtatcgggggcttcccgcagcttggcccgctgccggtgggcgggtcgggcatgacggtgatgaacaccacctatcgccccacggacgggcggctggtgatcggcgcctcgttccgcatggtgatcgatgtcggcaactgggatgccgcacgcttcgtcaacggccccggccagtcaggggaccccaccagcccccatctggccgaccatgccgaagactgggcccgcgccgccaccctgcccatgccctatagccgggccgcggtcgatgccgccaccgtcaccaccatccgcctgcgcccgcaggcgcgggcttgaccggcgcagtcactgccgtagacttcagaaatcgatgcgagccctctcgccaagacaaaaagccggcgccgccagatcaaaccccgttccaaacgctgtatccgcctcccgatctatttggctcacctgatcgaacgagagggtgaacactgtttgatctggaggccgacggccacggaacccgccacaagaaggtttccccccagatgactgcccagaccaccccggcctacaccgacatcctctacgaggtcgacggcccgcttgccgtcatcaccctcaaccgcccggatcgtctcaatgcctggacccaggtgatggaagacgagatgcacgccgccatgctccaggccgaggccgacgaggcggtgcgcgcgatcatcgtgaccggtgccgggcgcggcttctgcgccggtgccgatatgggtctgctttcgggcgccgccgaaagccagggcacgcgtgagccgcgcgcggccgaagcggtgtcggacgacaatttcgaccagaaattcagctatatgctgaagctgaagaccccggtgatcgcggcgatcaacggcccggtcgccggcatcgggttgtgcatggtgctgttcaccgatctgcgcttcatggccgagggggcgaagctcaccaccgccttcgcccgccgcgggctgatcgccgaacacggcagttcctggatgctgccgcggctgatcggcaacatgaacgcgctggaactgctgttctcgggccggctggtcggcaccgccgaagccgagcgcctgggcctggtgcgcagcctgccggccgagggcttcctcgatgccgtcaagacatacgcccgcgaactggtcaccacctcgtcgccgcgctcgatcggcgtgatgaagggccaggtctaccgggcgatgttccagaacctgtcgaccgcctgggacgaggccaaccggctgatggtggagagcttcgaaagcgaggatttccgcgagggcgtgagccatttcgtggaaaagcgcgccccggccttcaccggccgctgaaccgcacgcaggcgaggcgcacgtcagaccaggccggaaaagcggagccgttccagcaccgccccggcctcggcctcggcgccgaccatggcgagcgcattgcgcaccatgccttcggcgatgcgcgcccgggtcagccggccgtcggggcggtaccagttgtgcacccagatgatcatgccggcgagggcaagcgcggtgacccgcggatcggcgaccgtcagccgccccgccgctcggccggcctccagcatctcgaccagcagcgcatcgaaggcgcgctgggtggcgatgatccgctcctgccccgcttcgggcagatgggcgaattcgcgggcatggatggcgatctgctggtggttgtcgatcaccaccccggtgaaaccatgggccaccgcaccgatctgcgccaccgggtcgagcccggcacccgccacccgccgcaccacatccagcgaggcatcgaccgaggctgcgcagatcgtcgacaggatctcggccttgcccgagaaatggtcgtagatcgaggccttggacatctgcagccgcaccgccagatcgtccagcctggtgcgggcatagccctgggtgaagaacagctccgccgccgccttcaggatcagcgcccgcttgaattcccggacgtcgtcgcgcatccgcccctctcttaaactccgccccccgcccgcccggcgggtcaggcggcggatggtacccgcaagcggtccggctgtcgcctgtgctgacccgccgggcggcatttggcgcgggcgcgtcagagcgacgccaccacccggggcggaccggcgcatcagggcatcgctcaggcgccggcgcagggccggggtcattgcggcagccgatgcaccaccacccggaaaccctcctcgggtgccggggggacgaaatgcgcggtgatctggtcgaactgggcatcggtggcggcgaaatcatggccgcctgcggcattgcgctgccgcagccgggcccggcagacctcgtcgggcaggtcgatcagatgcaggcgatggtcggcaccggcggcctcgaagatcccgcgcatccaggcgcggttggcaagggtgttggcggggaaatccagcaccaccgacaggccggcgcggagcagcccggcgacatgcggccccatggcggcgcgcagccgggccgaataccgcacataatcggcgacgctggtcatttcagggccatagagccgggcgagccaggcgtcttcggcgatcagcaccgtggcgggggcggcggcaaggcgggcggcaagggtggacttgccggccgcgatcttgcccgagagcagatgaaggacgggtgtggaggacatggatcagaaaacttccggacaacgccccggcctcgcgagacatatcccgcagagcataccgacggcggatggctgacagaatggcgcgcgcgattgtcccggcctgaaaggtcaggccgggcagctaattcgacgggtgccacacatcatccacatgtcgtcagctggccttgtcgttgatggattgcgccagcatagcccggccgggccatggcgggaagccatcagagatcgcccagcctttgcagcagcagccgcgaccaatgcggctgcgccgtctgaagggcatggatgccgtcgacgaattcgtcatcggcgatctcgtccccgaaatcgatatgcgggatcccggcctcgtcgagcgcccgcgcctccagccgcctgaatgccgccagctgcggcaccgccttgcgcagcgcccggctttcgaccgactggtacaccgtcacccggataccggccgcctgcaggcgatgcacggcccggatcagtgcgtccagccgggccaggccgtcgggggcatcggcggcacggccgccggcattccgtgcgacactgtcgatcatgccacggcgtgcattctccctgacctcgggcgacgggtccgccgtcggatagcgccgggcatggatccggcgccaggcggccacgcccaccgtacccgcggcaaaaaccggccgttcgatcaggcgcagcaccggcccggtcaccggcgccgtcagccgtgccgccacatgcggaccgtcgggcccgatctcgaacgcgccggtgttttccagatagcggccaagggtggggatgctggcaagcagcgggatcggcggcagatacgacagataatgggtggcgatgaccagccgggttctcgccgcacggtcgggcggcaggcagttcaccagggtgtcggcaatggtcgccatctcgtcgatcggcgcccccgccatgtgcatcagatgatgccgcggccccggatccagcgccgcccgatcggcggggacgaaggcccgggcgctggacgggccgatcacgataagctgatccccgaggctggtatcggtacagatccagtagagcgcgcgggccgtgtaggcgcggttgtccagggtacggtacagggcgctgtcagccggcagcaccgggaccagaaacgaggcggcgatcagcagcgcccaaatcgccgccgccagtgcggcgaccgccgtcagcggatggcgccgcagccatgtcatccggtcagaagcccgcatagatgaactccgggatcggctcggacttcagcgccgccaccatcgccagggcgcagatggcgacggcaagcccgaaacaggcacgtggcgaaacccggcgcggcacgaaccggccgtccatccaggccgagcccgcccgccagaccagcccgcccgccagcacccagagcgctgccggcaaaagtgccagcaccgccagcggcccgggggcgatatccggcatcggcgccccgccatacagccaggtgaaggcggcgacgaagcccgacaggaacagataggccgacaccgccgagacggcacgataccagccccgcgccttcagccggcgccagccgccggtaccgagcgccgcgcgcaggccccaccgccagccccggttccagatcatgcccaggccgatgagcaggccgatggccagaaagcgcaggctgacgtcgtgccagagccccaccgccaggaaggtgacgaaggtgccagccatcgcctgcagctccatcgcccggggcgagggccagcgccgatgcagggcggtgaccagcggcgtgaacacgtaatcctggtaccagcgcgacatggtgatatgccagcgggtccagaaatccagcaggcaatcggcccggaacgggtggtcgaaattctcaggcacccgcagaccggccagccggccgatgccgatcacgatatccatataggccgagaagttcagataaagccggatggggaagatcgtcgccgccatgaggtggaagctcaccaccaccacgcccggcccctcggggccgagcagccgggccgcgagcgcccccaggtcgacgcccgcaaccaccggcgccgtcgcctgcagcaccagccagtcatgcagatcgtcgcagagcggcagggcgatcaggatcttggcatagccggcgaggatccggcccagcgccgccagccgcgccgcctcccctgccggctgccggtctgccatggccgccagatgatccggccagcgctgcagggggcccgacagaaaggtgaggaaattcagcgtgaagagcagatagcgccccgctgtcaccggcggcgtgccgccgggatccgaggcggtatcgaccagcagatgcaccatccgcgccagcacataggcaagccccagaacgcccgccaccccggccagatccaccggcagcggcaagagccccgcggtcttcaccagggcgaattcggccaggatgacgacgagccccggccccgccgcccgccagccatgccggcgggccagatatgtggcgacgaagcccgtggccacgaaaccgccgagcaggccgatctgcgccgggccgaggcacagcgccagaaaggccaggctgaagccgcccagcaccagccggaaccaggcttcgggcatcggccgtgcggtcaccgcgatgaaggcgacggcaagcgccaggaaggacggttccagaaagatcatgccatcgccttgcccgcggttacccacgcatggcgctggtcgtcgccggacgacgggcggatccttgccgggtcatggggtgaccactatcatgccacccctgaccggtccatacgggagatgcccagcaccatgtcgcgccttgcccgcattgcggagatcctgcaggagatcctcgacctccccgacctggtggtgaccccggagctgtcggccgccgatgtcgaggactgggacagcctgaaccacatccgcttcatcgtcgcggtcgaggccgaatacggcgtgaagttcaccacccgcgagattgccggcatgcgccatatcggcgacctgctggccatattggacgcaagggcgggcgactgacatcagcagtgtcagtcgggcgcacgggcgatgatcaccgccgagatggtggccgcgatctttcgtgcccggtcgagcgtcaggccggtcgaaggcaggaaggccgtatgttcgatggcaaagccggcggcccgggtcatgtccaccacggcttccggggtctcgaacaggaagatgtgatcgggggccgggctgttgaccggcacgttcaggaacagccgcgcccccggtgccgccagccggcagaaggtttccagcgccagatcgggccgttccagatgttccagcacctcgctcgccaccaggctgtcgaagcttgcgcccgagaaggcatcccgatcggccacatccaccgcacgcagatccgcgacccggccgatgccgaggcgcgccagggcatcggccgtgcggccgaggctggtcgcgctcacatcccagcctgccgccgcggcacaggccgggtcggccagcgccagggccagcagcagcccgtggccggggccgatttccagatggcgatagccgggccggttgccgcccagaaagcgccgccgatagaggccgatcgcatcggcgtggttgcgccacagcagctgcgacagcaggatgccgtccagatagggcgccatgcaggccggatcggcatagatcgccgcctcgacctcggcgaagctcgacagccgatagcggccggtgcggcggaaatggatctcttcgtcattgatcatgccgcacatatggcgatagccgtcgatcacccggccgaggtcgtcgcccgcgatggctgcgaccagcccggccagggtctcggccgatgccaggccctcgggggtttcgtcgcggaagcgccggtccagatagccgcggtgctccggccagcggtccagcaccgccgccacgatgcgggcaagcacgggggcggcggcaggcaggtctggcaggatcatggcggcagcttccgacgaatggtacagcaggcggggatggtacagcaggcggggcgggtccggatcttaatcgggccccggcctgaacgaaaggcggcagccgcatgaccgatatcccgatcgaccagctgccctggctgccggtgctgaccgacaggctccgcgaccgggtccgggcggtggcggaactggccgcagacgaccgcatggccgggctgcaggggctcaggcatctggccgggcaccggctggatcttgcccaggccgggccggtggcgaagctggccgatcgggtgatcgggaaagccgggggcgcaccgctgttcaggacggtgcggctctgcatcctgtcggacacgaccacggcgctgctgccgccggttctgcgggtggcggggctgcgccacgggctggatcttcagatcaccaccacccccgacgaccagatcatgagcgtgctggaggatccggggggccccctgacctcgccgcccgtcgatctggtgctgctggcgttggaccgacgccgcctgccccactggccggccacgggcgaggacgatgacggccgggccatggcgagggtcggcgagtacatcgccgggatcgcccgacggattgccggggcgaccggcgccacgctgatcttccagaccctgccgcaggagccgatcgccctgttcggccatctggagcggcggatggcaacgtcactgcggggacagatcgaccatgtcaatcggctgatcctggatcaggcgacggcgatggatgcgctggttctggatgtcgatgccctggccggccaggtcggcacgacccgctggcacgatccgcgccactggcactggtcgaaatcggccgtcgctccggccatgctgccgctttatgccgaccatctggcccggctgatcgcggcctgggccgggctggcccgccgctgcctggtgctggatctggacaacacgctctggggcggggtgatcggcgatgacgggccggacggcatcatcctcggccagggcgatgccgagggggaggccttcctggccgtccagcgccaggcgctggacctccgccgccgcggcatcgtgctggcggtggcgagcaagaacgacgcggccaccgcccgcctgcccttccgcgaccatcccgacatgctgctgggtgacgacgacatcgcggtcttcatcgccgactggcgcgacaaggccagccagcttgaagaaatcgcccggcggctgggctggggcctggatgccctggtcctgctggacgacaacccggccgagcgccgccaggtgcgggacgccctgccccaggtggcggtgcccgaactgccggccgatccggccggcatgccgctggcgctgatggccggcggctggttcgaaaccgtcgccgtctcgaccgaagaccggctacgcgccgaccattatacccggcaggcgcgcgcggctgcggacgataccggcgccccggacaatcccgacacccggcaggcgccggcccgccgcgaggatttcgaggcctatctgcgcgggctggagatgcgcctcaccctggcgccgatcgatgcacggtcaagaccccgtgccgcacagctgatcgggcggtcgaaccagttcaaccttaccacccgccggatcgacgccgccggcctcgccgcaatcgaggccgacccggcccggcactgtttcgccatccgcctggccgatgtcttcggcgatgccggcatcatctcggtggtgatcacccgcgaggtgacggcgcccgacggcagcccggccggggcggcgggacatatctgggcgatcgatctctggctgatgagctgccgggtgctgaaccggcgggtggagcaggccgtgctcaaggccctggccgaccgggcccggacgcggggcatcgggcagctgatcggcctctatctgccctcgggccgcaatgccctggtcgccggccattatgcccggctgggcttcacgccctgcccgccggaggtctggccccacgccgccccctccccttccgacggttccggcatcccggcgcttcccgaggaggcgacggtctggagcctcgcccttgccggctataccccgccggaactgccgatccgcatcgacgggccggcctgatccgtccgccgccggaagccggcgcgccatcacccctgccgcagccgctcgcgcaggcgcggcgtggcatgatccaggaaggcctcgatccgccgcggcgcgcgctcgcgtcccagatacactgcatgcaccacctcgctgtcggccaggcagtcgtccagcacggtgaccagccggccggcggcgatgtcgtcgcggacatggtattcggcaagtctcgccagccccagcccggcgcgggccatgtagcgcatggtctcgccgtcgctgacctggatccggccctccacctcgcgcgcgaccctgcggccatccaccgtcatcggccagaccgcggcggcacggcggaaattgaagcccagacagtcgtgatcgaccagatcatcgggccgctgcggcacgccgcgccgggccagataatcgggcgaggccacgatccgccgccgcacctcgcccagatgcaccgcgcgcaggcccgaatcgcccagcttccccacccggaaggcgatgtcgacccgcgccagatatagatcgaccacctcgtcggtgaaggtgaggtccagccggatctgcgggtatcgcgtggtgaactcgggcagcagtggcagcaggcagtgccggccgaaggggatggaactgttgatcctgaccagccccgagggcaccaccgcctgaccggcgacttcggcctccatcgcctccagctcggccagcagcgcctcggcccgctcgcggtagacctcgccctcgggcgtcaaccgcaaccgccgggtcgaccgctccaccagccgcacccccagccgcgcctcgatccgcgtgatcagcctggcggtcgccgacggcgtcatccccagctcccgcccggccgcactgaaggccccgcgcgccgcgacacgcagaaagacacgcatttcccaggcgcgggcgtcggtcatctcagcttccggataccggtggccactgttgggcaccatgaagcacgcgtagaacaatcaccgcacggggtgtttcctgataaatcaccagataattcgatcgcacgagcatttcccgggtgcctggaacaggcccgaccctgtaaagacgcggatgcatcgggagctgggcaaccctggcctcgatatcatccttcagacgctgcgcagcatccggattgtgatccgagatgtaatcgacgatcgccagaaggtccgcccgcgcggtctcccgccattcaagaccgggcacggcgcttcctgtcgatcagtgcctgagcctcgtccatcacccggtcgtgcgacaccgccggccgatcgtcgtccaatgcctccagaaccttcgctcggaaccaggcatcataggcctccgggttcgcggtcaggctggcggggagcgccttgtcgcggaccacacgggtcagcagaatccgaacggcatcagagacggtcaggcccagatccgcaagcgtttcggtcgcctcggccttcagctgctcgtcaacacggatatggagcatggtggttcgggcgggcatgagcgtgtctcctcctgtcgcccaagaatgcatctcaattgagatgcgctcaagagccgaaaaccatgtcggacggatgccgtcgccggtcaatcgcgcgccatcaggaaggcggcgacggccaggccacggggttaccaaccgatctcgccccgaagtgcgtcagcgttgaataatcctcggttgtatccgtttgatgacccgccttctggtgcccctgcggcaacccgatggcgccgccttcttgtcaagtgcatattccaggccaatttttcgccataaaatgaaatgattcgactccctcttcgcacataaattgcgctaccgtctctgtgacgggcatcacatccgcccgctttccacagtcttcctgacaacatcatacaactattgatagtgtatcgatccgggagggacggatgccccaggatgacccgatggcggggctcgcccgccttttgccgggcctgaaggccgatcggcggaccgcggcggcagatcttgatgtgctggccggaaagatcgaggccgcaaagatcgagggccgaaagcccgaagccggggaagcgggcgtcctgacggcgcggccgcaggatgcgttttcggtgctggccatggccgggatcgggccggcggcggatctgcgcgggctggcgccgtccagggtggccgggccgttcatcgatctggacgggcggcggctgttcgtcgacgtgttcgaggcgggcaagctgacgccgatcacacccaagggccaggcggcgccgctgatgctggtctcgggcggctcggcgcggcgcacgcgcgatcaggtgtcgatcggcatcgatgccggcacggtctggatcgcggccgggctgttttcgaacaaggcgccggccgatggctgggcggggctgccggtccggcgcggcacggcgcgcttcgccgccgccgctgcaaccggcacgaccatcgccgccccgcccaaaggcgaaatcgtgctggaactgggctatgcgcccgacccggccaatacctgcccggatgccgcgatcacggcgcccgccaaactcaccatcaccatcgacggcagtaaggccgcggtggcgctcgatggcggcgaggcgcggttcggcggcaccacccataccgtcgccccgacggagaaggtggtgtggaacgcggccgaaaacgggctctggtttccggccgatatcgatcctctggcgatcgatgccgccgggatcgactggcgggtggccagcttcgatgccgggtttcgcatcgcccgcggcggctggctgatcccggtggtggtgagcaccaccccgcagaccctcccccaggccagcaccagcggccattggtgctttgcgctgaagggcgatccgcgggtcggctgggtggggctggatggccgggtgcggatcaccgaccccaccctgttgatcggccagggcattttcatgctggtcgaccgcaacgccgccgccgatccgggggccgtgacccgcttcgatctctgggcgctgggggccgggatcgccgggcgccagagcgtcaccgccacactcgccgccgccggtgcggtggtgatcggctgcgccggcgccgggcggcatttcgccatggctgaggcccgcgtggccgaacgcctcgcctgcccgcgcgaccatgccggccggccggtaacgacccggccggtgaccgccatggtgatgatcgccgaagaggccgggcggcttcaggccgatctgatcgccaccggctttgccggcgatccccccggcagcctgcggctggtggtcgaaaacgccgtgctcgcgaccgggctgccggccctctatcgcgtgtcgggcacggtggatgccgacggcgtgatccgcgccggcacgctggatctggtcttcggcctgctgaactggctgccgaccctgcccgacccttatgtctcgtcctgtgcgggcgggctgccgctgccccaggccggcgccgccgcatcgggaggcgtgctgcgcgccgcggtcagctggtcgggcgacggcccgccggccctcgccttcgccggcgacctgccgccacccctgctcggctgcgacaatccctccaagcccgatcggcggccggcacgcctgcccgatcgcgagttgaccggccagaccgcccagggcacaggcctgcgcggcaaggccgaactggccgcgtgggagcgcgcccgccgcgccgcagagggcttccagggcaacgagtcctggcccaaggcgcgggcgaccttcgccgaccgggtgggcacgctgggccgccggccgggggtgtcgctgctcgacgtctcgacccggcgccatcagatcggcgtcgccttcgacaccagggtcgaccagcccctgacgcatgccgtgcccatgcccgataccgccgcacggatcgaggggctgcgcttcaagaccggcctgcgcgtcttcgccctgccccagatccagtgggaaccggtgcgcacgttggatgccgaccaggatctggtgacgctcggctggttccccaccccgctcgcctcggccggcgatggcgggccggcgatgatccgcggcgccgcgaaactgcggccggccatccccgatctcgcccttgaagagatggttgcgggcttcaacagcggcgacccgctggaggtactgaccaccctgcccttcggcatgatggccaagatcgagatgaagggcgccgccgatgccgatgcggcagccgataccgcgaccatgctgcggccgcgcttcgaccggggcgggccgcttgaaggcggccatcagctgagcctgcgcgccggcacgcccacggccgcatcgccgcgtcagagcgccggcttccgcggcctcgccactcagacgcccaatggcgtcgacctggcctcgggcgcaccgctcgacatctcggtgctgggcgccaccgccggccccgagggcgcggtcgaggcgatgttcaacaatgaattcaccctgttccgcccccgggtgccggtcacccggctcgatctctcgggctatggcagcagcaccttcagcgactggggcaacccgttcgccgccttcgccgaggccgccaaggtccagttccaggtgatggtcggccgcacggcgctggaggtggtgaaattcgtcagcgtcatctacccctgggggatcagggcgacgcgcaccgtcaccatcgaacgccgcggcggcggtggtgtcctgcgccgcgacagcggctggcaggcggcctcggccgggctgttcgatttccgccatgtgccggaaggcggcggcgcgccggtctcgcccgattacgaggtccatccggggctgatccgcgggatttacgacgtcacccgcatccgcccatccgacaggccggcgatcgatctgccctcgggcgggcgggtgctgccgatgtatttcgatgcgctggccgaggtcggcaccgatgccgcccatgcccgcacccccgtccgcggcatgctgggctggctgcatctgctgccggtgggcgacccgatcacccccgccgatctggaccagctgctgcgggtctatggcccggcaggcgggccgatagaggtatcgctgccgctggatgcctcgggcttccggatgcggctgaaacggatcgaggccgcacccgcctggaacggcccccacccgccatcgtcggcgcgctgcgcggcgcaccgcaattcggcgccggcaacggcgcctggtcggtggcggccttccccggccccgcccatcccgaccagccgggagaggcggtggccgcccccgacggtgtggcggtgctgcgcgcgggtgaggccggcacgccgctggccgaccgcatccgcgtgccggcaccatcgcccctcctcaccttccaggacccgcaggatctgttcgcgggcgccagcccgcgggccgattacgccttcgtccagaccacccccacccatgccttcgccttccgccggcccaggatccagatcggcagttccgacatcaccgccggcctgccggcgctgttcgccgacgtcttcgcccgcaccaccggcgccggtgtcttcccgcatcccgatgcggccatcccgctcggcggggccggcagtcaccgcctgcgggtgaacccggccaatggccgtttccggctgatgccgccggtcgccatggcgccggggccggtgcagatcgtgctctccgacgacgtcgatgccggcagccggatcgactatgccgcaagctcgatcacgcttgcgatcgaggaagacggctggtcgctgaccatgccccgggtgaaggtctggaccgacattcttggcctgaccgacgtcaccggcatgcagaccgacatcatcggcggcagcacgctcaggccgaagctcaccgccatcaactcgctgatgcatccggtgctggaagacatcatgaccttcctgcccggcttttcgtcacggccggaaatcgccccgatcgatctggcggcgaccaatctgaaatacaaagtgaagctgaagacggtggccgaaaaggaggtcgaactcggccccctgcatctgaaggtcggcgcggtgttcgaggccggcaccgacgaggtcgacgtgccccccgatctgctgccgcccggcagcccgcggaccgaggccgaggtcgaattcgtcggcggcggcatctcggtcgcgctggagggcgagaccccgaccagcccgtggaaagtggtctatggcgccgaattcgggctcggcggcaaaacctatatgccgcagctgaccaccgacccttcgggcggcggtgcggtggtgggcagtttctccaaggcatcgttcgagctgaaggcctatatcggcatcggcgtcggcggccatctggggccattcaaggccgaggcctccgtcggcatcggcccggtgatcgtctatgaaggcgactggggcttcggcggcttcgtcttcttcgatgccaaggtcgacgtcaagatcgtcaccgtcggcgtctatggcgaattctcgctgatgatcgtgaagaaggtcgatggcgactatgccgcctatgagggcgaggtcggcatctacgtgaagatcatgttcttctcgatcaaggccagtatcggattttccaaggaagacaagatctgaggaggccccggccatggccgcaccccgcctgtccattctgcccttccttcagtcctgggatgccgcccagggccgcctgaccgtgaacctgctgctggtgccggtgggcgacccggcccagccgctcgggccccccaccgccccggccttccagggcacggcgctgcgccttgccgcccatatctcggatgatccggggcgggtggcgaccctggccgatgtgccggccgggccgcagcttgtcgatctggcgccgccgcccgatcaggcggcgctgctcgactggctgcgcgccgaattcaagctcacccggcccgagacggtgcatgtccgcagcgacgacttccggctgcgcaaatacctgccgctcagctatcgccgcgcccatagtttcgtggcgccgaaaacaccgctcgcctcgatcgacgacacctatcactgcctgctgaaatgcccgccgccatcggcacgccctaccccacccgcaaccgacgagatgagctggggcgaaggcttcgccgtgctgctgcgccagccgccggtcgcccgcgccgccgggctgatccacaccgtcactatcgatctgccggaaccggcgccgggccaggcccatccgggcggctggctgttcttctcgctggcggccggccatcccttcgcggccgaggccgccgccgatccgggctgggcgaatctctacgccacccgcctgccccggctggaccgggcggaaccgcggccggtcttcaccgccaccctgttcccggtggcggcggatgccgcggcggcggccggtctcggcccgctcgaccaggtgtttccggaagccaccgttttcgacgacggtttcgccaagatcgtccatgcccgccagccgatccatgccgacggcagcgccgaggatgccgccggcggcccgccgctccggctcgaccccggcattcagctggcctgggacgacgaggacacgctggtcgccaccaaccgcgcgatcggcaccgagatggacggctcgctgccgcccgaagcgccgagtgcggtcttcggctaccgggtcgatgtgcgcgcggccggcgatgccggctggacctcgctgcaggcggtcacctcgcccggtttcgcggtcggcgcggccacgatccccggcttcgatgccgaaggcatcgtcgaggtccaccccatgaccgtcgccggccagttctggctgccggtgttcttcgcccgctgggccggcggctcgctggtcgccccctccgatgacgaggtgctgctgcgcgggccggcgcgcgcccgcgccctgccctatgccggcaccggcgccggagcggtgccgctgcgctatggccacgactatgaattccgggtgcggctggccgataccaccggcggtggcccggcggcggataccgatccggtgaacccggccgcggcaccggtggcgcgccaggccttccgccggatgatcccgcccggcgcggtgcgtagccgcgacctggacggcaccggcgcccacacgccccggcagttccagatccaccggccgcggatcggctatccccaggcggtgttcaccggcttccccggcgctttcgaccatctggccgcgatcggccgcgccaatcagggccggccggcggccgcctgggtggtgccggacatgcccgaccccgatgccgatctgctggagatccgcgtcctggtccaggcgccgcgcttcgacccggccggcggcgatgccggcttcacccagctgtaccgcaccacccgcgccttcccggcgctggtcgatccggccgcacccgcggtgctggacctcaccctcgactgggtggattgcgcgcgcctttccgacatcgcctggccgatggatggcggcctgcccggcaccgggccggtggtggtgccgcgcggccgcaatgtccgggtgctggtgcgggcgctggggcgcgcggatccgggctatttcgggtccgaggccgcacgtctgggcagcccgggagagctgtggccgggcacggtgacggtgccgctcgcgcccgaaccgccgctgtttgcgcccaccagcgatcaggagcgtctggcctcggtcttcctgcaaccggaagtgccgcgcgcggccgaaaccgcggtggcggccgcccaggcgggggccacgacgctgatggtcacgcggcttgccgccgccaccgggctggtggcagaggacggcacgctctacggggcccccggccggcgcacggttttcggctgtgccgggctgaaacatcacctggcgcccgatggcggcgcgctgaccctgaccagcccggtggagctggaccgggtctggctgaacctggtgcggctcaggctggatcgcgactggagctggacggggctttccagcccctcggtcaccgtgtcgcggcgggtggagctgctgccgatcggccagatctcgacccgcgccctcggcagcctgcaggtcgatcatgcgatcaacggccaggcgctcagggccgcccccgaccgcgagagcctggatctggtcttcctcgacgcgctggaaccgcccaccggccccgacggccacccttacgaggtccgtctgacctatacgctgaccgcgcgtttcgacgatggcggcacgcaatcggtggaggtagaaacccggctgccggtcgcaaccgcgcccaaggtggcgccgaaactggtctcggccggccatgccttttccgactacaccatcttcggcgattacgaggcgaccggccggcggcggcgcatgctctggctggaattcgaacccgaccccgcgcgcgacccgcgcgacatcatctatgcccgggtgctgcaccagaccccggacccgatgctgatgccgggctgggaaccggcggccgaccccgccccctatgccgggctcgatctcgaccccgaggcggtgcgggtgatccgccccggccagggcgacgaccatgccgggctgaacgccatgcagccgctgatcaaggcggtggacagcgacgtgcactacgccctgccgctgccggccaatctctccagccagtcgccggaactcttcggcttcttcacctatgaattccgggtcggccacccccagggcaccgaggcggcgcccttctggtccaccgcccaaggccgtttcggcccggcgctggtgatcgagggggtgcagcacccgacgccggacctcgcctgcgccatccgccgcacccgcgccggcatcaccgccagcgccggctatgcggtggcggtgcaggatggccgggtgatgcgcatccagccgcccaacaccgaaatctggttcgtgctctacggccgggtgatgcaggccgacggccagagctggcgcaacatccagctcgacctccgccgcgcccaaccggccatccgccgcccgacccacggccgccccgtcgccgggtaccttggcacccgccatctgccgcccaccggccacgccgcctggaccaccgccgacatcgaagcccgcctcgccgccttcggcttcgacgacgccaccccgctcaccgcgctcgccatcgaactcctgcccgaacccaacggcgccttcgacgcgccgctggcgggagatctgggccaggtgaggatcctgcgcacctcgccgctggtggcggtgggtggggggtgttgtccgccggaggtatgatccggaagatcatgtagaacagccacttcgcccgcgacaccacggggttgggtcacccctggctctcaccgggccctccccccgaccgtcagggcacaacgctcggcacggtcacggatcatgtcggcaaactgctcactggcccgtcggtccaagccggacggcgaaagctcctctgcaacggcggttgccttctcaagcacgcccttgctgatctccgcaacccgtcgccggatcagcggcaggccgagacccgtctcagctgcgaaggttgcccagcccttggcatccagctcggcgagcgtcgcccgtttcccgatcttcatggcgaaattcggcgagaggtcgggataggcgacagtcgccagcaggtcgtagagcggggcgaggcgcgggcctccggtgtcatagaggatcgagaagttcttgccgtgcgcatcggcattcccggcgatcacattgaagatcaccgcgtcgagaagcttcagcacatcgacggcgggcctggcagcgacacggcggagcagcgcgaagcaatccttgaaggtcgggccaccttcgctggcatatttgatctccggtggtacaccgagcgcctggcagaaatcttcctgatggatccggtgcacagccccatcaccgccgatgtcgcggtcgtagcgctggaccagcagaaatgggcgaccctgcacgatacgcgcctctaccggcgcgacatcgagaccgattgccgcggcaaggcacatcacaaaggcctcgttctcggtcgtggccgcgaagcgcgagatcggcggtttgagaatatgcgtcgtcggctggcccggcacaggcaacgccaccgcgccatccaccagaacgaccggcaccttcgactgcgcaccggccagcgagagccgcagtccgcgctcgcccgccagcagcgggcgaaggggcagcgcctccagtacccggatcagggccgcatcatcgagcgggctcgcctgccgctcgtcggcaagacccatctgtggttcgccgggcggcagaagctggagcgcgcccgcgacatcgccaccgagacgatcgagaagggcaaaatcattggcccgtgaaacgccgagcgcctgggccacagcgtcgcgctggccttcttccggcaagaggccaccgaaaaacggccgacattcgcgacgactgaacggctccgcccgcttcggcagcgaggcggacaagggcggcatctctgcatcgcccagccactccggcgcataggcgaagccgagttcaccgtgcgggttctgtgtcagctggcccaccaggcgcccgtcccaccagacatcgagggcgcgcgtcatgccttccgccctccgttgatatccggcggcggcatgatgtcgaacgaacatccaagggccgccaggacctgaagcgtcttgccgatctgggcggtcggcttgcccgcttcgagatcgacgatgaagcgcaagccgaccccggctgcgcccgcaagctcgtcctgccgcaggcctgcggccttgcgggtggcgcggacaatgtcgccgatctcggcaggggtgagcgtgcgtctggccatgatctttcccgatcgggaaattatgatcgaaccccgaagattatccatcagaatttcccgctcgggaaaacgcttcgcgagcatcatgacggcggatcgtcttaaagagacataaaaagtagcctcggtctcggcaaaaagaagccccgacaggcccaaacccgccggggcaattctccctcacaaaaggccgccgctcacaccgccgcgatcaccttctcccgcgcccagaagcgcaggtcgcggcaggttttcaggaaggccggggcgtccgacggcgctccgagtttcacgaagccggcatcgcgtttgggcggggccacgcccgcttcggtcatcagcgcgtcggcgtcgggggcccaggcgatgaatttgcggtgggcataggcgtcgccgatgaagtcgagcgcggccgggtgggttttcagccggtcggcgccttcggccgaggtcaggatggcgacggcgtcgtagagcaccgaggggccgccgtcgatcttctgggccgccggcaccagcatgccgtcgctgagggtgacgccggcgatttcgggggcgatcacctcgatcatcgcgccttcggccgagaccgccttttcgagcgcggcataaagatcggcatcggcgccgtcggtcagcagcacgccgagcttgcggccgcggaagctgttcgggccgttgagcacgatcgacaaggccggcgagggcggcagatcggtgcgggtgggtttcgccgccggggccgggtcgggcatgtcgcgcacgcccagccccgccgccacggcatcggccagatcctcgtgcacgttctgaagatgcgacagcatgcgcaggcggatatcggggcgttccaccttgctcagctcgaacaccagcgcattcgccatatgggtgcgttcctcgggcgtctggctgatgtagaactgccgcgcctggctgtaatgatcggcgaagctttccggccgcatgcgcagcttgtcgggctcgtgctcggtgacccgcaggctggagaagccggtcttcgggtcttcgcgcggcccttccttccaggaattgggctcgtaattggcgcggcccttgcggacatccatgcgcatatgcccgtcctgctggaagtgatgcatggggcagcgcggccggttgaccgggatctcgttgaaattggggctgcccagccgcttcagctgcgtgtcgagatacgagaaattccgtccctgaagcagcggatcgttgctgaaatcgacccccggaatgatgttctgggtgcagaaagcgacctgttcggtctcggcgaagaaattgtcgacgacgcggtcgagcaccagccggcccacccggcgcaccggcacgatttcttcggggatgatcttggtcgaatccagaatgtcgaaatcgaaggcctgagcgaagctttcgtcgaacagctgaagccccagctcccattccggcgcgtcgcccttggtgatcgcatcccagagatcgcggcggtggaaatccggatcggcgccgttgatcttcaccgcctcgttccacaccaccgactgcatgccgagtttgggcttccagtggaacttcacgaaggtcgatttgccgtcggcattgaccagacggaaactgtgcacgccgaacccttccatgaagcggaaggagcgcgggatcgcccggtccgacatgatccacatgaccatgtgcatgctctcgggcgtcagcgagatgaagtcccagaaattgtcatgcgccgtctgcgcctgggggaagccgcgatcgggttcctgcttggcggcatgaatcaggtcggggaacttgatcgcatcctgaatgaagaagaccgggatgttgttgccgacgatgtcccagttgccggccccggtgtaaagcttgaccgcaaagccgcgcacatcgcgggccagatcgaacgaacccttgttgccggcaaccgtcgagaagcgcacaaaggcttcggtgcgccgtcccgcttcctgaaacggatcggcggtggtgatgtcggccagcgattcatacgcctcgaaaaagccgtgcgcgcccatgccgcgggcatgcaccacccgttccgggatccgctcgtgatcgaaatggaagatcttgtcgcggaaatgcacgtcctccatcagcgtgggcccgcgcgggccgatcttcagcgaggactgatcatcggcgaccggcatgccgtgcgaggtggtgagcaccggcgtatcaccgccggcggtctgatgcaattccccgccagggccgcgaagcgcctcctggtcgtggatcttcacgggcgtgcgggcatcgggatcggtggtattggccatctggtcggggctccgctggcgggatcaggcgatccggggctggctgagtgaagggagagagggagagagggagagagggagagagggagagagggagagcgggcggcccggccggggaggcggggcggagcggccgggccgcccgccgacgggggcagggctcagcgcccgccgccgccatttccggccgagccgtgcccggcgctgctctgaccggcgcgggcctggttgtgcgcaccaccgggcacgaccacgccggtcatcgcggtaccggtggatgggggcgaatagccgagggcgctgtcggccagcgacagcacaccgaccagccggtcctgccggttcatcaccgggatgcggcggacctggatgtcgcccatgttctggacgacatgttccacatcctcgtcctcgtagcagtatttcacgtcgcgggtcatgacctcggcgaccttggcggaaccgtcgcggccggcaccgacgccgcggatcgcgatgtcgcgatcggtgaccgcgccgatcagacggtcgttctcgcccaccggcatgtagccgatgtcgcagtccgccatccgctcggcgaccgcccgcaggctttcattcggcgtggcgagctggatgttgcggttcatgagttcctggacctgcatatctcgatcctccgtcacggtgcccggccggaaagacgggcggccgggcctgggttcgggtgtctcggattcgggtgccccggttgtcgggccgcatcgggcgttcgggcgctcaacgcgcaccggcagcgatggttccggaacggatcgcccgaagaggcgattaaggggccgcatccccaaggagcccgccatgcccgccccctctctcgacggccaccccgacggccagacttccatccgctcgctcgacgaggcccgccggcaggcggaaggctgccggcgctgcgatctctgggccaatgccacccggaccgtgttcggcgagggcccgccatcggtggaaggggcgacggcggaaggggcgacggcggaatggacggcggcggaatggacggcgggggggccccggctgatgctggtcggcgaacaacccggcgaccgcgaggaccgggccggccatcccttcgtcggcccggccggcgcggtgctgaaccgggcgctggccgaggcgggcatcgatcgggcgcgggtctatctcaccaacgcggtcaagcacttcaagaacgagcccaggggcaagcgccggctgcacaggcgcccggatgccggcgaaatcgaccgctgccgctggtggctggagctggaacgccgcttcgtgcgcccgcaggtgatcgtggcgctgggggcgagcgccgcccgggcactcaccggccatgcggtcaccatctcgcgggtccgcggccgggtgctgaccctggacgcgaccggggtcgcaccggcggcccggctgctggtcaccacccacccgtcctacatcctccgccagcgcgacgacgacgcccgccgacggattttagaggcgatgatcaccgatctggttctggccgcccgccagaaatgaggccccgtttccggcccatatgccggatctctgatgcgcagtgtgcaacgagctttgaaggtggacggctccggggtcaatgaacatccataaacccgccgggatgacttgcaggtgacacaacctgcactctactctgctcgaaaatcagggtcatgccggcggtcgaaccggcaggcctggggtaatcgggcagcgggaggctatcgtgagcgtgatcggtcgggcaggtccgggcgggcggcaggatgcggcggcagagaccatcgcagaggccgcacctgtatcactgctgccgctgtcgggcgcgcaggcgggcatctgggccgatctgacgtcgggcggggtggggcctgccggctacaacatcgccgaccggatcgatctcgacgggccacttgcccccgcagccctctgcaccgccatccggctgaccgatcaggcgacggaggcggtacggctgcgcttcaccaccgacgagaccggcaccccctggcagtggctcgccgaagcgcccggccggttcgattttgccgtggtcgacctgtcggacgccgacgaccccgacctgcttgcccaagaggccttcgaggcgctgcaggcccgccccttcgacaccgcccaggggccgctctgccgccatcagctgctgcggctggcgcccgatcgccatcgctggatccgctgctatcatcatctgatcctggatggtcagggtggcatgatcctggccggcgcggtcgggcggatctacaccgcgctcatccgtggcgagccggtgcccgatccggatctgccggccttcaccgaccatctggcgcgtgaagccgcccatgccgccggcaccggtgccggggccgatgccgcctggtggcgcagtcgtctggccgggctgccggccgcggcccgcttccggccggccgccaccgccgccgcccgcttcgacgggcggatcgcgtcggtgacccgcccgctcggcgcagcacggctggcggcaatggaccgggtggcgcgggcgcatggcctcgcctcgcgcagcagcctggcgctcgcgctgttcctggtgctgctgggccgggtggccggcaccgatacccccgtctgcaacacgccgctcggcaatcgcatggggcgtgcggaacggcgcaccccgggcgaattcgcctataccgtcccgaccggcacccggatcgacggaaccgaaagcctcgccgggctcgcccggcggctcgatgccatgacccgccgcgacctccggcacatgcgcctcgcacccatgcgctggcccgaggccggcttcatccccgacaggccggccagccgcggcgcgctgttcaatgccatggatctgccggcgacctatggtttcgacggcctgcaggtgagggtggcggactcgatcttcggcgagttgcacgacgtgatggcctgtctgcggacctatggcgccgccgatgcctcggacatgcagtggagcttcccgcccgcccgcatcgaccgggcccgggtggaaagcctggccgccgcgttcgaggccatgctcgatgccgccctcgccgatccgacgcagccggtggatcacctgccggcaggcgatctgccgtcacccgccgacaccgccgggccggtcccgccgcagccggccgtgccgctgatcgataccaccacgcgtacggcgctggaggccgaggtcacccggctgttcgcgggtctgctggatgccccgcagctgaccgccgatgacgatctcaccgcccacggcctgcaatccctgcgcgccatccgcgcggtggcgccgctcacccggctgatcggccgcgaggtgaccgtggccgacatcctgggccacccctcggccgcggccctggtcggccatctcttcgggcggcttgagacgatggccgcggcggacgagagtcgacatgcagaggttgattcacccgcagaaataacctcattcagattgccggcccggctggaggggcaatggcttgcccggcgcgatgccggccccggcaccagctattccatcgggctggtctgcgacctgccggccgggaccagggcagcggcgctcgaagaggcgctgcaccggctgctcgaccggcatccggccctgcgctcgaccttcgccgagggcgtggacggagaggtgatgcagcggatcggtccggtgccgccgatccggctggccggctatgacgatgcggcggaaatgctggcgcccttcgacccggcgaccgggccgctgatccgcttcggctgggaggcggaccaacccgagcggttgcgggtggtggtcgatcatctggtcttcgacggcgaaagccgcacggtgttccagcgggaactgaccgccctgctgaccgggcagcccctgcccccggcgccgccggtggatgccggcggcctggacgaggccgccgaggcggccgcgcgcgccttctgggccccgcgcctcgcccggctgcccgaacgcgcccttgccgccgaaccggatccggtgccgtcgggagaggggcgccgggcgatgatccggctcgcaccggaaaccacccgggcgctgcacggcctgaccggccggggcgccacgccgaccgcggtctggaccgccattgcaaccaccgccctgtggcgaattcttgaagacacgcaaaggttgtcggccggcatcgcctttgccgggcgcagccgccgcgacaccaccgatgccatcggatgttttgtgaatctgcttcctgtggttgtcgagccgaccgcaggcgaggccctgccccagctggcccggcggatcggccgggacatctctcaggtgctgaccgtccaggactacccgctctcccggctggcggcggactgggcgcaggccgtgcccgcccgcgggcccacgccggtcgatctggtctgcacgctggaaaacgacctctcggcgctggaagcggccgacatctccttcgccaccggcaagttcccgctgctgatcgggctgatgtggcagggcgatgcggcggcgctcaacatcgaatacgacccgtcccgtttcggcagcgcctggatcgggcggctgcagacggtcatcacccggctgatcgccgccgccgccgccgatccggcaaccccgatcgaccggctggacctgctggatgccggggatcgcgcggtcatcgccgccgccaatgccacggaattcacctggccgcgcgacggcggcctcggccggcagctcgaccaggtgctccgcgccgatccggaccgcatcgtccttgccgacgatgcccgcgcgctcaccgcccgcgatctgcgcgcccgactgggcggggttgccgcggccctcgccgccgtgggcgttgagcccggcacgccggtggcgctggcggtggagcgggatcccgacggcctgaccgcgctgatgggcatcatctgggccggcaacgccttcctgccgctcgccgccaccttcccggtggcgaccgcgcgggagctgctggccaccgccggctgcacggtgctggtggcggatgatgccggcctggaacgctgggccgcactcgcccccgggatcacgctgatcccgctgccgaccggccgggccgacctgccccccgccccgcgcgggcccgaagatcccgcctgcctgctctatacctcgggctcgaccggcatgcccaagggcgtggtggtgccgcatcgggcgatcctgcgcctggcctatggcgacttctgcacgcccggcggctgcatggcccaggcggcccccatggccttcgatgcgatcagcctggaactctgggcgccgctactcaatcacggccgggtgcggatactgccggcaaccaccatgttcgacccgccgctgctggagcgcaggatccgcgacgacggcatcgatacgatgtgggtcaccgccagcctgttcaatcagatcgtcgacgaacggcccggcaccttcgccggccttaaacggctgatgaccggcggcgaggtgatcagccccgatcatgtccgccgggtgatggccgcctgcccgggcgttgtgctctacaacggctacggtcccaccgagaacggcaccttgaccaccatccaccggatcaccgccgccgatctggaaggtggtccggtgacgatcggccggccggtccccggcacgcgggtgcatatcgtcgacggccgcggccagccgcttccgatcggcgtctggggtgagctggtcaccgccggcgacgggctggccaccggctatgccggccggccggagctgaccgccgccgccttcgtcactctcgacgggctggacgagccgctggtctatcgtaccggcgaccgggcgcgctggcgcgccgacggcaggatcgatttcggcggccggcgcgacggccagctgaagatccgcggccagcggatcgagaccgcggcggtggaggcgatccttgccgcagccccgggcgtgcgggatgcggtggtggcgggcatcggccacggcgccgatcagatcctggcggcgctggtcgccgccgacgaggccgacgaggccggctggcgggccgccatcgctgcacggctgccggcctatatggttcccgaacgcttccggctggtcgatcggctgccggtcaatgccaatggcaaggccgatcgccggcaggcggccgcaatgctcgccgaagccgcccccgtcgcccgacctgccggcacgggcacgggtttcgagcgggcggtgatcactgccttcgaaagcctgttccccggggtccggatcggtatcgagaccgatttcttcgacctgggcggccacagcctggccgccatgcggctgtccgccctgcttcaggcatcgaccggccgacggcccgggctggcgcagatcatggccgcgcgcagcgtgcgcgggattgctgccctgctcgaccgcctgcccgcggtggcggcgcaaccggccatcccgcgcgccaccggcaatgagcacccgctctcccccgggcagctgcggctctgggtgctgcaccggctgcatcccgggcttgcgacctattcggtgccgatgctgctggcgctggacggccctctcgatgccgatgcgctggatcgggcgctggtcgggctggaaacccgccatcacgccctgcgcacccgtttcgtcgcccgcccgaatgatggcgacggcgtccgccagatcgtggccgcaccgggtgccctgaccgcccggcggctctgcctggatgcgaccggggccgaccaggcgatcgcccgcgagatcgcgcggcccttcgacctcggcgcggagccgctggcccgcgccgtgctgatccgcatcgacgcgcaccaccaccgcctgctgctggtcctgcaccatgccatcgccgacggctggtcgctgccggtgctgctgcgcgatctgggccggctttatgccggcgcggtggacggccggccggacgatctaccgccgcccgcccgccagctcgccgatatcgcggtctggcagcgggcccgcgccgccggcgccgaaggccgcgccctgatcgaccgctggcagagccggctgacgccgccgccccagccgctccgcctgccggccgatcacccgcggccggcggtgcgcagcttcgccggagacattctgagcctgaccctgcccatggccgccaccgccgcggtcgaccgcatggccgcagccgccggggtgacgccgttcaccgtgctgaccgccctgttgcaggccctgctgcaccggctgaccggtgcccgcgacatcgccctcggcctgctggtcgccggccgcggcgcgccggtgccggacgatctggtgggctttctggtcaacaccgtcgtgctgcgccagtcggtcgatccgggtgcccgcttcgccgatcatctggcgatcaccaccgatcggctggccgaggcaagcgccgatcaggacgcccccttcgaagccgtgcttcagaccctggcgctggaccgcgacccggcgcgcaacccgctcttcgacgtgccgatcacccgcggccggcggtgcgcagcttcgccggagacattctgagcctgaccctgcccatggccgccaccgccgcggtcgaccgcatggccgcagccgccggggtgacgccgttcaccgtgctgaccgccctgttgcaggccctgctgcaccggctgaccggtgcccgcgacatcgccctcggcctgctggtcgccggccgcggcgcgccggtgccggacgatctggtgggctttctggtcaacaccgtcgtgctgcgccagtcggtcgatccgggtgcccgcttcgccgatcatctggcgatcaccaccgatcggctggccgaggcaagcgccgatcaggacgcccccttcgaagccgtgcttcagaccctggcgctggaccgcgacccggcgcgcaacccgctcttcgacgtgctggtcacctggcaggacgacatgccggccatgccggcgatggccgggctgacggtcaggccgctggactgcgtgctgcccttcgccaaattcgacctctctttccatttccagcgcgatggcggccggatccgcctgcatctggaatatgcgaccgagctgttcgagaccgcgacggtgcgccggctggccgaccggctggcggtgctggccgcggcgccggggctggagggcagcgcgatcggcgcgctgccgctgatgaccgatatcgatcgggcggcgctggcgcgctggaacgacaccgcccgggcgctcgacaccacccggccgctgccgacgctgcgtcatgcgggcgatccctcggccccggcgctgatcgcgccgggtctcaccctcgacaatcagggcttcgaccggcgggtcggcggcctggcccgccggctgctggccgccggtgtccggcggggcgatgtggtggcgctggtcctgccgcgcagccccgatctgctgatcgcggtgcatgccgtgctcgccgccggtgccgcctggtgcccgctcggccccgacctgccgccgcagcgccgggcgcatatgatcgaggatctgggcgacccctggtttctgagcgatgcggcgcatggcacggatctgccggccgaccggctgatcctgatcggagacgacctcgccgatgcgccggtggtgccggcggggccggacgcgcttgcctatgtcctcttcacctcgggctcgaccggccggcccaagggggtggagatcacccggggcgcgctcgccaaccgcatcctgtggatgcagcagaccttccccatcggcccggcttccatcgatgctggggacgtgatcctgcagaagaccccggccggtttcgacgtctcggtctgggaactggtctggtgggcctggagcggggccgcggtggccgtgccgccgccgggcatcgaacgcgacccccaggcattggcggcggcgatccgcgatcatcgcgtcaccgtgatccatttcgtgccggcgatgctgcgcgccttcctggatgcgctggacgacggccggatcgagggggcccaccttgccacgctgcgcctggtcttcgccagcggcgaggcgctggatgccgcgaccgccgcccgcttcgaccgcctgcttcatgcccgcttcggcaccgcgctgcacaatctctacgggccgaccgaggccaccgtcgacgtcacctggcagccctgcacgccatgggatccggcggcgaaaacggtgccgatcggccgaccggtcgccaatacccgcgtgctgatcctggaccgggccggccgcgcgctgccgcccggcgtcgcgggcgaaatcgtgctcgccggcccccaggtcgcccgcggctatcgcggccggccggatctgaccgcagaccgcttccgccccgaccccgagatcgcgggcgccagggtctatcacaccggcgacctgggccggtggacggccgacggcgtggtcgagtatctgggccggatcgacgatcaggtgaagatcggcggcgtgcggctggaaccggccgaggtcgaagccgcgctcgatgcctgcccgggcgtggtgcgcggcctggtgcgggtcggccggcgcgacgggctggccgaactggaagcctgggtgatgggcgcagccgatctgacgcctgcggggctgcgcgcggcccttgccgaccggctgccggcggcgatgatcccgacccgctggttccggatcgatcaggtgccgctgtcgcccaacggcaaggtcgaccgcaaggcgctctcgggcgtgccgctggccggccgcccggccgtggccgccgcccccgcgggccatccggccgaggccgagatcgcccggatctggcgcgaggtgctgccgccggaagccgtgttcggccccgaggacgggtttttcgaggcgggcggcagttcgctgatgctgctgcggctgcatgaccggctggaggcacgctggcccggccggttcagcctggccggcctgttcgcggcatcgaccgtggccgcccaggccgccctgctggatgacggcgataccgcaaccggcgccaccgcaaccgccgcaaccgatggcgcgatcgccatcatcggtatcggcctgcgtgtcgccggcgccgaggatctggccggcttctggcaggatgtcgccgccggtgccgaccgggtcgggccccctgccgccgcacggctcggcagcgcccgccatatcgccgccgccgccggcatcgccatgccggccacgccgcgcgacgccgcctggctggacggtatcgacggtttcgatgcccgccgcttccgcttctcccccgccgatgccgccctgctcgatcccgaacagcggctgttcctggaaaccgcgcaatgcgcgttggaagatgcgggcctgggcggtgcggcgctgaagggcgcccgggtcgccgtgcatgtcggcggcaatgccaacccgctgcaccgccaggcgctgcgccacctgtcgggcgcgcgactggaacaggccttcgcgctcaacgtgccgtcgaacatcgcgacccgtctgggcttcctgaacgactggcacggccccgccagcctggtcgacaccgcctgttcctcggggctggtggcggtggatgccgcctgccgcgatctcgtccgcggcacggccgatgtcgcgatcgccggcgccgcccggttgatcctggtgccgcagggcgatgatcagcgcatgaccatcgaaagcagcaccggccgcacccatgcctttgccgacggcgccgatggcaccggcgccggagagggcgcggtcgccctggtgctgaagccgctggcccgggcgctggccgatggcgacccggtgcatggggtgatcctggccaccgccgtcaaccaggacggcgcctccagcggtgccgccgctccgaacccgatcgcccaggccgatgtgatccgcaccgcctgggaccgggcgggcgtgcccttcgccagcgtttcctacatcgaagcccatggcaccggcacccgcctcggcgatccgatcgagatcgaggggctgacccgcgcggcagggacggtcgccttcgccgagccggcgatgatcggctcaggcaaaggcaattacggccatctggacaatgtcgccggcgcgctcggcctggtgcgcgcggtggcggcgctggcccacgacaccgccccgccgcagccctttttcgaccggcccaacccggcgattgatttcgcccgcgcgccggtcagggtcgccgcccgcgccacccgcctgcccgatcgcggcaccccgcgccgcgccggggtcagctctttcggcctcagcggcatcaatgcccatgcggtgatcgaagccgccccgccccggccggcggcggcgatggatccggacggccatgcggtgatcgtgctctcggccggcgaccgcgcggcgctcggccgctatgcccgcgccctgcacgaccggatcaccgccgatgccggcctcgatcttgccggcatcgcctgcaccctgacgcagggccgcagccatctggcctggcggttcgcggtcgccgtgcccgaccgggcggcgttgctggcggcgctcgaccggctggcccggggcgatgaccaggacaccgccgaggtcgcgaccggtcgtcaggtccgccatcagaccgtcgccgcctggcatgccgatccgaccgcagccgcagccgcagccgcagcccgcgcggttctggatggtgccgtgccggtctggcccgacttcctgcccgcccgccgccaccacctgccgccggcaccgttcagccgcatcccctgccggatcgatctacccgcaaaggctgcaaattctgatatcgatacaactttcagcatggggtggaccgccttccccggcggccgggcgctggccctgccgctggccgatcccgcgttctggccggtggcggagcaccgcctggccggccggccgacccttgtcggcatggccatcccggcgctggtcgccgccgatcgcggccccggaacggtgctgcacgatctggtctggcgccgcccgctccatgccggatcgcgcgaggcgagcctggtgatcgcccgcgacggcagcgtcaccgccggccatgccacggcggagggcggctgggcggttgcagccgaggcccgggttgagacgtcatccgcaccgcatccctcagccgtggacctgtcgaccgacggcctgatcgcgctcgacctcgcccccttcgacggggcggagggggtgatgcaggtgggcccgcgctgggattgccggcaggcgatctggctggcacccgatcggcgccgcgccgtcgccaggctggccctgcccgccgcggccgccgccgatcgccggctctggccctggcatccggccctgctcgacatcgccgccagcctgctcgcgggggtgggagaggtcccgcgtgaggtggcggccatccgcatcctggcgcccctgcccgacaccgtcatggcccgcgccgaccgccgccccgacgggctggtcgacatccgcctggccgacgcggccggccggccgtgtctgctgatcgacggcctgcgcttcgtggcggcagacggccgggcggcgcccgagcttctggcgccggtctgggttcccgcacccctgcaccccgcccccctgccggccgggggctgccttgtccgcaacgccgacgatctggcggcggctccggccgatgccgcgctgatcctgcagctgccgaccggccccgatctcgtccgccggaccgccgatctgctgaagatcgcgctcgcccgcccgggtaccaggcggatcgccgtcaccggtgccggcaccgagactgaccctgaccgcgccgcggtcgccgggctggtgatcgccgccgcccatgaaacccggcaccagaatctgcgctatctggacgtcgacgacgatgcggcgccggctgcggtcgccgccgaatgggcggcggcggtgccagagcgcttcagcctctggcgcgacggtctgcgccatgtccgccggctggatccgattgccccggaaacggcacccgtctggcccgatcacggcgtggcggtggtgaccggcggcaccggcggcttcgcggccgccctcgccgaggcgctcagccatggcggtcgggtggcccttgccctgcttgcccgccgtgccaccgcggatgacacgctcgccaccgccatcgcccggatcgaggcccgcggcggccgcgtgcagctctatgccaccgacatcaccgatcagccggcccttgccgcgacgctcgcccaggtgcgcgccgatctggggccggtcaccgccgtggtgcacatggccggcatcgccgacggcgccatgctggcggtgcgcgacatggccggcttcgacgcggtcatggcgcccaaaatccagggtgcgcgcaatctcgacgcgctcacccgcaacgacccggtcaccgccttcgtggtcttcgccagcctgaccgggctggtgggtgctgccggtcacaccgcctatgcggcggccaatgcctggctcgacggtttcgcccgccgccgccgggccgccggcctgccggcgctggccatcgactggtgcgcgctggccgaccagggcatggccgcacgcgccggggccgatcgcgcccccggcgcgccggtgatcttcccggcccaggcggtcggcgccatgaccggcgcgctctccaccggcgccgtccaggtggtggtgctgccggcggggcttgccgcaacgttgaatgcgccgccggcccctgcccgtccggaacccgcggccacggccatgcccgccgaacccgccgacctcaccacccgcatcgcccgcatctgggccgaggtgctgggccacgacaccgtcggcgccgatgacgatttcttcgacctcggcggcgattcgctcgcgggcctcgacatcgccgagcggctgacggcggaaaccggccagccggtcaccctgcaactgctgttcgaccacaccactccgcgcgccctggccgcacttctggcgcccgaggccgccgaacctgtttccaccaccatcccagctcccacccagacgtctcccaccctggcccaccagatcgccgcgatctgggccgaggttctgggccacgacaccgtgggcatcaccgatgatttcttcgatctgggcggcgattcgctttcgggcatggaaatcgccgatctgatcaccgcccggctgggccagaccgccacgctcgccctgctctttgaccacaccaccccggcggcactcgccgccaccctcagccccccggcggcactcgccgccaccctcgaccccaccgaaacgacaccggatcccgcccccgccgatccccgccgagcgccggccggcctcgatgcctggccgctcgcctgggaacagcgcgcagtggtggaaaccgaggcgctggccggcatgggcaccgccttcaacctgccgcatgaaatcgacctgcccggcgacgtcgacatcgaccggttgcgggccgcggtggcggcgctgatccggcggcatgccgccctgcgcacggggatcatcggcgcagaccacgctcagggaggcgagggctggcccggggacgacgactggtacgggggcgacgactggtacgggggcgacgactggcggatggtggcgattgacgccgccatcgtaaccccttccctcgccattgagccgatcgcccatccggtcggcaccgcgcccgcggcccccatccggccgttcagcaccgatggcggcgcgatggcgcgctggtcgctgcaccgcgacccggccggccggctggtgctggccttcgacattcatcacagcatgtccgatgcccagggcgtcgaaatcctgctcaccgagctggcggccctctatcagggccgggatctgtcgccggttcaggtggatctgcgcgattacggctggtggtcggccgtgcgcggcgatgcggcgatccaggccgcgcgcgcctggtgggacgggatcttccctgccactgcccagggacgcgatctgccgggacgcgatctgccccggctcgacctgccggccgatcggccgcggccgccggtgcatggccatgatgccgcggcaaccggcttcgacctgccgccggcactctcgcgcgacatccgcgcgctggctgcccgccggcgcacgacccccttcaccgtgctgctgaccggctgggcaattctgctctcccggctgacggggcgcgacgacatcaccgtggcactgccggtcaacacccgtgccgccgccggtttcgacggcgtggtcggcatgcatgcggccctggtgccggtgcggatgcaggtaccggcggatggcagcggcgccgcacttctggcccatatccgcgaccgtcaggccggcgcgctcagccatcacgccctgtcgctcggccggatgctggccgaattccaggccccggcgatgccggagcgcagccccctgtccgaagtttcgatttcctacatgaaccatgccgcaaccgcggccggcacgctggatgcgggcggcttccggttgcgcggcctgacccgggccgacggcaagaacgacctgtcggtgttcatcgccgacaagggcgagggcttcggcctggtgctggaatacgataccggcctgttcgatgccgcccggatcgaggccctcggcccgatgctgcagcggatcctggccgggctgaccgccgatcccgaccagcccgtgggccggctgccgctcctcgacgatgaaacccggggcctgctggcggcgcgcgaggcggcagaaggtgtgtcggtgctcgacgatcggggccagccggtgccgcccggcgtctggggccggctgcaccggctgggcgacgatggctggcagccgaccggagacagggcccgctggcggctggacctgaccgcgatcgagaccggcggccggctcgaccggctgacgctctggcagggccatctgctcgacccggcgctgatcgaggcgcagctctcaggcctgccgggagttgcagccctccgcattctgccccgcccgggcaggctggtggccgccatcaccgctgccggccccggcccgatccggcccatctgcgccgggcggccggggcgatcctgccgccggtgctggtgcccggcgcctggcatctgctcgatgccctgcctgaagacgatgcggcgctcgccgcaggtgtcgccgccaccccgtcgctcgaagaggcggcggaggccgcaaccgaacggctcgccacggtcctcgccgtcgtctcggacgtgctgggccggccggcgaccgacccgtcggccgatttccatgcgctcggcggccacagcctgctggccatgcgggtggtgaaccggctggaggcggcgaccggcatccgcatccccatgcgcgccttcttcgccgatgcgtccatggccggcatcgcccgcagcctgggcgaggcggccagtgaggcgacacgtgcggcggcggaagatgtcatcccgcccggcgccggccccggcgcccacccggccagccatggccagcagcggctctatctgttgcagcagatgcagcccgaaagccccgcctggctgatgctcttcgtcctgccggccggcgccgtcgatgcccgggcgctgcgcctggcgctcgaccggctttcggcccgccatgccacgctccgcaccggctttgccaccaccgatgacggcatcgtccagctggttgcggcagaagcgccgccgccgctggtggtggacgatctccgccaccggaccgacggcatggacgaggccctgcgcctggcccggcacgaggctgccacccccttcgacctggcggcggcacccctgttccgtgcccggctgatccgggtcggcgaccatgaaagcctgctgctgctggtgctgcaccacatcgtcggcgatggctggtcgagccggatcctgctcgcagaacttgcaacgctttatcatgctgcaaccgaaggacgtggcgacccactgccgcctctgccggccagctatgccgattatgcccgctggcagcagggccgggactggcaggcggcgctcgacggctggcgcgaccgtctggccggggcacccgatgcgatcgcgctgcccaccgaccggccgccccgccccgatgcctcgggccgcggcgccaccgtccggcgcgagctgccggccgaggttctggccgggctctcccgggttgcccgccggcacaataccggtctggccgcggtcgggctcgcgctcttcgcggccgtgctctatcggttgagccgtcaggatgacatggtgatcggcatgggcgtcgccggccgcgaccgggccgaaaccgaggggctgatcggcttcttcgtcaacgttctgccgatccggctgcaattggacgacgagaccgggctcggccagttgatcgatctcacccgcgaccgcctggccgaggcgctggaccggcgcgagctgcccttcgaccggctggtccgggcgctggccccgggccgtgccggcggccgccagccgctcgccaatgtgatcttcgaataccagcgcttcgacgacgtgaaggcggccaccaccgaggcgcagctgccgccgccgccggccgatggcgggcgtctgggatcggccgtggccgggctggtcgatgcctcgaccgccaagcatgatctgatcctgttcttcgaggatggcggcgaccgcgccaggttttcggccgaatacgacaccgacctgttcgatgccgcgacgatcgaggcctggacaggctatcttctgcgcatcgcgactgcggtggccgccagtcccgacgagatctgacccgacgagatctgacccgcctccctaccgcttccggagccccc
